United States Patent 7,868,149 (PLANT GENOME SEQUENCE AND USES THEREOF) - sequence listing, part 89

SEQ ID NO: 46649 - DNA, 35615 bp, Oryza sativa
cttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagacagtgacggcgctccgcaagctctcctctagttccctccgtgtcacgcccagaaattcacgaaccagaatttctaagctgaatgtgtattaaacccctgtccaggaccagccagggtacacaaatgacaattgttgacatacatatccacgttttacaaaaatataagagattacaaatgcagcggaaaagataaaagcgagctaagcctgaagacttgactcctgcagcggacgactccattccacaggcatccttgacggcagcgacgaaaccaacctcttcgagacatcttcaactgagaaggacttcaactctggtgtgggggaaaagagagcaagactgagtattacccactgtactcagcaagtcataccggaagaggaggtatgatgcagggtatatccaagggaggctaaaggttcttttgcatgaagctagcatttaaaagcagttgttgaaagcagtaaaacaattgcgttaattaatcaatattaaccaatcactgctcaacgctacaccacgttgagacaggcccaaaccaccacctgaactaaccagttccaaaagataactaggggtgagactaatcacggtgaatctggtcgaccgcccataaccgcgggcacggctattcgaatagttttactctgatcagaggtgtacaactgtacccacaagacacagccccacgacacgttcctgtgcgccgacatgccaccacaacataccggaaagaggccgtgacaggacccttcgcataaccccctctaaccgatcgcaccacaccttagggttcgcccccgtccccagcaggcaacgggcagcccccctttcgtgcctcggtgaatccggaagccgatcaaccggacaccccggccgacccaactccatcacatccaccctcgcctgggtacgtcggctagagaaaagctacactacaagcccagccgttgcccacgctggcttgtggtaagtacgataagttcttccagggcatcccgtgaaccggtccttaattgccatgggcacgactagcaaaaccatgcacccacagcccaccatgacgtgtattttaattaaccaataccattacggtggcaccaaaccaaagctatgccgataatcaaagtctatgctttaatgtgattccctttttgtgtactagtagaactaagcatggctaagcatttcctaaaccaacatctagtcattttaatacccaagttatcaatggcgtaagggaaacaacataaagctgagtaataggacccatcccacatgatattgtaaaacgatgcaatatttaatagaaatacaggacatttgtaaattgggtacaatatgctcaattgtaatgtatgacttgccttgctctcgcactgatgagaccacagcaacgtcttcgagaaaccgcgaatcgacgaaacggccgaaatctacgcgacaaacaaagcacaccagcaaaacatgctataagactactgaaacaggaaacaaaaccatttttaatggattctacacatttttatgaatttactgagacttgaatggacttaatcggagctcggatgaattagttatgatttttagaagattatctgtgtttttactataaaagaaaaacccttaatcaatttattgcgcaataattcctcccagggctgacgtcagcaaggggtggggcggcgccgacatgcgggccccactggacagaggcacaagagagagggagagggggcggctggcaggcgggacccaccgggcggcggctcagggggggagacgcccggtcggctcggctcggcctcaaaccggccgaccggttatggcgagggcggcggcgcgcgagcacggtcgccggcgacggcaaccggcggcgggaggcggcggcggacggcgcaaaggcggcggcggcggcgcgcgcacggaggcagcggcgatagggagctcgggagcggacggcgaaagagggaaaaaggtggagagaggcgcggtggtcggttatatagaggtggggaggctggacgtggccgggagcggcggttccgcggcgacgacgtggagaggtggaggaggagagagagggggagaggattcaaatcgaatcccgtccgtgcgggcgcgcgcatggacgggagagggcagggcgtggggcggcgacgtggggacgtgtgggcgcggagtggggcgcggatgcggaggaagcggcggcgtgggcggcggtttcagcagcggatggtggcggctgccggaggttagggacgaccgacaggtgggccccacctgtcggcgcccgggaggagaggggaggtgggctggacttcggggaggggaggtgaagcgggccggcgcgggagggaatgggccgggctcaagaaaaaggaaaaaggagggaaaagaaaagataaaaaggaaaaaggattttcccagggatttatatattgcacatgctcatttttaattggttaaaattatttccaatgctctgaaaattccgctaaaaatcctgttagcgtattttgacatgtagaatccaagaaaaattccacatgccgaatccgattattatttgcatttattaatttagggtttctctcttgcctttaaacaaataatttcttccaaccatttattaattgaatttttgctagggaaataacttctgggcgcccgtcgccgctccgctcgcaccccgccgccgcgcttgccctccaccgttccgcccgccgcccattcgtcaagaaggatttgaggtccacgacggcgcgacgtcctgatcttcgagctcgtccgccgctcgcttcatcccctctaatactgcgtcgttggcaatcatgcgtcgcttcgtcgaggtccacgatagcggcggcggaggacactgatgttggcgaggcgaggccggagaacgtgacaagcgaggcggtgcagccgtggtgtgcgactaggcgctgcaacagctcagccatcggtatgacatggccggcgaaggggctgacgatgaggatgacgtgcggcggcggtgggcgatgtgacgacggaggcagctgagggatttgggggttctttttggtgcccagggctctactgaatgcaatgtagatggttagcttcggtcaaaccgggtatggaccttaatgagtcacttaaacaagatggtggacctagatgtgcaatttacaagattatggacctaagtgacacccgcgcacaactttaaggaatggtagtgtattttactctatataaaaaaagaggggcgatcctaaacgtagaaaaaaccacctcctcctattatgctatgaattatcttaagaaagataattcatagaaaaaaagctgctcatgagaatatagaaaaacatgctttttctatcttgtggcttctaacacattattttaatttcatagttatattgatgggaatttaggtgaaaaatttctaccgtctagagagccataaattatggaaaatgttgtattactataaactctcccgaacaaggacgaaggagtgcaagcagcttaaaatccacataacttccttaacgcctcgttattttctgattaagttacagatcttacccactactacaaaacattaaataggtgttgccactatagatactgaaagtactaaaaccagcacctataggccttttccaatttccgcgggttgaaattgcaaaaaccggcacctttaagcaattataagtgccggttctaaataagaaccgacacctattctataggtgtcggaccgacacctataatatattataggtgccggttttttaaaaaacgacacccacagaaatctagccgaggcggcatcggatgagccaaccagcgggccccaccacaacgaggcgaggaggagataaggttcgctctcgcgtcatctcgctctcttctctctctccctcccttctctctcatctctatcttctctctctccctcccttctctcccgctaccggcggaggcggcagcggcgaccgcgcccttccctcgctagatctagcgggaggggaggtggcggtggcaggaagggaggcggtagcagggatcttgaggggagcccgtggtggcccgacggccaggggggaggcggcggcaacgccttcccctccgctagatccggctggaggggaggcagcggcgcctccgctccaccagatctggccgggaggggagtcagcaacggctcggcggcggcgggaggggcggcagcagcaagtggcgtggctcacaggcatcggcggcggcgacctcccatctgccaaatccggcgggagggaaggcagcagcggcggcggagccccccctccgccagatccggcggggtaggcagcggcaacgacagtggcgggctcccttgtctcttctaccactggtgagcacccccaaccatctcctttgcttgccggctgtgtcattgttgatgtttgattcgatgattcaataatgtttgatgtttgattcagtgatttaaacttgttgatgaatatttgattgtgtgatgtgtacttgtctttttttttttgatttttgatttttttttttggctttaaagaattggctcgactcaaatcgagccgatcgggcttttttttttttttttgcaaatcgtatacctcaaaggtgtcggttcctaaaccggcacctttgagtcatctcatcagtgccgccttggtggtgctggttgggaaaattggcacctaaggggatttcccaaccggcaccgaaggctctttctgtggtagtgaccctggttttgttagcacgtttttcaatctgctaggtgtatttcgtgcgaaaactttttatacataatttaagttgctttaaaatatcagataaatctattttttaagtgtataataattaaaagccaattaatcatatactaattaatggatttcttgttttcgtgtcctagctacttcatctttagtaaaaacgagcatcaccaaactatgttccccggactggttggagagtggatatattttaaactttcgagaagacgttcccttgttgtttacatatcactcaaaatagttattaaaaaatttaaaagatatattaatatataatatatcagtatttaaaattcaacttttacaagttgtaaaaaaaaagtacagctagttaatgtatattgatagtcattttttttttgcaacatgtagaagttaaatttaaccttgcatgtttgtttggtgatctatcatatattaatatatcttagtgactttttttaaaaaaaaaattaactatctttatataataaaagtccattaaacttcctacaatcactctcaagccgccacgtggcatcctaaaaatactcccgagtcgccacgtggcattctaataaaatagagaaatctgaccatcgattttcacttaaataggtgggcccattattttagatcgttagattatctttaaagaaaaaaaaccccctgccgtccctacctccgtgcaggatgcgtattgtacgctccctatcaccccttctttttttttctctttgtttctttcttctttttttatctttatgaaaaaaaatccctacaaatagacatcgtacgagtaagtccattaaacttcttagaaacgcttttaagccaccatatggctcctacaaacgctcttgagtcgccacgtggcgctctgataaattagagaaatctaagaaattccaataaaaaaaagaaaaacatcgtaccatttattttctctttacacaccattagatctatatatgtaaaaaacaaatgtcacgtacgaccacacctctccctaggtccctcatctcctaacatgtacgtgcatccaaagtacgtatgtctccccacccctctcttcttccttccatttatggtagcaaaattttgtatataaaaaacacaacaactaaataattagaatatcttataatatattcgattttaatttgaactatgtttaccatattttggtatgtacatatataagaaacatatcatttgacataaacccctttatcgcaactaaatagtaataaaatattacaaaaagtaacatatatcatgccattgtaaatgatctcctattatctctcgtgctcactttcttatccatattttctagcgagcagttcagtacataaagaaccaacaaatgctatattaactatctattatatacttaaaaattcattaaactccctacagatcctcttaaactgtcacatggttttctacaaacactcatgagatgccatgtagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctatctaactacaaatatttgagcaaaatagcacttcgaaaatgatgaatgaattcaaatgtgtgggtctaaagtccaagttcaatcatcaccaaagaagcttggaaccagaatgcacactctgggcctgaacccgatgaaggcggagctataagacattattagcaaggtggacactgacggcagcggcatcatcgacttctacaagttcctggacctaatagcgcactaaatgattagatgaaggacaaggactaagaggaggggaccagagggagacgttccatgtcttcgacaaggactagaaaacagcttcatctttgccaccgagccccaccacgtcatgtctaatgtatcaagagaggctcactgatgaggaggtcaacaatgatccgcaaggctaatggtgacaggtggatcaccacaaggagtttgtaattaaattcagaacaaaaatataaaacaagcaatttgattaaaatacacaaacaaaaaataaaaaacactaaaactataaaaaaaaaataacaagattccatgtagaatataaaatatcaagagtccctataaaagtataagttataaatatctaaaatttggaataataaaataagtattaaaaaaagagatcaaatacagcacgatatgagattaagcgcaatttaaaatccctaaaaagacaatttagaataaagtaatttgatttgaatacaaagtcgaattaagaatcactcaatcactaaattcagaatacaataaatattttttaaagaatttttctatctttattgattcacatgcataacaaattgcatatatatgaagcaattaaagagagggctagcagaatggtaaaaatatatatttattaccaatgaaagtttatcgagatttcttcacgaaaaagagatataataaatactcaattaacagtagagaatacattactttaattttggatagactagttcttccatgctttgcttgctctcccttgtgaacacagagtacactcctctaaactaccaagtctcacttaagtcgacggcctccacacttcagtgaatccactccccaattaggaagactctacgcactgactcgttgctccaagtcaagctggtatcaccgtgcgcaccgacgccggccggccgcggcggcgatggctggctttccgctgatcacatcagcgatcacttgcgcagtgggcatcatcttcttctccgtttgctacctgcatccggcaccggtcgccgccttgtacttcaactactccaccttcagccaggacgacgggaacaccatcagactcgaaggcgacgcctccttcggcgacgggtggatcgacatcagcgccaacaggtacggccacaggggacacagcaaaggccgggcatcgtacagcgcccggccgatgctcctctggagcagggacaccggcgaggttgccagcttcaccacgcgcttctccttcaacatcaccccgcccaaagaggacggcggcatcgacaacaagggcaccggcatggccttcttcctcgccgcctacccgtccatgctcccgagcggggtcgatgagctcggctacaacatcggtctcaccgaccaaggcccggacgccgtggcgactggcgacagccggttcgtcgcggtggagttcgacaccttcaacaacaccatggtgcacgaccccgacgccacctacgaccacctcggcatcgatgtcaactcagtcgtgtccaacaagaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgctgccggagctggtctccgttggcttctccgcctccacgaccacatcctttgagctgcatcagctgcattcatggtatttcagctcatcgttggaaccaaaggccgcggtgcgtggcagagttgtagcgggagccaccgttggcacggtaatgttcgtcatactcctcttcgccatggtagcagtccttgtacgacaacgtcagagcaagaagagggagacagaggaggcaaagaacggaggcatggatggcagcgacgacgacgatgacgacgacggcgagaccatcgtagagatcgagatggggacggggccaaggcgatttccatactacgaacttgtcgaggcgaccaagagtttcgcggcggaggagaagcttgggcaaggcggtttcggcacagtgtatcggggctacctcagagagcagggcctcgccgtcgccataaagagattcaccaaagattcctccaagcaaggcaggaaggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattggcgaacatattgtcaaattttactcaggtttacgaacttgctaagtgcacatcgagatctctaaacttggtttagagtatcatctcggtccaaagccgcgtttgaccgtgctcttgcctatgtgacacgccacatagacgatgacatggaattttttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtgtacgcattgactcgatcaatcaacggggagggaacacaacacggcggccatcgatggccggcgttttgcagatcacatcgtcgacgaccaccacgaggtacaatattgtcggcctcatcttcttcttctccgtcttctgcgacgatctctactcgccggctccagtcgccttggccttgaccttcaaccacaccaacttcggcccggacgagcagacgaacatcaggctggaaggcgacgccgccttcagcgccgacttctccttcagcggcgacggcggcgggtgggtcgacatcagcgccaacaggcacggcagcatcgaagacagccgtggcagggtgtcgtacgcccttccggtccctctctgggacgccgccaccggcgaggttgccagcttcaccaccggcttctccttcgtcatcaacccgcccaaacaggacggcggcatcgacaacaagggcgccggcatggccttcttcctcgccggcttcccgtcgaggctccccggctcctacccctacaacctcggcctcaccaaccagaccgccgaccaggtggccgccggcgacgaccggttcgtcgccgtggagttcgacaccttcaacgacaccatcgtgcacgaccccgacgccacctacgaccacctcggcgtcgacgtcaactccgtcgtgtccaagacgaccttgaccttgcccagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgttgccggagcaggtcgccgtcggcttctccgccgcgacgtccacatccgtcgagctgcatcagctgcgttcatggtacttcagctcgtcgctggaacccaaggccgcaccgccaccggtggcgccgccgtcaccgtcaccaccgcctacctccggttcaggaagtggcggggttgtagcgggagccaccgtcggcgcagcactgttcgtcgtgctcctcttggccatggtagcagtcgtcgtactcgtacgacgacgacatcagaggaagaagatgagggaggcggaggaggcgaacgacgacgacgatgacacggaaggcgatcccatcatggagatcgagaacgggacggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaacttaattgacgaacatattgtcaaatttaactcaagtgatcagctaacttctattttgtcacagggtcaagattattcttgggctcggatcagccctattctaccttcatgaggagtgggagcaatgtgtcgtacaccgtgacatcaagccaagcaatgtcatgttggatgagtccttcaatgccaaactaggtgacttcggacttgcaaggttcattgatcacatcgtggggatgcagacaatgactgcagtctctgggacaccgggctatgttgatcctgaatgcgtgatcaccggcagagcaagcgcagaatccgacgtttatagcttcggcattgtcctactggaggtggcgtgcgggaggaggccgatgagcttactagacagccagaagaatggtatcttccggttggtcgagtgggcttgggatttgtacggcaagggagacattctcatggccgctgatgagcggctcaacggcgactacgacgcggcggagatggagcgtgtcattgtcatcgggctctggtgcgcacaccctgatccgaacgcgcgtccgtctatcagaaatgccatggctatgctccaatccggtgggcaactgccagtgttgccggctaagatgcccgtgccgatgtacattcctccagtggtctctgtagatgagctcttcacgtcgcctgcagggatgtcatcctcaagtgcgacgcagtcatcaacaacaacggtgagtggctacgcaacccacatctcgacttcttctgacacatccacttcagctggttcgaaggactcgtcttcgttgctcaaacatcagttctagtaatgttcagttcatttgagttgttcttgattttacagtagttgatgcttggatgggatgttcagctcgtcagcgcccgttgatttgatctttagacttttgcttaattgccggtgtgagtaatctggtatttacgccatgctttgaacttttacagtcattttaagtttgtctacaaatatgtatgtataaatgtataatgccacatttctattcattcagattgccgatatacctaacagctcgttctttcgatcgtccgcttgctagaagccagttaatgttctgggcctcaggcccattagtagagtaggcctccatcctccttattgccttcaccatcaggcccatagtacaaagttaggctgggccatagcctgcaggcaaagttgctttaatcaattcctagtgattttgctatatactgtatttattagcaaattttctcccaaaatattgacatgtaaatataatataattatagtgtaactacatcgttagatttgcttcaagattcgtactaacgagagaaaaaaatcacaccgcatacacatctggggattcggtcacatgacctccattttatagaaatagcatattactaagagatttttaaaagttacatacaagttaaattttagttttatgtaaattaaaatgtattgtactatttattttatctaccaaaatttttgaagaaaatttataaacgaatatataggtagtaccattagaggaagctattagcagagaccttgagacattgactggtctctcttgagtagatagatatatatgtactttttttttccagcatcactctcgatcaatcagtggatggctacaataattttagataggatagtgctagtccttgacttatggtctcctgaaagcaactactacttgctactacaatagtttcagtcttcatataggctcctgtagtccttcgacttgcggtttcatgtgcattgcacctagctctactatcaatggtgattggtgatcagatgtgtttgtgttttggatatatatatctagatatcggtgcctaactttatacggtagtataattttttaaaggtagaggacaacaataatttatactatcaattattcaaaggatttttataactttgtgtcgttagaacgaaaccagtgcacgtgcttaaaatcaacatcagcataggctcattatattcctcgaagtctagaaaattaatcaaaccaatgttcatggaggcaatggttaattttcagtcacaattttgagaagtttgggcgcaccataaaaaaaataaaatacaccagcagttcttaaactagttaggaggtttcactcaggtttacgaacttgctaagtgcacatcgagatctctaaacttggtttactgtatcatctcggttcaaagccgcgtttgaccgtggtcttgcctatgtgacacgccacatggacgatgacatggaattcttttctcctttttcttttttttttctcctgcgcaaccgaatcgttaaccatgttcccttatacagtttcgcatactcgttcgtccagttgttagttattcacaggctgtcgcacgtgtggaacgaagaaggaaaaggaagtatccatgtgctttcctgatgggccacccttacctttcttctaaaattcatcatcatgtctccacactactgccactgcaaacagtatacgcattgactctattaatcagcgggggagggaacacggtggcgatcgatggccggcgtcttgccggcaaccaccacgacgaacaatattgtcgggctcatcttcttctgtcagatcgtcatctgacagtgctgaggaagatactgaagaagaactgagcttggaagcagagcaggacgatgatgagaagatgcaagctgaagctgaagatgcagagcagggaggagttatggaccatcaacccgcgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacaatctggtatcagagcctcaatttgtctcgaaatcctcttgattttgctgtaaaattccttgcaagggattggaaccgacttcggttggattccgcgaaaaggaaacttgcccttctaggttagcgaaattcggagagtagacaagttcaggcctcggatccaggagtagcgccatggatacggatgggaagcttgatgtgttgctcaagttggtggaggggaacgagaagaagcgggtggaagcggatgagtgtacgagggcggagtaccaagagctcaagaagacggtggaatccagaattcctgtggttgagaagaaggtggaggtgttgagcgaggcgttgctcgagctgaatctcaaggtgaaccgcttggagggatagatgcagaggacagttaaggaagaagttcctcaaggcaaggttgctgatccgaaaccgaccacaccatctggtatgcgagatcttcacctgttttcctctgcttctactttcggaaacaattctaggaagtctgatcaaggaggtgaaattcccatggacattagtgctaacggtccacccatggtttgtccacaattcaatggtgataaccctcagatgtggaaatcaaattgtgagcaatattttgaagtttatggcacacatcctatcaattgggtaaaaattgcaaccctgaatttcgtgggcaatgctgcgttctggatgcaatctgttaggtctcaactgcagggaattacttgggtggggttatgtgaattggtgtgtagcaggtttgctaaagataggcatcaggcactgattcgccaatggattcatatttctcagactgggtcagtgagtgagtatgtggaaaaatttgatgggttaatgcaccaactaatggcctatgattcatcattagttcctgtttattttttcaccaagtttgtggaatgattgaaagatgagataagagtagtggttatggttcagaggccccaggatttagattctgcttgtgccatagccctgctgcaggaggaagctttagaaggtgttaaggccagtcattacaggaggtcagacccaggggttatgctcaaaacaaatagaactggacctattgtgggagttactcagcatactaagaacaatttgaatcaatctgaagacagaaggggcactgaatctgctagagctaaagatgataaggtggctgctctgagggcttataggaggtccaagggactatgctttgtctgtggagaacgatggggtaaagaacataagtgtgcaactacagttcagcttcatgtagtggaacaactgttggcagtgttacaacctgaaattgacagtgattctgataacattgaattgggaacatcaccagaacaacatggcactttattgaccatatctcaacaagctctgtggggaactgaatcaaatcagtctatcaaggtgaatggttgggtgcagggaatggaactgatcatgcttattgactcaggcagcacacattcgtttgtggatgaacaaattgcacttaagttgatgggagctagaaggttgcaacaacccctaactgttagaattgctgatggaggtgtcatgcagtgcactagggaaattgctgactgtcgttggtggatgcagggacagagtttctgcagtaatttccgactgctacccctgggaaattatgatgccatattgggtatggactggctcacaatgcacagcccaatgaaggtagactgggttcaaaaatggatggaattccaatacctgggaagggatgttcgaattcaaggaattactaatcagccagcacagtgttctcatataacacacaaccagttatctggcatgaacaggaagggttcactgttgtattttatccagttacaaaatatggccatacaggagaatagcactatttctgattcagtcaaacctatgttgttagagtttgctgacctctttgaggaaccaactgaattacctccgagaagagcttgtgatcacagcattaacctcattccaggggctaaacccattaatctgagaccttataggcacaatcctgctctcaaggatgaaatagagaggcagatagctgagatgctcaagtctggggtgattcaacccagccaaagtcctttttcttccccagctatacttgtcaagaaaaaagaccacacttggagattggtaatagattacagaaagttgaatgccattacagtcaaaacaaaatatctagttccagtgatggaggaactactggatgaactatctggttcaaaatggtttaccaagctggacttaagatcaggttatcaccaaattagaatggctgagggagaggaacacaaaacagcctttcaaactcattctgggcactatgaatataaggtgatgtcttttggcttgactggggcacctgcaacatttttgggggctatgaatgacactctaaaatatgtacttagaaaattcgtcctggttttctttgacgatatcctgatctatagtccagattttgagtcacatttgactcatgtcagacaagtcttacaactacttcagcaatatcagtggaaggttaaattaagcaaatgttcttttgcttagtcacagttatcttatttgggccacatcatcggtgcaaatggggttgcaactgatccacaaaaggttcaggatatactcaattgggagattcctaccaatgttaagaagttgagaggatttctgggattggctggttattacagaaaatttgtacaaggctttggtctgaaaagtaaacctctgaccaatcttttgaggaagggtgttccttttgtttggagtacagaagcagattcagccttccaggctcttaagacatctctggcctcagctcctgtcttggctttaccaaattttcaaaaaacctttgtggtggaaactgatgctagtgactatggaatcggtgcagtactatcacaggagaagcacccaattgcctatataagcaaagccctgggtcccaggaccagaggtctgtccacttatgaaaaggagtgcctagcaatgatcatggcagttgatcactggaggtcttacctgcaacatgttgagtttataatactcactgatcaccacagtctcatgcacctatcagaccaaagactccacaccccctggcaacataaggccttcacaaagttactgggtttacaatacaagatttgttacagaaaggggagtactaatgctgctgcagatgctctttctagaaaaccacagcaatctgaggaagagttcaatgctatttctcagtgtgttcctcaatggctgatggaagttttgcagagctatgatactgatccacatgctactcagttagttgctgccctgacacttaaccctaattctaagcctcatttttcacttcagcatggagtcttgagatataagggaaatatttggataggcaacagtcctgacttgcaacttaaaatcattaatgagatgcatgccagtccagtaggagggcactctggatttccagtgacttacagaagaatcaaacaattatttgcctggaatggaatgaaatcccaaattaaggaaacacttgccaattgtcaaatttgtgctcaagcaaaaccggatagatcaaggtatccaagactattgcagcctttaccagtccctaaaggtgcttggcagactatatcattggatttcattgaagggcttcccaggtccagtcactacaattgcatcttagtagtagtggacaaattttctaaatactcccacttcatacccttgagacatcctttcactgcaattgatgtagcaaaggccttcatgagtaatgtgtacaaactccatggacttccacaaattatcatctctgacagagataaaatttttacaagccaattgtgggagcagttatttctgagatctggcactaaattacattacagttctgcttatcaccctcaatcagatggacaaacagaacgaggaaatcaatgcctggaaatatatttgaaatgctttgtccagtcagcaccttccaaatggccttcttggttgcatttagctgagtactggtataacaactcataccattcaactattgacagaactccatttgaagccctgtatggatatccacctcgccattttgggatcagcatcagggactgtgacaacagtgagttgataacttggatgcaggatagaaaattgatgcaacagttagttcaacaacatctgcatcgtgcacagcaacaaatgaaactttttgctgataagaaaagaagttttcgacagttccaggtgggtgagtgggtctatctcaagttacagccctatgtgcaaagttcagtggcccccagagcgaatcacaagctggctttcaaatattttggaccatttcaaatcctggagaagttgggtactgttgcttacaaacttcagttgccagccacaagttccattcatccagtctttcatgtatcacttttaaaggaagcaaaggggttccagccatcagtgcatacaccattatctccaacttactctgctgtccagtatcctatagcattactggatcatcgtcttaccaaaaaaggtaaccatactgttcaccaggttctaactcattggtctgacactattccagcacaagctacctgggaggatctgcatgacttgaaggccagatttcctaatgctttggcttggggacaagccaaaactcaaggggaagggattgtcagatcgtcatctgacagtgctgaggaagatactgaagaagaactgagcttggaagcagagcaggacgatgatgagaagatgcaagctgaagctgaagatgcagagcagggaggagttatggaccatcaacccgtgttgcggcgcacttcaaggactgtcaagcccaacccactgtaccatgggccacagtgggccgtgtaactgaattcgttgtaacagctgtctaacagctagcgtgtcgcgtatgctgtacgttgagagcgagagagagaactatatatatgaattggggatgaactagagaggaggacttttggcaatctggtggcgaaggcggcggaaggctcaatcctgttggattggtgcataatacatcagtaatcgattgccatatatcttgttgctgttctgtgattgttctagttagattagatcctaacatcttcttcttgtccgtcttctgcgacgatctctactcgccggctctagtcgtcgtggccttgaccttcaaccacaccaacttcggcccggacgagcagacgaacatcaggcttgaaggcgacgcggccttcagcgccgacgtctccttcagcggcgacggtggcgggtgggttgacatcagcgccaacaggctcgacggcaacatcgaccacagccgtggcagggtgtcgtacgcccttccggtacctctctgggacgccgccaccggcgaggttgccagcttcaccaccggcttctccttcgtcatcaacccgccaaaagaggacggcggcatcaacaacaagggcgccggcatggccttcttcctcgccggcttcccgtcgaggctcccgtccgccggctcctacgcctacaacctcggcctcaccaaccagactgccgactaggtggccgccggcgacgaccggttcgtcgccatggagttcgacaccttcaacgacaccatcgtgcacgaccccgacgccacctacgaccacctcggcgtcgacgtcaactccgtcgtgtccaagaggatcttgaccttgccaagcttcaccctcgtcgggaacatgaccgccgtcgtcgagtacgacaacgtctccagcatcctggccatgaggctgcacctcggctatgggcttagtggcccccgtcaccggccggattacaaccttagctacaaggttgacctcaagagcgtgttgccggagcaggtcgccgtcggcttctccgccgcgacgtccacatccgtcgagctgcatcagctacgttcatggtacttcagctcgtcgctggaacccaaggccacaccgccaccagtggcgccgccgtcaccgtcaccaccgcctacctccggttcaggaagtggcggggttgtagcgggagccatcgtcggcgcagcactgttcgtcgtgctcctctttgccatggtagcagtcgtcgtactcgtacgacgacgacatcagaggaagaagatgagggaggcggaggaggcgaacgacgacgacgatgacacggaaggcgatcccatcatggagatcgagaacgggatggggccgaggcggttcgcgtaccatgtgctcgtcaacgcaaccaagagcttcgcggcggaggagaagcttggccagggcggattcggcgcagtgtaccggggctatctaagagagcagggcctcgccgtcgccattaagaggttcatcaaagattcctccaaccaagggaggagggagtacaagtcagagatcaaggtcataagccggctgcgccaccgcaatctggttcagctcatcggctggttccatggccgcaacgagctcctcctcgtctacgagctcgtccccaaccgcagccttgacgtccatctctacggcaatggtaccttcctcacatggccaatgaggtaattgatttccctaattcattagaatttttgctaatgtgcaattgacaaatggccatgaactgatcagttattgggtttggatgttgcaggatcaacattgttattgggctcggatccgccctgctctacctccatgaggagtgggagcaatgtgttgtgcaccgtgacatcaagccaagcaatgtcatgctggatgaatccttcaatacgaagctaggtgacttcggcctcgcaaggctcattgaccatgctgatggggtacagacaatgacgcacccctctgggacgcccggctatattgaccccgaatgtgtgatcactggtaaagcaagtgccgaatctgatgtctacagttttggggttgttttattagaagtggtatgtgcaaggagaccaatgagtctactggatgatcaaaataatggtctcttccgactagtcgagtgggtctgggatctatacggccagggagccattcacaacgcagctgacaagcggctcaacaatgactatgatgtggttgagatggagcgtgtcattgctgtcgggctctggtgtgcgcatccagaccgatgccagcggccatcaatcagagctgctatgatggtcctccagtccagtggaccaatgccgatgctaccagccaagatgcccgtggcaacatatgcaccgccggtggcctcatcggaggggcagctctcgtcatcgacgggtatgtcatcatcaagtttgacacaaacagcaatcacacctcgttaggggcataagtttgcccacttgtggtacaaaaataatccatgccattagattataaatgcacttgccttctacttattctcatttcagattgataaactgtaaaccaaatgaattagcatgggtcagccggcggataccttgagcagggatccttttctcagggatgccgctctcggtgaaatctagctagagatttaaattgcaaacaatgtttgactggatttgaatcaatttgaacaaaattcaagaaggacatgctcattgttgatagatgtcatacgataatcggcaaaatggaggcggacaactgcatagaacattacctactaaacttaggttttatccaaatgcatccccatctctgactgacaccaaagtatgtaacctcgaacgatatagaacacatggaacatcatcacaaaaagcatatcagtaattttgtaccacaccactaaaattcagaacaagaggtcacaaaatatattttgatacatggttcgagttgctgctatcattgtcagcatttcgtcaagcaaatagatgaattggaacttccagtgctgtttccagtcttcgttaccatggaagagcgaagtctaatgtttgtttcaagacaaaaaaaaaaggtaaactcaatcagaaaaagaaaaggtagatgaaagagagtacttttatggtacattctactgctagtatatactaccagtatatgaagggtagttttggtattagggaaaaatctgaaaagggctttttggtcatttaaattagagaagtattttcaccgggattaattttccttcggttgtttggatatcatcatccgcgtgataccgcttcttctggatacatctcgcgtcgctgctccttctgcagctccgcctgcccatcgcctcactcaagaactagggttttgggtcgctggaaaagacatgagaggaaaggatgagggaaattgattcgattcccgatggcggcggcgcggcggcgctcgcaagaggaagacatcggcgacgcatgggcggccatggatcagatttgactagtgaggaaacgtgaaatcataaaattacccccacacaattagataaaaagacaaatatacccttttcaatttatactgcagaataattagaagggggatcggatgaattttcgaccgttagattaaatatactggtagtatatactagtagtagaatgtaccataaaaatcctcatgaaagaaggcacctctttcaagttgaaactcctgaaagctataaagagtaaacaagcaccaaaaatggttgctataataattggctgtaactcttttgagtaaaggccgggatgctattttattccattatctaaaaaaatatattttcacatgggaactgaaacacaacagataaatgcgcagctcaaagtcaaatgcaaacaatatgaaacaacaatggtggtgtaaacaacaggaacctcgatataataaaagtggagcatggccactgcctactgtaaacaggatagcctgcaacaatttactactacagagttattcaaatgcaattttctcaaattacggatatttatgttcgacactttggttttgacttcagaatcaaggtcatcgaaagcagaaaaaaaaaacattaacgcacaaaacattagagcacgatagtccacccaaattgtaagatttaagaaatagtcaatcattcagcaagcatgtcacccaggactgatagctctgccacttcacggagtgatcaaactaaatttggaaataaaagagttgattcttatagtgtcagcagtggttctgctgttgcaatttcctcaacaatttctgatcaaaagtgtgaaatcatagtcatgattaatatttgtaatgaataattggctttgcaaaatgatttattcgaagaattggtttgagagtatgtgtgaatgttggtgtgagtgcgtgtgactaatttgggtcaggttgtgatatctgtgcccagaaacggttgttttgtctgattgtgtgcaggtgacttgaggtcagccttggtcaatggtgaggaccgaaactatgctcagggtggagcagaggtctagtgcggtcatgataccatgtgagaaggtgactagagtcaggattcttggtgaacaacttcggtcaacggtggggatctgaaacgctccgcttttcgtgaggcgttaaaaactaactcggcaaaatcctaattgcgaaaattttcgttctctgtgtgagagtctaagttgtgccaaggatcccaatttaatcccgttgttccctctcatcgaaatcaaaaaaatcctccccctcatccaaattcctcttccgattcgagtctttgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcctttccatgacttctccttgagtttcccctgatacatccctaaaccctcgagtttgaatatcaaatttgaattcgaatccaaaccctaaatctctccaattctatccaaatcagttttctctgtaaaaatctactttacctccctatgtttttggatggaccgattctcctcccccggcccatctcccctcccagcccatcatctccccccctcgcacgtgcgttacacgcatgcgagccgagagagagccgtcgctcgctctctctgtttccctctctctctctctcgttcgatctccctctcctcggcgccgatttcccgccgtcgccgcccaaaacctccaccgccttcgcccattcccgcgcgcacctcgcgaggtggccgaccggcctgtcaccgccgacgccatgcgctgccgccttgccctcgctccatgccaaaccgaccgccgccgtcatcgtcgacgtcatccatgacccccccgccgctccacgccgcacccgtccaagagtgggagaagcagctgctctccctctcctcctcctcactctccctcccctcattatggcaagggaccaagcccctttttccccttctttttccctttcccgaccactgccggcgtcaccacctctgcgccgcttgaccgaccgcgccagcccgcgctccagcggttcgatttccgccgctcgatccaccgccttcgccactcaacgcatccacgccgtcgccgctttcgcaccgcccacgaaaccgccactaccgccagccgagcacttgaccgccaaggtcagttctcccctccccaaaccgacctcgtctccgctataaaaccaagccaccccaaaccccttcctctctcgttttcactcgcctcagtcctcacacccgccgcgccattgccgccgaaccaccgtcgccgccttgttgctgctcgtcccgctctcgccgttgccgtccgttgccgaagcaccggaggagccggtgcgtgggtgacgaggagctccgggcaccacctctccctcccttcttccccggccgcgccctctcggtgccgtgccgcctcggcgtcgcgaacacctcgccgcgacaccgaccgcgccgccaatgctgcctcctcttcgattggtgagctccccaccataatcctcctcctgccgcgcgatgcgccgcgcccgccgccgctcgccatagctcgccacgcgctcttgctctgtcccggaggccgcctctcgtcgccagccaatctcggtgccgctccgtccaatccgacgccggaaacggattccttgaaccccggagatgctcccacccctttgaatcgaaccctcgtcgtctcgtcgtgttttccccttttgatctccggtgattgccgccgccgcaatccaccgtcgtcggctcctctcgcgtcgattcctctcgccgccacgctcccggggatccccatgacctccccctggctgccccaaggccgtcggccttctcctttgtctccgcgccgtgtcgccgcttccgccgccgcctaacgccgccgtgcgtgcgccgccggtgaccatcgggtcccgcgtcaccgcgtgcgcgtcgcaacaccataccggttcggctaagcccgagcccgcgcacccttcgctcttctcgcgcgcggccacgtcggcgtgctggcgagcttggtcgccgccgccagccaccgtcatacctcccctctcaaatccgtgccgttaaacggattccccctgacctcctctagctgccggcggtggccgctcgctccggttcgccgtcgctcgccggaacgcctcgcgcgtcgtcggccgtccgatcccgggcacctcctcctcctcctccttccctttcgcccctgcccgcgtggccgaccacgtggcagccacctcagccccgggcccgcttgactgggtcaagtcgcgcccagtcagcctcctccctccgtcttccctcccatgcgcgcggtccacggcaagccgtgcggctgcacgtgggcccgccgccatccgtccacccggcgcgccgcgcccgaactgcgcgcatccgaaaccctagcgcccgcctccgcgtgcaccctccccaccgtgaacccaaccaccgccatctgggtcccgcgcggtggaccgcgcccaccccgacgggcctccctctctccccgcgcgccctcatgggccgcctcctcgcgcccgcgccggcccatttggtttggccgagccgcgttagcctttgggccgcaccaatgccaccgaaacaagtctaatatacatccctccttgatttcctttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccattccacttccaataattccgtaaattgagctctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccatttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagtttgatttgtgaacgcctaaaatggcctatgtttatgtgaggatttgatccttctatgtggcatgaggtaaccctgggtcggctcgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtttttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagctgattaatcaagtggaatggctctgggagccgagaagtaatgaactgacccgggaggtcggtacattaccaaatgagctgttgaaaaacatctcttaaagtcgaatcgagacgcaagtctcttttcgtcccaaacttagaaagaaataaatcacttagtgatttcaaaatgatttcaaacaaaagatttgcaaaacaaccttgcctctctgccaagcttgcattaaacacctaagttcccgtgacttgctgagtacgaaagtactcacccttgctctatataaatatatatatatagttcctccgccctgaagggaagataaagtgaagtgaagatttgggtttcgtcctggttcccagccgtcgcctgtggtgttgggtgttagaccgttggttccgctgctgctgctgctgttggtgttttcctcgtccgcgtcgtcggttgtattctcgggctgtctgagctgcaacctaagttaaggtaaataagtcctctatttattttaaggattgctatgattcatatttgtcaccatgggtaccagcactatgtcctgggactggtaccgagatcgcggtttcgtaggaagcggttcgcgccgttttccctacgacacgctcctgtcaggtgccgttgtacggcggtatcagattggggtgtgacaggatcgggactaaactcagggaggagttgaggtccagacagtcaaggataccgggtgacgaagttggatacgagatggcacacagtgaatggatatcgtgtgggagagatcttcgcaacgggcttcacgagatatgcgtgcaagtaccggtgttggcgaaggagattggagtgagaaattgaggaagagtatatggtgatatagtacacgtggtactgtagcatgcatatgtgtggtattgatcgatgcatgcaagtgtactgtagtggttggcagtacatggatgcatgtatgcatatacatgtgtgttggctcggtgagtccaaggcaggagcggcgctaaggcaggagaccgaggccgaccgggacttcgtatgagacggacatgtgtccatgtcgggtttgctatgacacggattgactgtagtcggttgtgaggctgcaggctttaggagactaatttggatagagtcatagtttgacgagtggtactcctatttcgagtaggagaattttcatgtataaatagagaggaagcgtgaggcttcccggtatcggttttaggaagctgagtttgagagattagatagggtttcgtgagaaacttttgaggggtgctgtggctgcaccttgtgaacaatatacttaagcaataaagatcatattcaatcatcaaggcattaacgatctattccggtttcgtaagttttacgtttatatttggttttggtattaacttgtgattgttcattttgctgcgattttgttcaagttaattcatccaaaacttttctaatacttcaaagatcagatctggaaagtttcgttgattggttctatttgatgatattttgtcacgtgcaaggaaaaattgcagtggccaaagcaagcaaataatgtgatccctatatgggatgttcagattgcatgcagagcagtacgagctgtgagcagcaaaccacaagagatcggccgggcagctggttgtatccatgcatgcaagcccgcacatacgcacgcatgggcttcaattacacctgcgtacactcgcatacgtgaccgtattttctagcaatacggccgcgtatatacatggaaaaacaaggagatgcgaagctacggtgtattttacgctatacggttaagttagctcatgcttgcccggatcaacaaattaaatttatgaagagataaaatttatctgaatgaattcaacacaatccttgcaagccacgcgcatacgaaagacggccttccgccggactctcaccggcccagcaacggaagagtggcaaggaatatcggaaaccgccatgacgcgctccggcggatgcgcacacgtacgagagttaaattctatcctgtaggcccatcagaaattaacagaaccaatatttgacgtcaggcggatcgaagagataagattaacaaaccgatcgattgatcaagtatatccgcacttctccaccgacctcaggcccctatataaggcgtcgacgtactctcggcagcctggaggccatggacgccgatcaatccataaacacccatcgacacacatgatcatccatctgtccatctcctcctggaagacaactatccaccggcgacctagctatccatcgaccggcaacgagcatcaagatgtgatctcggcggccggcgacctcgtccacagcacccctgtgtccggcaagaggcgcacatgaggaggaacaacgacatcttccttgggcagatcaaacgctgcaggagatcgtactcaaaccttcaggaggagagcaagtctctgtcgctttcttttctctcgtttcaggtgggagatgagcctgtacgcgacgccgccggggttatcgtggctgccatgactatttctgaaccatctccgctgccatcgagactcatccgcccgccgtcatccacattcatcaacatctccatctcatctcagatggactcatccattcatctacaaatcattcaagaagcgacaccaaagaaagtcttaatggccactacaggtaaagctaatttagattggttcctttcttttggttccagtgcctacgtgcatgcatggaggacggccgggtgtgctgccatcgccggagtcgtcgcgtagaccaatctgttgacgctgatcgcaagcctccgtcaagatcgatgccgctcgtcctcaagctctgatgttcgagctgccggtgacgatgaccctgctcattgctgcgatctcgcctagatgttggatgacgttgccttgccgaccgctgcctccactcggcgacgccgtggatgtctgctggccatcttcgacgatgctgccaccttcctcacactcatcgtcaaggcgctcgaggagaaggccggtcggagtgccgctacccggcactgcgacaccaccaacacccatctgccggagaagaccatcgtgatgccactccgcccgacgcgacgcgccggagatcgtcggagcagccgcggatgctgcctagtcacgctgatccagaagctcttgttgagaacaacacaacaacacggacgccgctgagctgcccgcgtccgtgaacaacatatcgtcatcacgccggtggccgcccacgccgtcctgatagagcagcgggaggccatctcgtccaccttattggcaacgcacagacgctcgccatccccgtcaagctgctggtgacactgtccgccgagtgccaccctgtcaaaggctgtcgttgtaccgacgccaagctctaaggacgccgccattgtgatctctactgtgtgaggacgtctcaccgagactcaggcgacgccttcacgctcgtcgcggtttcttcggtcaccatcaacgtctactcaatcatcttcgacggtgctaccaccttcctcacgctcatcatgaagccactcgaggagatcgccattcggagtgctgctgcccggtgcctgcacgccgtcttgccggagcgtaccacggatcgtcggagcacccgcggatcgacgttgccgagctgtcctgatccaggaggtctggacggagccgtcggggacgcccgccgagctgctcttgcacttaagctcgttacaattatcatgcaactgaggcactgccatgtagtgttcgttcttgccgatcaaacactgtcacactgcctgccggagcacgttggattacgccagagtgccattgctaggggcccgtacgccgtcatcaagactggccgtgattctttctcttcatcaagccgaggtcgttgtgccgtttgtccgcgacgctttcacttcatcatgctggagttgttcgtgatgtcacgtgaacatcacgtcggagcaccactgcttggtgcctataaaccatcgtcaagccggagtcgtcgtgccgtccgtccgtgacgtctccttctctctacaccgcatgatgagatgccatctgtctacgatgctttcacttcatcatgccaagatgagatattgtctgtccgtgatgctctccctcttcgtcgagatcaacgacgctgtattggagcgtcgctcgtccacatcaacataaagcaagaatggtgccgtttgtgatgtcagggaaccgttcatgccagatctacaccaataatttcctcgaccgttctgccgacaaggcatttacttctacaaaggtcgccgttgctaccggcaccctcatagagccccttttatgggctcgtcgtcatatcaactggatcaatagtagatccatcatccgaaggatgtgctatataagccacgttcgtccggctgctgtctgcactgacttcttcatcaacaccttcattacaaatccctgttgtataagggacatgacgggtcaggaggtgcccagccatgtttaatccggttgccgtctacacctactttcttcgtcaattcttcattactttgatcacatctagtcagaaggtgcccatccatgtttattcggctcttgtgtgcaccaactgacttcaccaactcatcttacctttaacaccattccgatgttgttgctatgacgtcgagccgtccaagctaggcgattccatgcgtgtcttcttcaaacaatctacaccgacacgtcgttcaagaccgacgaggctagacgacgagggtgcgcgaagccgacgctaaggctatgtcaccaacactggcgcacggaccgacgaggccgtggatgcgttgccggcgcccacatatatatcacacatcttcaccaacattcatcatccatggagaacgtgaagcaaagacgatgagacgaccacaagcagcttaatcgggggttctcctgcaggcctagacctgcggaggtaattaaccaggagcttctcgaggccctaggaaccagaagacaacatcgctgatgtcagatctgtccaacgacaggcaatggcacgtgtattttctattatacatggaaactgtatcttgataattcaattaataaagatcatgtgtttttgtgtctcttttatgtttattttacatttgtgtatttaggtacactggcacgtccgcacttattttctctctaaacatagagggacatattcgtatttttctaccctaaacaggttcttgttagatttgaatttgcttaagttttaggttttgttcagatttgctgaaattttgatagagctgattttcaagggtattttctcttaaaccgtttattagtttacaaatccctccggtggaattgttctttaggttgtttagtgtcaagtttgcaactcgatccaacggttggtttaagagaaatcgtgtttttaccgaagcgctgtcgtgttgttttcaggctgacggttagaccgcgagaggaccagcggtcagaccggtcaagcttcggtcagaccgaccctagtaggtcggatagaccgccaaacgtgtgttccattggcttttgtgggatgtgttttgatctattaagattcgattatttgacttccgttgacgtaatctaacattcacccctctctggtaggcttggttacttatgtttgattctaaaaaagcaatccgttggaccctatccttacaaaagaaagagcagatctggaaacataatatcacaacacagtagcgtgtaatccattctctttcacatttgtccttagccaggatcagatgcgcttttttaaacctatcaggaagatgattgcgaaaacagtgatgagaatgaattttgacagcaacagctccagttatttatacattccaaatctaaagttacaatagtttcagcaatttttcatccccaaaagtccctgcataaccaattctgaatgtccaagttagttattcaacactactgcagaagtgcagaattgagtcaccctaaagtgaggttgaagcccttaaattcctttattgaaaggggaataaaaaacacgccaaggcaataaatatgaagtaattctcacatagacgtcacaacaatccccatccagccatccttgaattctccatttgcagatagactagaacagctagcgcatgagagtatgtgttcaatggttatggttttgtgggtaaatacaaacatataggcaaagggataaatatgctgttctaaatttgtaaattagagtatcatcaacaaaaaaagcaatgcaatgatctccagggctaacaaacttcatcagacagaggacaaagaaggaaatttaacacaaatcaattatctcaggtcaaagaaggcgatttcaacattagacaagacaaaaggaaagcaatactactgtaaccaacaaccactaaggctatgtacatcctttgggtgcagagtaaggctgggaacatgatcctctgacgtagagcaatctaatctacgtcagaggaacctattacgccaggatatttacatactttaagtgcacaggccggaacaatcctttatttatgaaaaaccagacaaccactaccagctttaacattgattaccgacgtaaaggaatgcaaagacctgaccttaggacaggccgctcccgtaggacgaatcggcggcgattcaccaccagtgcccttgccgacggcaccgcgctgtgcaggggaatcaaagaatgcacgctcgccagcgccgctgccaccgccacgaacgacctgaaacagtcaggatctaggtactttgggcgtgacctgcggaggcggagaggagagaccggatgcttcgccgcctggaacgagctcgtaaccggatatctcgactggcgcgcgtgggcgcggtagaaagacgccatcttgtttcgtggtttgctgcggccttcggttgaggaagggaagaacaaaagctcaaaactgggcctgcgtttattgggccataaagggatcgcggtggcgtacatg

SEQ ID NO: 46650 - DNA, 6582 bp, Oryza sativa
cggcagccgcacccgagcagcaccaccattgcgcgcttgcgcccacgccaaggatgccacactcgtgccgcctccacacggcctcaccccgggcgccccatgcgccccatgcgcccccgcacggctgtcgccccgtacggcgatgtgccgtgtgtcgccgcacaatagccgtcagccgcgtcccgcacggcgctgcacggccgtagggccgcaccgcccgaacagccgccgcatcggccacccacgtcgtcgcgctcacgccgcaccgcctgcttcgacccgaccgctgccacgccgcgccgccctggccgcgcgccgccatggccgcgcgccgccatggccgcctccgcgccctgaccgtcctggccacagcagagaagagtgagattcagcagtgctccatctgagcgtgagctcaaggaggcagctaggctgccatggcccatggctccgccagaagcgctggccccaacgacaggaggtcggtgcaggcgaaccacacactcaatgcggacggcaccgccgcaggatgctgcgctgcgggcctgcgacaccgttggtgaagaactcggcggcatatgacgagagaagcggccggccgggagcgagccttccattttcgtgggttgattttggtcggcgtgggctgaaaagaagccagtaggtccgctgtgcttgtttacctccgttggatggcgatcgagcggcatagtggcatcggacgtccctctgacgtagattgctctacgtcagaggatcctattccgtaaggctatgtacatcctttaggtgcagaggccggtttaatccattatctaaaaaaaaccaaacaaccactagcagttttcacattgagtacagaggtaaaggaatgcagagccctgaccttaggagaggccgctccggtaggacgaatcggcggcgatgcacgaccgcagccttgccgccgccaccgcgctgtgcagcggcatcaaagaatccacgctcgccagcgccgctgccaccgccacgaaggacctgaaacagtcaggatctaggtactttgggcgtgacctgcggaggcggggaggagagaccggatgcttcgccgcctggaacgagctcgtaaccggagatctcgactggcgcgcggcggcgcggtagaaagacgccatcttgtttcgtcgtttgctgcggccttcggttgaggaagggaagaacaaaagctcaaaactgggcctgcgtttattgggccataaagggatcgcggtggcgtacatgagacccatttaagttggcccttcttgtggcccatatatacaatgggccagagatacctcgccgccacgggtaaccggaactaactgcggcggcggccgcgggggagcagcagaaactctgaaccagcagcaagctagcttcatgcttcaggcttcaagctttagttgctagcctgctacattgctcctcgttgcaaattgcaaacaggcgatggctgatctgatgcatctgatggcaacgggattagatcactgtagatgatccaaaaaccaatcgtttctctttgtggatttcagattcactagcatcaacttttgccctaatttcctccctccttttgacttgaactgtctccttaatttatcggagacgtttggttctcagctggatgagagtgaaactgatgaaatcatataaaacctattgcttttgcctacaacttttgcccccaggtactgtattactgttctactgttctctcaacagttgatcgatgccatctgcaccgtccaatctagcgtgtgtcaaggatccaaatatccaatatctcttccgcttctaccctcccgtgaccgtgagcagctcgagattagtttcttctcgaccatcgaaccctttcccgctgcttctgttcgccgccgccgtgctccagcgcctagggttttcttcgccgccggcgagtgctccagctcctagggtttcttcaccgccggcgagtgctccagctcccagccctgcgcgtcctcctcgccggacgctgccggtgacgtctgggccaagctaggtgcggccaccctcctcctccccccttcctttttcttgggtttcttccgcctcacgggttcttgattcttgaccttttcgttggtcttgggcccttggccattgcttgcacagcaggtctgtagtgccctccgattccgtgttcccggaggtggagctggccgaggacgacgccgtggtgtgctcccgggtcaccccggatggcggcggggaggtggtcgcgtggtgcaagattaggcgcggcggcgacgtgtcggcggcgacgatttggaatctgaggtatctgttgtgattggtggttggtttatccccttttcgctgctttgctcttctggactgtacatcgtaggcaagatgcgctttttttttttttgcaatcctgttttattggattgggggtacaaatgccattcattgatgatgcatgtttgggcgaaggctataaaatgcagaaaagttcttactgattgcgatggaatgcgagttgttgtcgtttggattatgtgaattgttgcggtgtcgcactatccaaaattaaagaaaggtttcctgtggataaaaaagattcaaatttcctaatgattccaaagtgcctcattttcttatccataagaccataataactcagtttccaaacttttgaacctgattgattttgagtcgtgctgatctgaaatcgatagatgtgagcccctgaagacagggaataggcagagtggccatgggtgagttttttcttttttagggggtggagggaactgtgttgcaaccttccgttaatccttttatcaaattctcgctgatgttagatgcctgtcttgtcatccttgtaatgtatgtttcattcgaccgctatcttacgttaacattatccatgtgccattgagaaagcttggatgcaattattgtcgatggaagagttatccagcaagaagcagttgacatcaaaccggggagtgaaattgttccagggccccagaaagatggtgagacaattatgtattttgagtttggcattttgtgcatagattggttgttatgtttatttagtggtcttgtattttttttaaatagactattttattcctttatgaagccaaatgagtgtttacacatgactctgaatatatgtactcattgagtcatttggaatgtttattgtttcctagacctttctgtttagaaagtgaaacttctatggttgcatgtttgtaattgtgcttctgaaaaatttaccaaattacaaatggttttccttttgtgatttcgttatgttggacaggtgaactgtaccactatgtaatgcatttatgctatccattttcttgcagggtatctgttgtacacctttgatataactggcctgaatgactaggacaaaaataatatcaaggtattttgttgaaatgaatgttgatcaacagcaataacctgggtgcataaaagtcactaacttctatttaaatgacgatgtcagattgtgctaggtattgagaatgcaaagtgcagcatatgcttaaatttgtgggatgatgttgttactgttgcttcatgcctccacaacttctggtacttttgccaattttcctagctacttttgatttatctcaaaattctgattggtgcttattcctgtattccttttaagcaatggctgcttctttgagtggttaagaaggtcttcagctaattcgcgtgataaaagttagagtgctgcctgtccacaatgtaggacgacagtgcaattagttggtgggaatcacttcctacataatattgaagaggtgtgatagttgggtgtgatgacttaactcctcaatactgtttaagtgctacatattgtacagctgagatgtttatttatagttctgcttttgtaggctatactgtaagttttttcatcgctacagcggtctgatgaggagattgcattgttggagtcatatgccccggtcaagacaaatattgtgagttcaaaatcttactaagaaattgttgattcccaccattttctcaatggattgtatcaagtgttgtgccagtctcatatttgccagcactgatatttgtccctgttatctgccataaaatcgaatattgttttaaaatcatcatctttttttcaacttgtaaaccttattttttttcctacaaactttgcccatgttactgtattactgtttaatcaacagctaatcaaggccatctacaccatccgatgtaccacgcggcaacgatccgtcccctcttctgcttctaccctcccgtgagctcgtggttgaaagttacatttgtcatgaatttggattatcattctattttgaagatatccttgattgataaatgcactgccatgtttcagataacattttattctcttatttcccccaattttccttccatttggcaattctcgtggtgttggtttgtctgtactgcactttgacacattatatttaatttacaagacttgccaggtgcctaggattgtctttagtattcaacttttgacaagataatagtggatgaaatgaaaatctgtttacaattagtactggcctcttaataaactaattagtaaaacaaaattccccaaatggtgggctcattccgttagtcgggtacttataattgtagaatttcctttcagtgcaggttgatctagaatcatggttctctctctaagtcctattttgcttatcgaatacttgcctcttaataaactaattagtaaaagaaaattccccaaatggtgggctgattccgttagtcgggtacttataatggcagaatttcctttcagtgcagtttgatctagaatcatggttctctctataggtcctattttgcttgtcgatgatattgttaaatgttgccatggaatgttagcatctgatacatgggcttctcatctatagacatgttgtgcttgtcattacctctaaccatatcatgttatttaatttatatcacatgattgaaaatgcattttagcatgaatgactcataacgatttagaattttctaacttacaattagcaaaccatggcagcacaatatggtatttcaaattttcatttagttgcactacttgagaatgagtttagtggtttggttggattgtctaagtgcaaatgttgctgtcatttgtgggaatcaggaaaatataaaatgccatatataatatcctctatattttagttcatagagagtatagtttccattcactcccaaagaaaatatgggtataatccggagcaaataatctggaagcagatatgaatatggatattttttgctggatatgaatacaaatactatgacgttggcgaaagggcttgtagcctagtggttacaagagcatcagtagcatctgaggtcctgggttcgactccccatgggagcgaattttccagaatttaacggcgttgtgctttcagtagtaggcgacgtacccgtcgacagcgaggctcctgtgtagtcttcgaagatgctcacaggggtagggtttgcgtgcgtgtgtttataggggtaattctaaaaaaaaaagaaaagaaaatactatgacgttgtttccagtggatggggatacaaataaagatgcatgcttattgtttttcaaccacatttgcttaagcaatgattggtctattccagtattactattgttggcccctttggaacatataattgatatgccttttgcatgactcttctcaactaaaatgcattagattgcatcatgtctgtggttcacaatatgttacatatgttatctggaaagaatataattaaatttgctacagttctgtgctattgttatgttatttttgcattgttgcatgtggtgtttgggatccaactaaaactaagttggttattttattatgtaatctcaaccgatatacggaatttatatgttgtgtatattcatggttgttaaattgctacattatgttcagtatatatacagttttttttggcttcaattttatgccgtcctttccagctttcccgccgcaccgcgcggggcaccctctagttatatttgttctctgcacttctgctaggctgcttagctaccactagccttttactacccagctgcagataaactaaaacatgtatatatgaacatgaattccctaaccatataaactaaaacgcctccgatgatcgaaccatatcttggtccatcgatttaagtggaaaccaatgatcagttgttttattttatttattatatttatagaacaattactccctcggttctataatataatgtacaaccactttctttatatgttccataatataaggcatgcattcaattaattatgacatcttcttcattaaattattaattttttaaacaattcactctcacattctctaattctattggatgcatgcattatatttattaggatgatccaaactacaagatgataataactatttctttatctttgggttaatgttggttgtgccttatattttggaacggagggagtaatttattagagtcacgtgacaact

SEQ ID NO: 46651 - DNA, 5052 bp, Oryza sativa
ttccgctaccgaaacccggggaggtaaatccatccatccatctcatgttttctcacaatctagctgagcttgattctctcttcctaattagtagtaattacttgtgcatgtttgtattgtgttagcgcttctattcctaattaattacttgtgcatgcatgcgctaattaattctgtttgtattgtgttaacaggccgggatgacgaccttagtgacgacaaaatctggacatctctgattgcattccactatcctggattggtggttccgccaatctgcatcgaggacattgcaaagaaatgcgggtggaataatctgacccctgcatgcgtgatggaagagatggacagctgccactaaggcgaccaccggccactctccatcagtctcaggctgacaggctctcagccataataattaataagctgtaataaggggcctaattaatatgtactacttcatgcctctgattttgattgcaagcaccactagccatgcatgcatgtcgtatattctaatagaattaattaatggtaataatataaagctagctagatgtgcctgtgggtttgatttttaatcactaggagtaatagagtagtactcctctatcagaatgtcagggtgcagtcagaaccccttgaatttggacgctacaactagctactacttaattaccgatcgatttggggcaaaaacaactactgtttgccagatcagagagatggtcatccaccatggtgaagaactagcttaacagcggcacaagcacgacctcgtccaagaacccgtgtctagctcgtgtggccggccagccggtcaccatggccgtgcaaatcatatatacaagtcatcgcttgtacaaagttttcattgtttgattaaacaaatctgtacaggacatggtgatacagctggattactcatgatgtacttaaaaaccaacttgcttcaagattgcccatggaacataacatcaaatcacatgccttactttacatttattacctatgaaagtaccttcttgcaatgtttatcagagcataagcccatgttcacatttttacctttgaagtacctccttgtaatgtttatggtagagaaagatccatactatcaaagataagacatatatttttacgtagaaacaatataaatacataattataagtgattgaatttaacatcacatatgctttaaatttctaattaccaggctaattttgcacactccaacatgtccatacatttttcttccaaaacaacttcatgcaggtagcaccctgaactacttctattctcaccctgatcagcactgagatggcctcaggaagtcaggaagcagtgccggcagtagatagggaagccaaacctgccatttgaaattccctggaacttaaggagacagctagtgcacatgaattgcatccaataattaatcagctactacaaaacaatgtgagaattgaagtagaagtacgagaaatataagttaatgaaaggaaactaagtactgtctcacgacatgattcaagataaataagggggataagaaaatcgcaaagaaaaatcggtttggaataaaagattgatttagtagtagcattttgtcaaaacatctttgggcaataggagcatcaccgatttgttatctttctcttttctactgttgcaaatccaacaaagaattgtgaaagcaattataattattttttttttaaaaaaaagatggcgtagagttttctcaaatttttacaagctttacttcacaaagcacatgacttatcagctatagccagaagatcgcatgattgaaactgatttattctagagagtaataggcaatcatagaaccatccatgacatgcaatcggcaaccaacagatgatggtctatcactcctccatatgttcatctccagcatattcgtgtacagcttgtaatgtacagtcaatagtggcaccttttatagcatgtgtacatgccaacctacaaacagaaagatgaaaaggaacattcagcaacgcgcaaaaaaagatccattttttattcatacagtttgaaaacttttgaatttttacctagcataagaatctttttatatgggtcaagctttaaaccaccagtgttatagtactacctatagctaagatataggtatacttcaatagtcctaattaaacttaattcggtaaaaatctacatagaaaaggttgtgtgctaccatctacggaatgtggaaaatcatttagatttcgatacaatggagttctcaagctgctaaataaatgaataaatttgttcaacatatttttcctaaaaaaatgatgcatagagatgaagtgctgattaaattaccaaaaagttggattgtggtcatcactttaaatccaaaattcataatgacttgcttaaatatagttaaaaatcgaatgtcagtatataattaattgattttgttggaagcctttcatgttcctaggaataacgttaaacattatttagtagagtgtgaaaatcatcatttcagctctaatctgattcttgggagtagcatgtgcgtgagtccaaatttcttagtggcaagcacatggcatgttcatttgtatacatatccgcaccagaaaatacatataattgcccacaaattcaaactgtatgtaccatcgctagctgatgagctcacctcgttaacatgtcaatctgcatatcaggcaaataatctacgtcgttataagaaacaagaataaatttatattataagtgacagtaatgagtgcagcttggaaggaggacaggcaggccatagagctggacgcatacttcatcaaacatgtattaattgggcgtttagattttgtttaaagtccaaagctgaattcaccacgcacagcaaaatataaagatcccaaatgttagttctgttgagggtgttcaattcttcggttccacattgcagaagcttagagataataaaagtgaagattcaatcttagacatgatcaaccaaggataacacaatgaatatcaataaaaaatgtattattgtacaaatatgcatgtacaggctccggcctagagatgacaaccagggtttcatttaccgccggggccgcggttatcgcgccccggcggtaagcacggttaccgcacggtaaccgcggtaaccgtgacaaaccgcgacaaaccgtacaaaatttatcaaaaattcaaattatttttcaaatttatttgaatttgacgcggttaccgcggtttaccccttaccgtacccccgcggtaagcgcggtaaccgcggtaaccgcgcggtttaccgcggtaaatgcaaccctgatgacaacacacctgcttatgatccattcatgcagcaatatgcagtgatagaaaaatgtaattttcgaccatgaacatatatatttattactaaataactcttctctctgctacatgatgcctcatactgagcctagtgttggaatgtgcacacatatgggcattacttcgaacaagaggaggacatacggagaggcgagattgaattctcattcagtctgctccacctacttgcagttcctcttaattgtttgtggttctaggaaaattagggaaaagggggcaagaagaacatgagacacatggacaaaatataaatcaagcagcattttcttttttttttaaaaaaaagaaaagagagaagaaaagggagaaccttttacagggacaagagcaagaagccgacgtttgaggcaatggatggggtcaatctgttggcaccggattagtgagttgcatactcgcattaacgttcaaccgtagttgttgtacgatacgatgggccttcatccctgcagttgacacccttgtctctgactgccggcgccggcacgacgtacggcatgaatggtccatctggcttatgcttacctttccaaaagagaaaaaaaaaacaaaagagttgagtttattttatgtatcgtcccacgcagaacaaacttattcacaacggggtttcatcaagcaccttgaccttgtacaggaataaataaatgacgaatgaatacaaatgaagttgtcggctgaggaataaagctgcagagttagaccctagaagcttcaatctcctaagatggagaggaggcaaagccatgataaaggaagatgaaaatcatctggctggaggagcagatgttgagacttgaggccaaggtcagaaatctcggcgaatggtggaggccgtggcaacgtgaaacactgtggacaaccacgccaaatctagagatggaagtaacaaatactctctccgtccctaaatatttgacaccgttgatttttttagcacatgtttgaccgttcgtcttattcaataacttttgtgaaatatgtaaaactatatgtatacataaaagtatatttaacaatgaatcaaatgatagaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtaaaattagggattagagattagatctgttcccttttgtgattaggaatttagattgtttatttacttttctagaaataaaaagaaaaaaaagagatcgggagatggggaggagatttttttccacctccgattcgcttttgtttttctgttgccgcgtttttcttttcaggatcgctcttttttttaagttagacggacgacaaaaacatcataaattttttaagtagtaacagaaacgaacggtcaaatatattttaataaatcaacggcgtcaaatatttacctcgccaactgccccgaggcttcctccattgtcacggttcaaatcaatagcagccacaaccttccaatttagcgaatgacgagtgaaacgacggcc

SEQ ID NO: 46652 - DNA, 33894 bp, Oryza sativa
atcccagcgacgactgtccgcgcgcctaggtcgtcatcaccgcgacggcgagtgcccccgcctaccccttgtgccaccaccaccccgctcttgccgccgccgttgcagcctcccccctcgtgccaccgtcaccgccttcccccttgtggtgccgccgccgcctccccctccgccggatccagtggaggggagggctctgccaacgcctatcggtcccggctacgatcggagaggaggtgtaggagatcggagagaggaggaaaaggagagatagaaagagagaaagagaaagggttagtggatgagggggagaaagaaataaggacgacgacgcgcgctgctctccccccccccccccccatgtggctcgtctgtttttttaatttttcgttccggttggtttagacaaccgggactaaagatagtgggaggcctaacaatttttgaaccaggacataaaaaatgatctctagttctggttgatgttaccaactggaactaaagaatcaaaaaattctattggtcttttgaaccgggactaaacacattcttatgtctctgttcctattcgaatcgagactaatgcgatttttatcatccggacaaatatcaattctccggtagtgtatattgatgtattaaaatggaaggggttggatattggctaccagaaattatttttctagcaaggagaaaaagagctgcgatatctaatccattttttcgaccagtaaagcatctagaaaccctgcttcactataccgaacaattcttatcaatgggaaagtctgtaatagttatccaagagttctgtgtagaagggctatcatgcaacggatcaaacgtgtggatagcacaccatggcaccacggagatcgatatccacttctgtcattccatgtaaacgacagctccttctcccctttctagagttggttcgatttggagaaggggattgaaaaaaaaaagagtaaattgcatcgccgtacatgaacttgttaggtggtagcaatctagtgtacgaacttataaaacgcttgttctagtgcatgaacttgtcaggtgcgtgcggaggaaggcgaaaagaacactacatggataatcttattgtttttgtgattgtagaaaaagattaaaaaaagagcaatgatataagctagggtgggaaagatatgaaatatcatcacttccttgatgaaggataaagtagagatcaaatttataaataattgcagtcttatgcaaacgcactatacatatgcatgtcacaccctaatcaatatcaacttcgtaagattaatattgccaagctattttggccctcgtttgcacaaaactagacaagttcgtgtaccgaaacgagcattttacaagattatgtactaaattgtacccatctaacaagtttatgcactaccaatgcatgtgcaaatataagaagggtatttgataattgtcaaaccaaatagtggtaaatagttaaatgtcccgttggcacaagaagtgctagctttagattagtagatactagaagatctgcacgccctgttgacgtgccgcctaatttagcctgtaatatggctcatctgcaaaatatatattaaatttgcatatatctcattttatattatttgtcattctagcaaaatttcacatcaaactaggagatgtgcaaattacactgctatgcttattaactacattataatcgttctcaaaagcaatattaactttgattaacagttgtacatggcattgataaaatgtgaagatagaagaccacgatctaaattaataattttaaatgtgagaatgaccagtaatattttgaaacatacagagtaatatattaatggaatttaattttctgtttccaaagaattatgagaacaaccaaattaagattgtaattaatgatgaccaatagtttggcaaatagttagatatttccatattggaaagtacgaattacccctcgaactattgcggtagtacgatttaccccctaaaccataatactagacatttaacatcccaaactctcaaaaccggataaattacaaccctaaatcgattcgaaccggttttcagcctacatggcacactcatgacaatacagtcagcaaaagcaatggtggggcccacctttcagcgcttgttgtttctctccttctctgcccctctctctcctcctcctttgcccctctctctctcagtgaacagaaggcggctgcgagcggcgggcaaggagccgaggccggcggtgggcgggggcggaggcggctgtgggcggcgggcgaggagccgaggacgcggcgtactagacgtcggggtagcgctcggtcggctccgatggcagcggcggcagagagggcgagggcggcgggacgtggagcgagatggcggcaggatcctccttcccaccgtccaggcgctcatgatgagctcgtgcggcccggcgacaccgggggcgtacacggcgtcgcggaagcccgacttccgccttctcatcggcgtgctcacccgcgccgacaactacgagcttcggcacctcctccgtatggtgtacgacctctagctcgccgccggcgacctgagcgcacacgtcgacgtccacggggatgccacggccggcatccaaggtctcgttgtagtacacgagcatgccgatggcttagaagcacgggttgacactacgccggaccaggtcatctctgacgggcccaaaccctcacctttgacgggtttggtcttggtcagtgattagtggtcactgatgacaaaatcacctgtgacggatgaaacacccgtcacagataacccatctctgaccggtatataagtcatctctgacgggttaaaacttgtcacccgtcacagatgagtcatcagtgacgtgtcgtaactacctgaccgtcactgatgactcatctctgacgggttgtaacttacgacccgtcactgatgacaaagcaagaaatacaatttttgaattttaaacgcaacaaaaaacctcaaaaaaatattttgaattttactagccatcctatacatggttacacatcactacctacaaattcacaatttttcacgcaatataacttggatgctacaagtgagattcgaactcaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaatgatctctaatagaaatgttgttagttataaagttgtggatatcattaagagctacaacttttatataggacatgtttcaatccgaggtttttttgcaaaatttaaaaatttgaattttcactcatcactgacgggtcataactaccacccgtcagagataacgttatctgtgacgtgtgttagttaaaagacccgtcagagatgagtggtctcttttgtgatggttcataatactacacccgtcacagatgacatgtcatgtgtgacgagccatggttgtgacccgtcacagacgatctgtgacgggttacaagtgcaagccgtcacagatgacttcacatctgtgacgggtcctccctggtagccatatattgaagaggatattttttcggcccgtcagagatgactcatctttgacgagttgcgttggcccgtcacagatgacccgtcactgaagcccggatctgtagtagtgtgaaccgcccgcggtgttcgtccagttgccggtgtggaacaccgcgccgaggtaggggatgtccggcgagatggggacctggcaacaacccgtcccggtgcacggcgcgccgtcggcgtgagctcggcgcagtaggtgaagcagcccgtggcgtacaggtcgtcggcggcggcgccgcgcgggagaagacgaacgtggccgttggtggacggggaggtggccgatgacgcgtagcaggcgtagctgaggccggcgtagagccgcgagctgccgtgctcgccgagagaaggggggagagagagagagagagaggggaagaggagaaggaggaggtgagatgacaggtgggccccaccatttttttaaaaaaaaaggaaatgctgactggattgccacgtgtacgtcacgtaggataaaaccgctttggattgtgccagtgggggtaattcgtccggtattgaaagttcgaggtgagtgatgtctggttttcagatttagggggtaattcggtcgaccgcgatagtttaggggggtaattcatactttttccttagatattctattataaaatttaaagttatgtttcctcaaaattgttgcgatttcattaaccaaaaagttatagactaaagtgcatatttgaaaaaacggttcttagtattacaaattctcatcgaatctttcacttcatatttgttatttagtttttcccgattattatttattttacagaaatacaggatatcaatatggttttcaccataagatatcgtacttatccagatttaccttcatttttcctatttctgcttggtcctatttgtgttattactaatttagtatgagaaagcaaagtgcaacgtgcaaatgctatagcagcaaccaatgttttaaattggctgagacactatgcgggctaaatgaaattataacggttaaattatacattaaaaacaaatagctaggaatatatatatgtatatatgtatgtggactatgcggatgccgctgagcaggtttctattgtagcacatcacaggcagatggtgcagaatggagagcagcactaatagcgtgcacatgatttggaattttggatgaagcaacagggatgatcagatggaatcatggaacggtacgagattatagaggattatcaacctgattgattgcatgcggtataccagtccggataggaaggaaggatgggcccacggagcagaaaaaaggagatcgttgatgcggcctgcggcgctttaaagttagtcaaggcgtcggcagaaaggaccccgccgaacaatattatcaatctactattttcctctttttatttttactagcaaaaatgcccgtgcgttgcaacgggtgaaaaaattctaatgataatatacgtttttcataaataatcatgtcaatggcaatgtttgtattttaatgagcggcttgttttttacgaacggtgtttttttcttgcgcgattttctcaaaccattcagaaatgacgcatttctttctaaaagatttttctaacatgatctttttgcttttttatttacaatgaaaaccatatttttctctattttttgcttttcttttctcgtgtgttttttgcctttttttgccaattattttctcgcgtgtttttttgcttgttttttttcaaatgttatttttgttgctttttttaaaaacaagagaatatagacgaaataaaagccgtgtagtaggtggcaaaaaatcgatggatcctatccgactcagagcgatttttttaatagacggtgtttttttcttgcgcggttttttaaaaccatttgttaaaatggcgcgttttttctgacagttttttccttgcatgttttattttttaaaaaagttaccgatgatggaaataattttcctcgcgcgtttttttatttatttatggaagatggaaaacctttttagcgtgtttttttgcgctttttctgacttttttctcacgcgtttgtttgaaccgtttctattctctcgtgcatttttttttaaaaaatagttagattatattagagatagagaagagatatatattgattagaaatttcgccctttccatttttttcctgtgtgcattttttattttatacgaacaagcgttttattttttacgaaccatttttttcgccactttcttatggaatcggacaaacttttttagattttttttctgttttttttcacctttataggaatccgactttttttcctgtttttaacggaatcgaatctagtattttttttcacttttttttgccttttataggaatcagattttttttcgttcggatctacggtttttttttgccacataggggaaacagaacttttgttgttgttgtttttcttttttttttgcagctttcctttttctttttatgcacctttctgcttttgttctctcttttattattatttttaacaaaaacggccccaagtaccttattgcaagattataggaactcaaatataaatataaaaattatagggactcaaaagcaaaagtacaaacccaaaaattaaaatcatataaaaatggaatgctctcgacctgtaggttctgttttattaaacagatctctaatccggcacatcattttgtttcaccaagatatgtgagatatcacggtatagattaagaatcggatctatagtcggactttttttttgtttctgagagggaatcggataggagtcggacctttttttttagcttttttttttacagacgaaggaaacatcttttattattttttaagtagtagagacagagatagagatagagattttttttcgcttttttaacatggaatcggattattttttcgccctttttttgggatcggacatttacggttttttttctcgctcgtccgtttttttggggcggtttttttgtcgccctttttcacagaatcggacttttttttgcccttttttattggacagttacggtttttttcatttggtttttttcgccggttttttgtcgccctttttttcacggaatcgaattatttttttcgccagacagttacggtttttttttgcccggtttttttcctcgctcgcccggtttttttgacggacgatggaagcatatctttttaagtagtagagaagagatagagatatatggttttgatctcctgatgtgtgctgaataggacttggtacgatttaaaccaactcctgttcggttgatttacagccaatttggagtgttgatttttttttctatagtcagattttttttatgttatgctgaaccttttttagatggaaacttgttttttttgtcatggtggggtatcgaatcggttttcaaaggcggttaatttttttccgtgttgaatagaaataggacttctttttttttttgctgcgcctctttttttttttgcatttttctgccctttttttaaattttatggtacgataggaataggaatcagatgattttttggggcgcttcttttttttttttgccttttttacgtttttttttgccgcgtcggaatcggtctttttttgccgcttttttttttctcgccgccctttttttcacccttcctattttttttcgcgctggcctttttttttttaccttttttacgttttttttgccgcgtcggaatcggtctttttttgccgctttttttttctcgccgccctttttttcacccttcctattttttttcgcgctggccttttttttttttacagtcggactttttttacacggacgaaggaaacactttgtatttttttcacagaatcgaattatttttttcgccggacagttacggtttttttggcccggtttttttcctcgctcgccctgttttggtttttttcctcgctcgcccggtttttttttcgccagtttttttgacggacgatggaagcatctcttattttttaagtagtagagatatgatattttctattttgtttttatggctaagaggatttggttaatctttgttgttttgcactgaaaaatggttgtgtttctccacgaaagcgaggaggttatcctttgctagtttgctcggaaactactcgtttgtcgtaacgtaattccgatatttctcgtcatgtaagtacgatatttctcttatttgctaatttgctcataaattagtcgtttgattccacgaaagtgaattaatcttgaaattttgatctatcgatattgacaacaccgtcgattacaccgcaaatcgttaggtgatttttgttggccaagagaaaaagcatcaacaaacagcgagtgaatgaaccaatggcttttcttttcttttttcatggtgcattgtccgagaaaattgacatttagccacatgtaaggatgggtttcgctgtaatgccattccgccaagttgtttcgctaaaatgctatcgccacgctcgcacaacacgctgcttcgccgtttttccaatttcaccggattaacacaccgaatcgcgagtgttgtgaccaatgtgcccctgggtcattctttagatcagtgagacaaaggggatcgagatgcgccggctcttgctcacggcggtgccctagatcgatcttgtcagcatcgccattccacctgtcgcgatccccctctcgccctcacccagctatagctcacggcggtgctgccatcgccgttccaccccccgccgccgctgctgcagtccccttgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacagttggcgcgccaggtaggggctgcgtcgaattacccatcgaaaagtgtgatggaatcgactacagaagaaacggcgagattaatctcgatggctcaaatcttcagtcgggagcagcgccgacggatgcgttgcggccaccacgccaccacgggcacatgggagcagccgcctatagcttgctcggagaaatttcatgcatgcatgagttgattcagcagatcaacatacagctggcatatcaagccgccgttgttgggcgtctacgtcttcaccgaccggcttgcctccgccgccgccgactggtgtctctgcctacacggctggcctattatgccgccgctgttgggcgtctacgacttcaccgccggcctgcctccgtcgccgccgagtggtgcctccgcctacacggctggcctattatgccgccgctgttaggcgtctacgacttcaccaccggcctgcctccgtcgccgccgagtggtgcctccgcctacacagctggcctattattatgccgccgctgttgggcgtctacgacttcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctatgacttcaccaccggcctgcctccgtcgccgccgattggtgcctccgcctacacggctggcctattatgccgccgctgttgggtgtctacgacttcaccgccggcctgcctccgttgccgccgagtggtgcctccgcctgcacggctggcctattatgccaccgttgttgggcgtctacatcttcaccgccggcctgcctccgtcgccgccgattggtgcctccgtctacacggctggcctattatgccgccgttgttgggcgtctacatcttcaccgccggcctgcctccgtcgccgccgactggtgtcttcgcctatatggttggttggtcacaccaccgttgttgggcgtctacatcttcaccgccggcctgcctccgtcgccgccgattggtgcctccgcctacacggctggcctattatgcctccgttgttgggcgtctacatcttcaccgccggcctgcctccgtcgccgccgattggtgcctccgtctacacggctggcctattatgccgccgttgttgggcgtctacatcttcaccgccggcctgcctccgtcgccgccgattggtgcctccgtctacacggctggcctattatgccgccgctgttgggcgtctacgacttcaccgccggcctgcctccgtcgccgccgagtggtgcctccgcctacacggctggcctattatgccgccgttgttggatgtctacatcctcaccgttggctcaccttcgttgccgtcgactggtgtttccgcttacacggctgacctatcatgccgccattagtgggcatcttcgctttcaccgtcgaccgccttcgtcgccgccaactggtgtcttcattgttattgatggacgactttgttcccacattggccacttctgccatcaccaaggggaatattacaaagctaagtcatcatttattttattctttatatgatattttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtactattcggaataaatcaaaagcatagagatgagataaatttattttctgctcttaataattgcaaaagtacccgagtagtaaactccgatccgtgaaactttgttccattaatgacgaactcatgacactcatatgcatgtttgggaagtgcttaggccgactcccagtgcttggtggctatgattagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggttttaagcttatctcttacgctccaggaatggatcagtcagaacatcaccaaccggccgcctcgtctgccgccgactggtgcttccgcctgcacggctgacttattatgccgccgttgttgggcgtctacgacttcaccgaccggcttgccttcgccgccgccgactggtgcttccgcctgcacggctgacttattatgccgccgttgttgggcgtctacgacttcaccgaccggcttgccttcgccgccgccgactggtgtttccgcctgcacggctggcctttaatgccgccgttgttgggcgtctacgtcttcaccgaccggcttgccttcgccgccgccgactggtgcttccgcctgcacggctggcctattatgccgccgttgttgggcgtctacgtcttcaccgaccggcttgccttcgccgccgccgactggtgtttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtcttcaccaaccggccgcctcgaccgccgccgactggtgtttccgcctgcacggctggcctattatgctgccgttgttaggcgtctacgtcttcaccgaccggccgccgcatccgccgctgactggtgtcaccgcttgcacggctggcctgttataacgccaactgatgctatcttcttcacggctggctacatcgctgtcactactaataggcatcagtatcttcaacacaagctgcctacatttgccatggctgccgactgttttcttcacttccatggctgcatgattctgccagtgttgattggccttaccatcttcatcgccggtcgtctcgtctgctgctgactagtgccctcgcttctacatctggtttatacaactatcactactgatgaacatcatcgtcttccgtcgccgactggttatgttgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgatgctacttcgcaagttttgctacttcaccaaccacgacgtctttgtgagcctcgacatctcggcatgcgatgccatgttattttactacaacaagaggctctccaatatttaggatttctacttgaacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgctgacttattatttcaccttcacggttgacctactatgcaaatgctgatgagcgtctttgtcattttcattggttgctacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacaccccttctcgctgacgccgagggcagcctccggatgccgtcgtccccgatatgagataggaacaaggtggaatcgatagattgtaactggcatgagttagtcgtggggtaagaaattgcttgtctccgtgctctgatttgtaaccttggtttgtcgtttattttcattgccgactactgcgaatgagttagagattgttgtaacaatcgttcgaatttttttgataatatgtactgtccagatttaccttctctaaaaatatgtgtgatgtgattatgcaccgtctaaaactactatgtaattcttgaaattgggacagtttgatatccattccagattgacattgcacaatattgtaaattggaaacagaaccgccggaacgggaatctaccgatatcagtcggaagtcgaaaagtcatgtcgtaaacagcgaactgtgacatcatcccacatttaactatgcatgaagatgaccttataatttcacccttgcatcatcacgctgccacataacactgttatatgatgattaatgagttgacaataaggtcaacaaacaatataaacaaagttcaacgatacttcaatatcgataagttgacgagactatagtttaataacggccacatgccatggatatgatagacgacagcagatgggtgcggcatttttgttcggcaggtgccatcatgcttctccggcaagggacacagtgaggcgcgaggatgcgacggctaggactagcaagcggcggcgtggcggcgaggacaagtggttgcgacgatgggcggtcggcggtcggcggaggtagaggcggcggagagctatacgagagtcacgagacagggagaggatgagaagcgacacgctggttgacgcccattccctagggtttttcttccggcctaatgggctgctcctggtagccaggctcagccgcccaagcttccttcttcggaattttgtcggaaatttgacggaaattaccgatcaaaaaaggttaccaacaaaacggtcggaaaaaacccatctcatttccgctaccatttccggaagagattaccgtttatatttccaataccgacaattaccaataccgactgaaatggtcggtgcaaaccggacacggtagccagaattctaggaaatttccatactgttttcacccctactgccaggcacatgcatacgtgcatgtgtgttataccaaaccatgcgtacagacaatctagtgatgcctcatcacttgtaaaatgctcgtttcggtacacgaacttgtatagtttcgtgcaaacgagagccaaaatagcttggcaatattaatcttacgaagctgatattgattagggtgtgacgtgcatatgtatagtgcgtttgcataagactgcaattatttataaatttgatcactactttatccttcatcaaggaagtgatgatatttcatatctttcccacccttatatcattgctcttttttttaatctttttctacaatcacaaaatcaataagattatccatgtagtgttcttttcgccttcctccacacgcacctgacaagttcatgcactagaacaagcgttttataagttcgtacactagattgctaccacctaacaagttcatgtacggcgatgcaatttactcttttttttttcaatccccttctccaaatcgaaccaactctagaaaggggagaaggagctgtcgtttacatggaatgacagaagtggatatcgatctccgtggtgccatggtgtgctatccacacgtttgatccgttgcatgatagcccttctacacagaactcttggataactattacagactttcccattgataagaattgttcggtatagtgaagcagggtttctagatgctttagtggtcgaaaaaatggattagatatcgcagctctttttctcctagctagaaaaataatttctggtagccaatatccaaccccttccattttaatacatcaatatacactaccggagaattgatatttgtccggatgacaaaaatcacattagccccgattcgaataggaaccgagactaaagaatatgtttagtcccggttcaaaagcccaacagaattttttgatatttagttccagttggtaacatcaaacaggactagagatcattttttatgtcccggttcaaaaattgtcaagcctcccactatctttagtcccggttgtctaaaccaaccaggacgaaaaattaaaaaaacagtcgagccacatggggagggagagagcagcgcgcgtcgtcgtccttatttctttctccccctcatccactaaccctttctctttctctctttctatctctccttttcctcctctctccgatctcctacacctcctctccgatcgtagccgggaccgataggcggtggcagagccctctcctccactggatccggcggagggggaggcggcggcggcagcacaaggggggaggcggtgacggtggcacgaggggggaggcggcagcggcggtggcaagagcggggtggtggtggcacaaggggtaggcggcggcactcgccgtcgcggtgcatgacgacctaggcgcgcggacagtcgtcgctgggatccgcctctgcctcgcgggagaggagcgccgacggcgacgatccagctgccgaggtgtggtgacgggtggaattgggtgtggcagcagttgttgtggtggaggaggaggctgaggtgggagtcgtagtgctcgaagtccgcggatctgttttgatttgtgatggtagtataatttgtgatgatttttggggatctggatcactgatgatttgtggattagcgatgatttttgtggatctgtttttgtgatgatttctggatctgtgatcaatatgcaagcagcaaaaaaaaacaatgaaaaaaggaaaaaaaataatatttagtctcggttagtaacaccaacggagactaaagatatcctagatttgtggtgtcggtttgcaactcgggactaaagatcacttgtctagcagtgatattaagtggtatgatgttagtctaataaacctacatactcatctttactaatatatataaaaaggaggagttattctctttgctagatgcacctaggagaacctacacaaaacttcctatctcttttatcagccatccgatctattcatccaacggctagaaacggatgtagatatctttgtgataacaatgcgacagtgaaatcaccgattccccatccagccgagcggatgtgcgccgcgctatccccacgcaccgagcaataacaccggaccatgatgcgcctcacatcctcccctaagtagtggccaggtcatctcttccaccgtcgtgtgaaggcatggtctcagggaaggccactcgtggccatgagcatggagacaacagagtgctgtgacatggctgcggcctgcgggagaggagcctagggtttcacgagagcgtgtgctggtgtggtggagtcgaccggtggccgctctgttacattgcctgttggccgtcgtttcactcgtcattcgctaaattggaaggttgtggctgctattgatttgaaccgtgacaatggaggaagcctcggggcagttggcgaggtaaatatttgacgccgttgatttatttaaatatatttgaccgttcgtttctgttactacttaaaaaatttatgatgtttttgtcgtccgtctaacttaaaaaaaagagcgatcctgaaaagaaaaacgcggcaacagaaaaacaaaagcgaatcggaggtggaaaaaaatctcctccccatctcccgatctcttttttttctttttatttctaaaaaagtaaataaacaatctaaattcctaatcacaaaagggaacagatctagtctctaatccctaactttacttaaaaacttaaaaagttaaaaaagtttccgtcgtccgtatataataaaaaaccattatatggtacaaggggcggaaaaatccaattttctaattgtggtaactacaacgatccatataaacattatcattaatatggttatgcatgaaaagtgtatattgtcattggattctttttacccgttgcaacgcacgggcatttttgctagttatttaaaaaattgaagtaattcttaattattttttctatcattactcctagtgattaaaaatcaaacccacaggcacatctagctagctttatattattaccattaattaattctattagaatatacgacatgcatgcatggctagtggtgcttgcaatcaaaatcagaggcatgaagtagtacatattaattaggccccttattacagcttattaattattatggctgagagcctgtcagcctgagactgatggagagtggccggtggtcgccttagtggcagctgtccatctcttccatcacgcatgcaggggtcagattattccacccgcatttctttgcaatgtcctcgatgcagattggcggaaccaccaatccaggatagtggaatgcaatcagagatgtccagattttgtcgtcactaaggtcgtcatcccggcctgttaacacaatacaaacagaattaattagcgcatgcatgcacaagtaattaattaggaatagaagcgctaacacaatacaaacatgcacaagtaattactactaattaggaagagagaatcaagctcagctagattgtgagaaaacatgagatggatggatggatttacctccccgggtttcggtagcggaagtaatagttggacagataacaagaactaaaataagaacacctgctatcttcgtcatcttggtcgatttcatccgatcctttgctcctcctccgtataaataggctccagcccatgtgacgtgagtataataattaatataatgtatgcgaattttgctcaatatcctcttcaacgtcttactatgtttttggaatttggacgtgactacacggtaattaagtgtgcacatgacccgttcgcggcagcctccgacaacaagattttctccttccactagtaacgtgtactcctactccggccactaatcatgcatgagcggcatgacagaaatgtcacattcagagcagtgtgattaaagcgaatgcatgtctttctgtccacctgcttgtgcaagcaactgttagctaatcccctcctccactttactgtctgtgtgctcatgcagattggtttaaccctatagctaatataattaattaactaggcatgaaagtaaaaccaattaggaaacagcagagaaaatgtgacctggtgtaaacgtacatctatatctatctatcatatactaaaagttcattaaattaacttcctacaaaaactcccaagccgccatgtggtctcctacaaacgctcgtaaaccgccacatggtgttctaataaattaggaaaaaaaaatcggtggacctactaattttacccattagatctccatctcaaagaaaaaaaatcaggtatacccaccacgatactcccctccacatgtggaatcgtatgtcctcactaatccccacgtatacgagttctacatacaaaccactatccaccgatcgctaataagtcatattgcttacaagacatttcatgcacaatgtacctaatataagaatcagctgatatccaatgagcatgcatgcatgtcatctagcaccaaagataaagaacgatactccgcgagtaacatcaacaactgataggtaggtagagtatgccaccaagctacaaccaacagtagttgactacaagtaaactgagactattagtagtagtgttccgacaaaatacacctaagttgtcacgtgactctaataaattactccctccgttccaaaatataaggcacaaccaacattaacccaaagataaagaaatagttattatcatcttgtagtttggatcatcctaataaatataatgcatgcatccaatagaattagagaatgtgagagtgaattgtttaaaaaattaataatttaatgaagaagatgtcataattaattgaatgcatgccttatattatggaacatataaagaaagtggttgtacattatattatagaaccgagggagtaattgttctataaatataataaataaaataaaacaactgatcattggtttccacttaaatcgatggaccaagatatggttcgatcatcggaggcgttttagtttatatggttagggaattcatgttcatatatacatgttttagtttatctgcagctgggtagtaaaaggctagtggtagctaagcagcctagcagaagtgcagagaacaaatgtaatttgatcagtttcactctcatccagctgagaaccgaacgtctccgataaattaagaagacagttcaagtcaaaaggagcgaggaaattagggcaaaagttgatgctagtgaatctgaaatctgtttacacccaaatttgacacctatagacgaaataggggaaaattgccaaagtttggaaagtgacgggtttccttcacagggccggtcagaccacaggtgtgtgggcggtctgaccggctagtagggccggtctgaccgcaggtatgtgggcggtcagaccggcagggtccgagtccgagtctgttttcgtcgggtctcgggtttccttgctcgggaaggcatgtttcgtgtttcctttggtttctatcccgagttggacatggagaagggcctgtagagggcaagaccaacccctatttaagcgacaaggccggttcattgtaaaaccccccaaatacaatctacttgaatcgttcttttactatgtttttctattttactctagtttagtctatctttgtcggtttgcgccgtaaaccgtccgccgccgctgcgagagtgcgacacctctttttaggtttgtcctgaaaaccttccattttgcccacgagacgggtagttatcctcatatcgatctaaatcggcctagaggctgattttgatctctaaatcggctctgctagccggtttagttgcttttctacaaaacccatcttgatttggccctttggctagatcgaggtggttggcgactccatatcaccgcaaggcgtttaggtgttgcgatcgtgcttgtcgacttgtcacaaaaagttgccaacaaaatccacaaagagaaactattggttttcggatcatctacagtgatatgatcccgttgccatcatacgcatcagatcagccatcgcctgtttgcaatttgcaacgaggagcaatgtaacaggctagctagcaaccagggtttcatttaccgccggggccgcggttaccgcgccccggcggtaagcacggttaccgcacagtaaccgcggtaaccgtgacaaaccgcgacaaaccgtacaaaatttatcaaaaattcaaattattttttaaatttatttgaatttgacgcggttaccgcggtttaccccttaccgtacccccgcggtaagcgcggtaaccgcggtaaccgcgcggtttaccgcggtaaatgcaaccctgctagcaactgaagcttgaagcttgagcgcctggacggtgggaaggaggatcctgccaccgtctcgctccacgtcccgccgccctcgccctctccgccgccgctgccatcagagctgaccgagcgctaccctgacgtctagtacgccgcgtcctcggctcctcacccgccgcccacagccgcctccacccccgcccaccgccggcctcggctccttacccgccgctcgcagccgccttctgttcaccaagagagagaggggcagagaaggagagaaacaacaagcgctgaaaggtgggccctaccgttgtttttgctgactgtattgctacgagtgtgccacgtaggctgaaaaccagttcgaatcgatttagggttataatttatccagttttgagagtttggggtgttaaatgtctggtattatagtttgggggtaaatcgtactaccgcaatagttcggggggtaattcgtactttccaatatggaaatatctaactatttgccaaactattggtcatcattaattacaatcttaatttggtttttctcataattctaaggaaacataaaattaaattccattaatatattactctgtatgtttcaaaatattactggtcattctcacatttgaaattattattttagatcgcggtattctatcttcacattttatcaatgccatgtataactgttaatcaaagttaatattgcttttgaaaactataatgtagttaataagcatagcagtgtaatttgcacatctcctagtttgatgtgaaattttgctacaatgacaaataatataaaatgagagataggcaaatttaatatatattttgcagatgaaccatattacaggctaaattaggcggcacgtcaacagggcgtgcagatcttctagtatctaataatctaaagctagcgcttcttgtgccaacgggacatttaactatttgtcactattatgtttgacaattatcaaatgcccctcttagatttgcacatgctttttagaccctcttaagtggtggtttcttaactatttgccacttttgtccacgtggcatgccaacgtggatatctagggtgaaaaacgacgtgggacctactggtcagtctctatctcccctccatcttctccctcgtcgaccctgattgccaccttggcatgccacgtaggtaaaagtggaagaaaagttaagaaaccaccacttaagaaggacaacaaaaagtttgtgtaaatctaaaagggatatttgcataattgtcaaagctaatagtggcaaatagttaaattttccggtgctagccgattggtcttccgtcagttctacaaatttgcgccacgtggccctaagccccgcgagcagaggaaaaaaaaaggtaaagcgccgtttcttgatttatcacgggggagcaagccgtagcaaagcactgagctcccaagctgcctgggagggatgaaaacggtcggaaacagtcgaaaaaccctctaccatttccattttcattttattttcacgaaaatggaatcggaacgatacactcggaaatggtaacgatatcgcatgccagattttttttaaaacaacatgacaccattcattaccatttcagcaatttcagcaagcagcaaaggctcaagttgccattcatacattctagtctgaatgacttgtctgatacattgtactagagggtgggacgcgccaatggtgcgccgcctgcacgtacatgttgggaatagcaacaatccggttgttatacttgcacactgaaaaagaaacaggttgaaagcaatatagcaggtgaccatgttaacttactcaggtgtccatatatagataaggatgttgcctatttggtccttataacagtggctaaatatgtgggtggcatagtagatttacaagtgcagtctgcacgatggccttataaggcacaaggctaattaacaccatattgatatcataagatattagcatcacgtttcatggagagcgaaccctgatggcaccaaaaggactgtatggcagggccagtacggtcttcagaagatatctatggttgcttgcaaatgcttttcttgtagaaatgaaaatgcatagtgagcaacctcatgctgttgtttactgcaaagtctgtccatccatcttttaagttgcaacgatgatccgttgatgtgtggagaaccattgtgattgaagggccttccaatgcttgaacttgtatatccactgttgcgctgtccatgagtggcgctatgtgatctatggagtatttcgtcgaaaagtactgtaatgaaaactgggtgtcagctgttggctgaaggcataaaagaatttaaagcaaacggaagagctaaccactctgtcttgtttcatgaaggcctatgcgtggttggtgcgaagagtgtgataatatgttgagtagatttgcagaaagagctgaaaattaggaaaggtaaataaacatatcagaaacaaaatataagacaacgataacatactggattgttcactacacataagcatcttgttagttagcagtctctaataactgctagatacgtaggaggtatgttatatttacaaagaagtgcagtgtgcacgatgaccatctaagatgaaaagctaattagcaaacagtagtaccataacttgtaaatggttgatttccatggggatggatactgcagtttgttgacaggaaaaggatgggtatagcatatagcattgatatagtactcttcacaggacatcaatttttgcctgcattattagcatatttgaagctgatctatgctaacaattaacgtattttgggattaacatggtaatagaagttgatctattagaattattgttccagtcataaatcagaatatgctgattgttagcatagtcagttgtaaatcagaatatggctaaatgatctacttcaaggatcagtaagtttaaatcaatatttcctattcctagctatattcctcgtttgattgctacaagcattgacagattcctagaagcacagtgcattagataagtaactttcataaattcaaagcagttacaatgctcatcgcaagatgtaggttttatacaggatatcatacagcacgcaggggcgagtttcatatatagtaagtcgtactaatggcttggatttgcaaaaaacaaaataggaccacactgtcttgttgttgcttcattggttctgttcgaaaagggataaaatgcttcaccaatcaattgacctatagggaagtaaaaacagtagtgttaattaattgggaaagtggtttgcatacatgcgtacccaattaggcatgctgaagagcttgcacaatgggagttcctcatcataccgtccatgaaagagggaagacggtaatgcccacaaataaaacatcctgcatataccatcaaatcacacagcacaggttcaggataattcagttcacaactggccattctggccaatgtaatttctcttgctactaaaagaaaaataaatggctgttctctatatgttgaatagggagagacacggtgccttacaatattgccaagatgaggagcctaattggtcgaaagcctgtcctaacaatcaacatattcttttacaactgaaacaataatgctaatagccggattcttaacacgaaaatcacagaaaagaaatcaggtaaggttaattgcaagcataaacaccactatcttcaagctttcaaacgaacaaattccatcaaaacttagcaatgatataaaaatcatggacaaggttgggaggtgatatattgaagattttttttactatttccattagctaagctgcaagacttatttgcacagaaatcacactacacagagtcatcaagctttctaaagggatattgaattgatacatagaaaatataatagttgcataagttttgaatgggagtcgccaacctgataaatcatcacctatacggctccagataggatctcattcattgccgataagccacaacttgtggtactctgtaaaacaaacagatcgagaaagaatccatgtaaaatatcagaacctggtaagccaagtaaatcattagtaagaattaattgacgtgaagttgcatatcactgtccattaagtattctctattgattagcaagttgttaatcttattaactattattttaatctaagccaatgtaatttaatctttatgatgtttatcaaaaaaatagtccgtgcgacgcacgggttgatggctagtgaatataatgacagtctgaaaactaaaccgagggcaacaccctaatcacttgcctgtaaaaatgtgcaccctaaatccaggtataaagtgatgttggattgcaagctctatgagggactctgaactcttcaaaagacttataactttaattgcttcatccatacaattatcctacaaaattaaaggtgcgcacaagtatgattctacattctggttcttgtattgtatataaggaagcacatgtactgccatactggtccatgtatggcaagattcaggacccatggctcattgttcttttctcattgctaagaacacaagaaaaaaattcatcgcccaatcatttgtaagaatgaaatttaaggatttaaaataaactagctgggtggcccgcgcaattgcgcggctagcacccatataaacttatatgtttttaatatgattttacttaaattttattaaatagttatctcgttgtcttaagattttgaaagatcaaaccttatcattctcgtgtttctaattttatactacctccatttcaggttataagactttctagcattgcctacattcatatgtatgttaatgaatctagacatatatgaatgtgtgtctagattcattaaaatctatataaatgtgggcaatgctagaaagtcttataatatgaaacggaggaagtggtttttaaaagtcacacctgttgctacccttacatctgtcatattattctttattatttgcttgctcgatttaccattgtttctattcattctccttggaacctttaaaaattggatctaaaaactataggtttattgtcatgttgggcttcttttttataatttctagaagtcccatcaaacgctgccattatactcctctacgaccatccaccgcatcttctctttattgtcattgctattttagaagtcgtacataattattgtttaggttcattttttttactttctagaagttccaccaaaatatcagcgacttagtcaccatactcctctatggctcgctcgctgccgctcttctttattgtcattgagtttttaaaatcaaacatgattatcattggggtttattttttttattatttagaagcccgaacctttaaaaattagatcttatagtttttagagtttattgtctcgttgggtttcatctgttttataatttttagaaatcccgtcaaacattaccactatactcttctacgacccgtccgccgcatactctttattgccactgggattgtaaaaatcgatcataactatcattggaattcattttttactttctataagacccaccaaccatcaatggctctgccattgtactcctatacaggcccgctgcctctcgtttttattgtaattgagattttaaaaattaaatatgattatcaccaaggtttatttttttactttctaaaagtcaaagtcccgccaaccgccttgaccgattgcttcacgacctgcccgttgtttttccttttaatcgtcaagttatcagatgtcccatcaacagccaccactctgctcctgtataggcctgttacttaattaatctcgtcatgtgttttagatggtctttatttttcagttgtctttattttttatcaccaattttaattatttttaaattgtattcctagttgaaatcttatttttatttttctaatttcagtatttattttatttttcgtattgtgttcttttgatattttattttttattttcaatttcagttgtttcaaaattattttcctactttcactctctttttaatttgcctaatttcagattttattttatttttattctgaattttaattaatctactattaggttcttatatctactctcatatcaatattgcttatatttaattccgaattccaattaattttaaattgtattcctacttgaactattattttcttttcttttttctttttttattttttattctgaattttaattaatctcgtattggattcttgtatggactcttctttcaatattccttatttttaattccaaatttcagttatttttaaattgtattcctacttggacctcttctttttttttttctaatttcggattttattttatttttattccgaattttgattaatctcgtattaggttcttatatggactcttctttcaatattgcttatttctaattccgaatttcagccattttttttattgtattcctacatagactggaaatttttagcccccacaacgaatgtggtgcctcctttcaaagctgttttaataatataatagatgaatatggcaagctgtagactcggtgaaatcaatctctaatatttagctattagaacggaaccactaataaccaatttcgcgtttgaaattagcaaactaagaagtgaacagatcaaggcaagcagccgcagctatggcaagacagcaccaaggcacgcagtcgatgaccaagcttctgcagtagaaggtaaacgttggccaacctccaccaatttccttgaggcttgatgagtggcaaatccaggttgagaatggaggatgggctcgaaccctaagttcaaatcagtaaaacaaaaatgaagcatatgcccttacacatgtcgaatgtgatgtgcacatgatgaaatggaaaaaataattactcagctgttttatttggttcattcaacaaatatgccctcctcacttcatctctaattttagaagcataattgcatagttctcaaattgtatttgttatgtttgatcagcaaatatctctttaggataaagtaataatcgaaggctctttgattgattcgtgctctagttattttggggtgggggtgtcacttgaactgctagtaaatcaattaacatatgttaaatccccttaatcgacaaatagatcagatgctagaaatctagaaagaataaagtcataccactcgctgtagggctgtaggccgcagccaagaagggagttacgaattgcaagacataactggagactggagaagtagatcagcttcccgtctccaaggtcttgcctcctagcttgcccaacggcctgaaaacggtggccaggcccagcgctcgcaactcgcaagatcatggttcgcgcagtctccctggctcacccccaattcgtcgcgtatctccgtcacatatggcgtgacgcccattagggcatcgaggtcggggttctcgggctactggccgctgcctgctgcctcgcaccgccacaaatgcacatgctcggatctaccgtcgggtggatgaagaccgtatctgcctccaaaagcacccctgcacataaaactgcccgctttttattctaaatcctatataaagtaacaaacacacaggaaatacacacgtcctaatacagataaatagcatctcaccaagcttcaccctccaatgtccatatagtctgaatcaggctgcaaaccaatcccaaatccaagaaatctacgaatgccagttaaatccccagcttcgccgtggactgagaagaataaacaaattaaagtgtacaatgaacttaactataatgaaggtggatgagaaggtcagaactgcacatcccactactatgtagcagtgcatcctcatgcataaaaacatatattgatgaacaaagtctaaatgctaaaagtctaaacacaacacatgaaacaccaaaccgtataatcaaatgtgcttaatagaacggcataaatataattcaatagattgacattatacgtaaccaatgtcataagggaccaacgagaagctaaaattggaacatgtcatcttttgtaaataaaataacaaaacagctaacatcttcatgtaaaatctatgttcttataacatagatacaaaggcatgaattatgcatggccgtctgttatctacatggatatagtaagctagttctatataacgctcaggcaagacaaaaacacatcctgggttcgtgcatgtggattatatttatataaattagcacctaagttgttcttgtgaacaaaacctgtataaacctaaaattagtaaaaaaaggaactggaagaaaacgaaagatcttcccatggaactgataaaacacggtgaagacataaaagcagaggtaaacctatagctcatgcggggcagaaggaaaacaaacaagtgaacaattcataactctctttttttattctaaagcagcacattagcaaacacatatgtatagtggaacatatatttgaactgaggctattgcatcctgaaagctcagcagctgaaaaaaaaaaagaaagcatgcacaaagtgtagggcaggcgcaaagagaaccaaaaacaacaggaaatgtaattttcatgcacaacattcaggataattctggtcgtaatgcaactcaattccaaaatcgcatgtatctgatcatataaaccacactcttatgataaaaaggctttctggacatcagaatatcaatagatataaaaacatgtaatcaaatgtgcaaccatttagcagcaacttttaataataacatgcacagtttttcatggaaagcagcatgaaactcaaatttcaccttcctattaatgaacattaataggcaacaattttccccagatctcaacattcttccacagcattagtcatgtataaaattaacgataatctgtatgttttttcatcgacttaaatttatgaccattatcataggataaaacaaaacactaagttttaagaaccaatcttagcatggccgggtctatcatcatgtctcttacaataagtggcaagaagagtagcgcattaccttgttagttttctctgatgaacaagtacggcaccatcacactggagacaataggaagctcatttattcgtttgcctcaaattgatccagtagaaaatacgataagaagcatcattttacaaacttaatcataaccagaataacaataccaaagtaatatttgtgatacacataatccccaaggcccaactacaaacttttaggtagagcaatatacaaacgcaatatcaaaatctatatcacatcacatacagtttccaaccagccagaaatgaggaccagaatacataacgaaaaggtaacgccaaaatcataactgaaaaggtaacataataaacatggtttgctcatcttagataagcatcaaacacaaagactatgaggaaccacaccaaacagtttttttttaaccatggcctcaacatgtatccagttaaatagattgaccgaccataaagttaatcagaccatctaaatataattataatcctggcctatgcgactgatctaggtaggtccactcacccatccgctaatacgttttttccttccatcttttgctgccaccaaccatagagtgctgtggtatacacgctagctgtttggaacgaagcctgttgcaatcaaaccgagaaatacctttttagtctttaaaaaccagataaaccataaattaccctatcccaaacatcgccacataaccattaaaaaatgaatataaaaatgatacaacgcactaaacaaaaccttgaaccctgccatcctccaacaatagaaaagcacaggaaaaaaacgaacaaccattcaccgatagaaaccgagctggacagaaaacgcaattgactcttcccatatcacccaaccataaaatctagccagcttacattatgctattaatcatattatttttgcacttccagaaagagcactgcagtaacagatttctgactaaggcatcaattaatagagacctgaaattataacttcactctgctgcaacaattaaagcgcaagctaagatgttctcccatacaaacggaagcaaataatagggcaaggtactctcttgactgaacctaccaaaaacaaatattcaatgtcagcaaagtgaagtagctttattttattttggaggcaaaaccaacacctgtagtcattctgttttacctatctataatttttaaaccaccttgagcagcctcaatcgatacgcacatttcttgcaggtgatcttccatgtcttctgtcagtttgtcatagagctttggcccatgttcgtgaagtgccagattataagcagtcctgccagaatataaggacaatattatgttctggtacataagaaggatattggttccaaacaagtaaaaatactatactgtgccatgaaaggctagtaggtcagacatgataccatggaaagacctaataatactaacgaaagtatttccagaacgaaagaaaaaaataattcaaatatcacaataacacatcacttaagggcaagcaaacagggcagttggcctttgcttctctcttaaaattctatttattgcactttttaagagtaaggggcatagcgactacagagttccattgaacaagttgtatgacagaagcactatctacagactacacgaatagtaaaagcccatgcttgtgattgtagaaatagagtttttatgtaagaaaaataacaattttccaccgaaaaaaacaacgatgtaaagaagaaagactttcataagtattttgaggcattgttcagctaatcttgtttcaaggggataaggacctgtttttttatgtgcaaacaaatgcataacatagaccacgctgcacgcaaactctcaagtgataaaaattgatccgagatgaatttccctagatgtaataggcggcggcggtggtctatatctccaccccgactgggtcgtgcccagagcataagcagggagccatatgcccgaccaccgtgacatggag

SEQ ID NO: 46653 - DNA, 7628 bp, Oryza sativa
  unsure (1)..(7628): unsure at all n locations
aggttacaggaaccgaagccccgtggcactctccgctgtgtcaggccagcgccgctccaaccccgcccacaacggacgccgcacccgcccccaccggcaccgacatccaagacgtcgtcgtcgccgccgccaccacctccacccttattctcctctctactcaacgtcgccggtcccatcaacgctcaccgggctgcaacgacaggaacgacgatggtggtggtgttgccgtggctgagcacagaagaaaggaggaatgaggcgtcgtcatggttggcgggtcctcacgacgagcagaaggacagagggcactgatctggggcgagctcgagagcctggtgacatacggttctcctcttctcgctgctgccaccgccttcattgatgccggctccgtcaccaacgtcgtatcttcgatggcagcggcaacggaggacggagcagcggccgtcggcgatggcggcgaaggacccagcaggggcgctcggcgatggcaacggcagcggaggacgggtgctgcggcggcggcgctcgacagcgccagagcgaggtggaggcgaaaatggcgatgctcggcgacggcggaggaggagacgctgcccagcgcatggacggcggtcagatccgcgtccccgacaacatggagtccggatccggacgccggcggccggaggaggcgcctcgcagcggcggcgctcggcgacggtggggaccgaggcggagatggctgctcgcctcgccgacggcgacggcgctcggagacgccgacgcgacggccacggaggtggacgcggccgcggcggcggaggcagaggcggcggcgcgaggggaacgcggagacggaggcggcgacggcggcgggagagcgggagggagagggcgagcgagagacgagagggagaagggggcggcggcggatagggttttgggagttagagcatctccaacagtctctctgaattggcctctccaaatagccatatagccaactctccatgtaatttagccagtcaaactagatgggacggacccacgtgtcagcctctactcctcttccccccccccccctctccccttctttcttcttatccttcagatccaaagctaaagctagctagctagctacccagctcacgcgaatggcctcctacgacggcggcggcgacggcgggcggtctggcgggggcgggagcggcgacctggcgtcgagcgccaagctggtggcggaggcggcaagtcggtgttccaggaccgcgtcgcgtcgcgacctggagaaggtcgacaaggcttgcatcgcgggtggcgcctcccggcgagaggcggcgcagagcagtggcgcggaggagcggcaccggtggaggggcgacgcggaggagcggcgccggggaagaggcagcgaggaggagcagcgccggtggaggggcggcgcggaggagcggcgccggcgaggggcggcgcggagcggtggcgcggaggagcagcaccggtggaggggcgacgcggaggagcggcgccggcgaagaggcggcgaggaggggcggcgcgaaggagcggagccggcggaggggcgacgatgatgtcgacacttggcgacgggatgacgacgccgccgggatgctgctgcgcgccttagagtgtgcggagagagagagggggaagcacgcgtgggtcccacggatggcaagctggttttgactggccaaatttggctaggcagggagccggtttggccagctgatagcttggccatccaaatagcaagtctgttggagtctgtctaattttgaaccaaacttgctaaatttttgctcggagagtgagatagcaagactgctggagatgcttttacgtagtgtgggcgtttttttgcgaaaaagcccctattcttttcactttttacattcatgtccacgatttttcctatacaaacactgtttgtgaggggcctatacgtaattaaagaaaaccggagggctttttttcaaaaacacacccgagcactatagcaaaatccgacgtggcgtcgctcctcgcacgccccttctgcgcggcataattgttgcttggaagggattggattcatgctaattgttgtattccttcaaccatgcatcaatgcttgattcagtggcaaggcgacaagattgaaatcgtgccagctgacaggtcagtcaatgttgccagtgccgatttagctctttgggagatggatggtcttgattatttatctggaatagtttgagatggagattttctaaaagtgtccgattctgatatatagccaattgaagatagagaacccaagctattattttgagggcgtcttggagggttcagatgtctacaacaaggacacaatagatgatctcaatgacaagcaaggacagggttttacgtcggccgatgatttggaagaaattgatataggtctaggtgatcgaccaaggccgacatttattagtaagaatttatctgcagaatttagaaccaagttgatagagctgttgaaagaattcagatattgcttcgcttaggagtattatgagatgcctggactcagccgatcgattgttgaacatcggctacctatcaaaccaggggttaggccacaccagcaacctccgaggagatgtaaagccgatatgcttgaacctgtcaagactgaaattaaacgattatatgatgctggttttatttgttcttgccgatatgctgagtgggtttctagtatagttcctattatcaagaagaacggcaaggtcagggtgtgcattgatttccgaaacttaaataaagctaccccgaaagacgaatacctaatgccggtagccgatcagctggttgatgctgcctcggggcataaaattttgagttttatggatggtaatgcaggatacaatcaaatctttatggccgaagaagatatccataagacagcttttaggtgtcctggtgcaatcggcttgttcgagtgggttgtaatgactttcggtttaaagagtgctagagctacatatcaaagagccatgaattacatctatcattagggatgatggcaatgggtcgggtcgggcgcgggtagagtaaaaccatgcccgacccgatacccgacattgcctgcccaaaccctacccactagagttagcgggcaaaactctgtacccatacccatgcccggcaggcgccggtacccaatggatctcacatgaataataacttgaaagatatgtaatttaacaaagagaaataaaatcaataatttaccaaattattggttatcaataataatttgaattacatcacaacttaaaccttggaaattcagcttctgtcacagatggccgattgacaactttcaagaccatcaggtttaaccaggtctgcagcaaccaccatggtctacctactccaactaccgatccgacagctatcttggccgatgcattgttcaacatttggtataaatagtcgaggaggattttgcccaaaggaaattgtttctttgattctagggcttcggctataaattgccagttggttgtaggaccacaactggatccacagaagaggaacttttctaaccacattagcaagaaagctacatgctctcgaggagtgacaggccctttacccatgtatgcagctacatagccagaccagccacctatgcttttggttctaaaatcaaattgattcttggtattcatgctcatagggttggccgatgaggttacatctagtccagtgatcatggtgatgtcaatcagagtaggagtcatcggccctcggttgaacagaaaggcattgatggtattggaccagaaataagtggcagcggccatcagaggttcatccttagctgaattggctatggtaagggcaagtgcttggccaatcccgatttcatcccagtgaactttcttactagccgatacacgcttgtaccatgtggtccaactcctctcaggggtggttttctcgagagatggccaagacttaaaagttttcttccagtgacctaggttagggttggctaatctaaaggggattctgttgctttcgccgatgatgaaatcagtggggtcaaggttgccgattggaccaagaaagtaatggttttcatgcgacaggctgggaatcgcaactagattggagaggtgctgcaaatccaaaagaatcgagaagaagaaaacaagatgaggaaaggggaaatcgatttcatgcgaggaaaagggatctagccgatgagaccttacctcagcgtactcggctgatggcgcggtagacgggctggcggaggacgacatcaacgcaggcggaggtccggtcggagatggaatcgctttggaatcgctttttgcgtcggtggagtcgccgcaaagagagggcaaagtttgtttcagcggcgaaaatagaagaggacggtgtgagatttctcgagggtgacgattagtatttaaagcacgggagtaatggtcggaaaatagcgaagtgcgaaacttgctcggagtcgatatacggcaaatctgaaacattaccaaatattccggacttggggggcatgtgttaacaaccaaatttggcaacatcggcatcggaaaggaagattagatcgaagtggaatcagagataaggattatcgcgagaacagagtaagaatcggctggagtcctgatcggctacgattggatcggctgaattcgagtcagacttttggtttggtgatacagccgattccgacaatacgacttggtgtacgacatcgggttgagttgatatgcttcaagatgatggccacgcgtggatagagtcctgggaaggcaattgtatctattaattatgatattttatgtaatttccttagatatatgtttgggcaaaagtctgccgttaagacttatggtatcttagagtttgttagagataagagtcgtgtccgatatggacatagtttgtaattttcgagtataaataggccccgaaccacatgtaatcaaagaacacacacgttcaatacaatctcggcgcatcgccacccttttgctttagttttatttcgacgagttcttactttcgggttgagctgcatcggtttcgatcctcaacaagaggtaaaacttgttatgacggcttgcgttctcgggattagtgcttccatctttatgatactctaatcttgtctatgtaattcgtcaagttatcatatatcttacataatctctggcattatcgctatttaacctattatcggctaacatctgtcggtagagggcagttatagttaaacatcgatgttgacttagattatataggatatctaccactctatgaaacttccagcggcttgattgtctagatattgttctttttttcatacttaatgcggcatcagttgagtttgatctattaagtcgtgcttagaatatcaatctctagcctgccttctggttgccaattagaatagtatcggggtttcagccgatcttacctgatttaactatattcaccctatatgcttcattgatatgttaaatctgccctttatattaagatcttgttgcatttaagtatattaggcctttgtttgatatattctacttgctttaacatcttagtatagagcggtatcggagtattagccgatacatgctagatctatctgattggctatgctatgaacatatatagtcctattattaatatatatttcgatctaagtgatttatactgtctcggcatggcgaccgatctatcccaatcacttgatttaaatatatatcgatatgaggagtatatatcgttaatatctacagctgatcgagtagatttagttctttcttatttatttatgactgtcgatcgatatatatatatatgacatcggctcaaagataaatgatatgtcatcggtacttagccgatcggctatcgtttataggtttaaccgcggtttccttgtcgttatttcttgttgattgcaggatcaaatcaactggcacgctagcatacccgaaggcgagttttggacctgcactggagttaagcagatctcccaggcctcgtgttttccgtcaacactttggaatactctcgggtgaaatactacaatggtatatccgtgcgcttgcggatgaaatctgtaaccatagtataccataagtatttcggcgccattgcaaggaattcatatttctagtaatgacgttaagaaataccaacatatacgtgtgcggcaaatgaggtaaaagatttaagccgctaagcttaattgaagacatggcttctattatggctagaaagtgcaataatgtcacgcccagaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaatcagcatttagcaaaacatttaggagaagtaaaacagtggagtaattaatcagaaattttaatcaacattgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccataagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgcttcgcaatgaatcatgttatacaaaaggtaaagccgttgcctacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataataatgagtcataagttatcccaatagtgtgctaatgtttctaagcatggctaagcaatcatacctaatatctagctgaaccaatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46654 - DNA, 1710 bp, Oryza sativa
catctcaaaatcttgcccatataactacctgtagtacgtgcgagtgtgtgcgactgcatgcaagaaaaaatgacattcatctattgtaacacggttataggacatgagaatttattgtatatatcataacaattcttgagaggaattagttaccacaagtagatcagatcctcaagagaaaaggagagggaaatgaatctaaatataccttccatttggtcaaatatacagctaggcgaattcggtttcactgcttgatcgatcgagtatctcgggtatgcttcgatgctagcttgtgattttccctaggaaagaatgtgtggccttatatagcgtaagacgatggtgtgatatttcacgagaaaagtccatatctacgcttgtaaccactcttaatctgttggttatgtaaatttgactggtaatagccaactactaacattcaaattaagttggctatgtaacatagtcaacttaattaatttaaatgttaatagtcaacttaagttggctgttaacagtcaaattaagtccgtatctacgcttgtaaccactcttgatctgttgggctaacaagagaagtttactgttggctattaacagtcaaattaagttggctaattaaattcattatcgacgcttgtaatcactcttgattatattactacactatctagggaaatgtcatttacgaacaaatgccaagatggctagttgtgtttcgctgagtagcttgattaccaaaattttttttcccaaaaacatcacatcaaatttttggatacatgcatgaagtattaaatatagataaaatgaaaattaattacacagttagggaggaaatcgcgagacgaatcttttggacctaattagtccatgattagctataagtgctacagtaacctatatgtgctaatgacggattaattaggctcaacaaattcgtcttgcggttcccaggcgagttatgaaattagtttttcattcgtgtctgaaaacttcttccgacatccggtcaaacatccgatatgacacctaaaattttttatttgacgaaaaagggcctatatatccatgcgcgcactggcccatcttatcaaagaaaccggtggtcagacagaagctagagacaaagttagttttcattatttgatcacgagacaaacttgcattgtagttgtagacatctttctattggaactcatagactcagattatttcactaaattaatctccgccatcctgtttcgctgaacttccaggtatttaagctactcgtgttttttgctgactggaacacgtacttaggagctcatacaaatatgaaaaaccacaaactcgctaatgggcctgttcggctgccgttttattgcagttgcgcgggctgcagctgcaagccggctacagaggcctatgttttcacctcgatggaccagtgggcatcctcggtcctatacgccatatggaataagttcacctgacatccctcaactttaagtccagtttgcctagggcccccaatccgcaataccagaaatctctatccttcaactatcacaaaccgtacaaaaaaagatctcaagacagtattgacccatttttccccggttccgctgacgtggcatacggtgggacccacatgtcagtgtcctatctttttctcttttctttttcttttttcttcttcttttctctttcttctcctctctt

SEQ ID NO: 46655 - DNA, 2248 bp, Oryza sativa
ggcctctcacccctctcctgtcggcgtggcctgcctcctttcccccttatcctgccggcacagccggcggcctctcccctctctcccgctggtgcggcctctcccgccagcgccctcccctcccgccggctgtcccatgtttgggaagaaaagaaagatgatggtgctgataggtgggtcccacatttttcttctatttcacttacatgtgggacccacatattatcttatttctattttgccgactaggatgccacgtcagcaaaaccaggcatctatattaccatgggacctaatttgaacagttttgtatagtttagaggtgaatatttctggtattgagaataaaggatgtcaaacaaactcggtgtaaagttgagggatggcagctgaacttattcttacgccatattgactgactcaacatgcaaggatttcttcttttactccctctagttaggagcccgtgcgttgcaacgcaaaaaaaaaaagtttttcggctcgtacaacgaaaatcgattaatataacagcacagtaagacagcacgtccatggatgtaaatatatcaagcatcttgcttttgtttaaaaataattgtactgatttgaaagcgataccaacattacaaataattattgatcgttcagcgaaaccgtatactacgtctaactatggagaagatgactcaagtatcaggcagacttgaaaaggctttatacacactaaaaggccccatagaggcttgagtagaattgcacatgagcaattgagcatggagagcgtccaaagatatagcgcacaaaaagatcgcaacaaaaaggagaaacaaacgttgagttaaaatgtaaggaccatttaagaaacaaaaggcattacacaaatactgctaaacctacgtttgggtgtactgatatgagcactcgtcatttagagtaaattcacacttgaaagccaaactctttaaaatatagatgcaggattaactcgtcatgttaattcacacttggaaaacatgtgagtattaaaaccggtgagtttttttcggtaacatgcaaataaatcacgagttgacaaaaatcactcaattgtccttgctgtagattctcacgatttgtccacaaactcagtgacctccaggcatttgagacaaacttactctaaaaatggcttaaaccataaaattttgcaaacacctaaaccacaataaatttattccatgtctgcaacaacagcattcagtgcatcaccagtccaaaggtatcagtggagttgtcgccaaacagacttgaatagctagcaaatggtgatgttgcatacaaaagggtgtttttttttttgagttgtgattcaaattcatttgcacataataaccatcgccggaggcttgggctggagcgaagcggagaatcgttattcttttagggtttcaccttcgtatactttcatgagttcagttgagaatccatttggtcgatggaaccattttaatcacaagatggcaaattctgctttctctttcccttgaaagaaagtccatgtccctgcaaagtgcagaatcagaacaccaatgattgataagtgtgttcatgctgaaattgaaaggaaaagtttagagtttagttgactacatgaataaatcttctatattttagaaggagaaacatatgggtagcaaacttaatcaattgcaatgacatcagattcgtcaaccagaagggcccaatctctagctattgtgacattctcctttcccttcttgtggccactaccggaagtggattttgatccctcgaggggatatccactcgttgtttgcatgttatttaaatggctatgaagaaaattaaaaaaaattaagaaaatgtattaacatgtgatataccactccataaacatgcaagtaaaaattcaactcctacatcttacaacaaaaaaaataaatttgactctgaatatacgttaactagctgcggttaatttgtttttttgttacgagatgtaggctgtgtttagttcagcgcaaagtttggattttggttgaaattggagatgatgtgattgaaaagttgtgtgtgtatgacaggttgatgtgatagaaaaggactgaagtttggatccaaactttggatctaaacacagccgaagaagttgaatttgaacctgcatgattgtgtagtgttatatcatgtagcgcccgttccgtcgtggcgcctagcgggaaaattatctcctaaaaaccctaattgc

SEQ ID NO: 46656 - DNA, 1887 bp, Oryza sativa
ccgccgtcatcgccgtcgtcatcgcccggccccgccactccgcgcgcaagccgccaagggatggaggcagcatccctcctccctctgccgcgtcgcccccgctcacctcctcctttttcccgaatcggcaaatgggcaagccccctttctccccctccttttccccttttttctcctcgccggcgtcatcctccctgtcgccgctttggccgtgaccgccgaacgccagctcgcgcccttgaccgcgcaagtcggttcccaaaccgacattgccgcccatttaaaccccagcctcccctttcccttcctcttccattcgcctccgtgccattaccgccgcccccgtgctctgtctcgcctccgccgtccttcgccgagcgccaggaggaccggtgcgttcgaggacgcggaaggggacttcggccgcgccctcttcttcctcttccccagcccgaggccggagagattactcccgcgccgtcggcctctcgtcacagcgccccgtcccgcacggtagtgtctccctccgttcttcctcctcgctccatctccccccccttagttttcggtggtagcacgagtagactccccgtagctagccggcgccgccccagccgttgccgtcgctcgccgtgtgctcgccgccgtcgccgctcgagctccgtagcacccgcacgtcgccagcctcgctcggcgtagctccgtccaatccgacgctagcatcgagttcccgaaaccgcgtagatactctcaccgccgggaatcgacccctcgtggtctcgtcgccgtttccctcttccctccccgccggttgtcgccgccgcgattcgccgccgtcaagctctctccggcgaatccgagccgttggctcgtctcccctcatcacgaacaaccgcccggtgtgctcgcttttgcccgtatcgccgtggttcgctccgccgctcgccgccgccgcccgccgtccattcgcggccgggtcgtcgtctacctcccgccagcccacgtggcagccacgtaggcgccacgtcggcgccagctcagccgaggtcgggacgggccgacctcggtcagtccctccccgtgcgcgcgttccaccgcgagccgtggggctgcgcgtgggcccgccgcacctgcgtcctccgcgaaccgcgtgcgtgcaccacgtccatcctccaccctagcgccgcgccgcgtgctccctccgcacggtgagccgagccgctgacaagtgggtcccacccgggaccgcgcgtggtgagcccggtccaccggactctctctccttcctccgcgcgcgcgcgtcttgggccgctctgggccgccttcttgggccggccgacccgttaagctcggccgagccgctctttctctcgggccgcgccctagccgcccgagaaaagtctataatccctccctcttttcttttctttatcttttccaaaaaggatttaattaaatccttttcctttagaccaaaaatccaataatcttagaaattcaatatcttccccgccgtaaatccgtttgactccgttcaacttccaaaattccccaaatctcgagatctacctaatggcatgcttagaggtcattaataaggctttattttcgccgtttgttgagttgtcccatttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatcttgttgtcccgtctgcaaggcagattggcggacctgcctaatttgttgcatttgatccttcctttgttaattgttataccatgtccccttg

SEQ ID NO: 46657 - DNA, 715 bp, Oryza sativa
atcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacg

SEQ ID NO: 46658 - DNA, 994 bp, Oryza sativa
ccctttcacagtgacgattgaccctagcatcctcctatcaaatgaagacaccccttactcacgtagcgatcacaaggaaggaacaatagtgaggagaaagtacgtgcggacaaccgtcaccgccgatgtattgccgtaattgttgtaaactattttggatgtattgaatatgctagttatatatgatgattaacaaatttaaatcatgcatatgctaggtatatataattattagaatttttaaaagttttaaatcatgcatgtggtatttacatatgttaattacaatttttaacaatttaatatcatgcatatgctaattatatatgattattagaatttttaaaagttttaaatcatgcatgtgggatttacatatgttaattacaatttttaacaatttaatatcatgcatgtgctaattatatatgattattagaatttttaaaagttttaaatcatgcatgtgggatttacatatgttaattagaatttttaacaatttaatatcatgcatatgctaatgatatatgattattagaatttttaaaggttttaaatcatgcatgtgggatttacatatgttaattagaatttttaatgcattatttactattttagaaaacatatgcaacgaaattcaatatcagtgctattatctttagacccggttcttaaccctaaccgggtttaaaacagaatttggaaatagcgggaaaatatctttactcccggttggtgagaacaaccgggagtaaagatatctttactcccggttcgtaacaacaaccgggattaaaaatctaaagatatctttactcccggttcaaccgggagtaaagatccgggggtatatatattcccggtgcgcccttgtcttctccaccaacacttcgacgtttttccatcgagatcgagcatcggcttctccttcgccaccactgtctagggcaaccccgcgccgacgccgccgtcgtctctcaccgtcgcctgg

SEQ ID NO: 46659 - DNA, 1768 bp, Oryza sativa
ctacccaggaggagacggtgagacgcatttacgagacacaagccacgccattatactatggcgcaagcggtacatcatcctccctgggcaacaagcggcgtctcgtgcaccatctcctccggctccgccgtctcctcctgcaccatctcctccggctcctctgccacctcctcctgcaccatctcctccggctcctctaccacctcctcctgcaccatctcctccggctcctccgcctcctccgcctccacctccaccgtgtccgcctgcacctcccaagacaaggtctcgccaagctccacctcctgccagcacaagggcaacgaagaaggccaaagttgacaccaccaaaaacaaggagccgccgtacggttgcagtcaagaggagcttgacgcttatgtggcaggagaagtgaagaggcaactcaagcctcggagtcctgaaaagaagatacctattaacccgagcgtgaagaatttcttcaagggaatatccaccgcaaacaaggaggccttaaagctatcggactatgaccgaacacttaggaaagcctattacaagaagtccaatccagttcctcgcttggaaaacaaccacaccaagtggtcgagccgttggtgaccggcgaagactttggcataacggatttcatttcggacaccggtctaactgtggctctgttggttggaggcgcaccaatcccgaaggcggaagtggcatacaagtttgaactcggtaaaccgcttgtcaggcctgagcggctgcagtccctaccgacacaaatgtataaattccatgaacggtacatggaaatgagcgccaatggtagagagatgttcggagcgaggattagaaaccccgacttcttgcaaggagaagatgttctatggatccatttcaaggatgtcttcgatctgtaccatcgggacgccctcgacgtctctcttctgagcgcatggattttgtaagtatctttgagttcgatttgtttcgttcaataattagctcctggcatatatgtaagcaataataatttcctttcattgttgtagaatggagattcaaagggcccgacggcggggggtttacgatactgggttcatcgaccctcggaaaatcaacaccgaaatgctcgacaagtacgagaaagacacagaggacaatctcgtccatctcctaacgcagcagcatttcaagacgttcatactattgtcgtacaacacagagtgagtttttattgtcgttcgaacaaatttcattcccatacatataacatgtacattctgatatttatctcatctcacgcatattccagattccactgggtcctgttctttttcgacttggacgcatgcagagtcactgtgtacgaggagaaggtttttgacaaaggtcttccaactgatagacaggtaatataatgccatctattccaaagtcacgggactctgttgctattatgttgatctcgggtaataattaattaatcatagcttgcaactgcacatgtagggcttgggatcggttccgtcaattggtccgcgggacttggaaagaaaaacttggatcgaggtttcattttccagtgagtacatgcatgatccaaaattatattgaattgaatctctagttacagttaatataaagagtatattaaatctctcatcgtttctcatgtagtgtgcaaagcaggataagggaactaacttatgcggctactacgtatgcgagtatgcccactgcctatcaaaccaaatatacaccaca

SEQ ID NO: 46660 - DNA, 710 bp, Oryza sativa
agttggcaatactacaggaaaatcgtgacataagcgtatcaatcaatcatcagtggtatacaaaatttccaaccatttcgttgattatgaattatatataagagagaggtacgtacttggacatttcttttttgggaagttgactagtacagcgagcatgtaaactatactctgcaggattagtgagctatggaggtgatagcgtcaaaaatagctagcctcccaggaaacagcctacaggagatagagaactgatccacggccatgtctcgctccgtccaattagcgatggccgccggcgatcaggccgccgacgacccggacagcctccggcttctccagctcggctacaagcaggagctcaagcgtggcctctcgtatgcacacaacaagtttcagtttattcagacttagcatgcattcaccgtgctaattagttcattcttttcaaaactaagaccatcttgatcgattcatctggatatatatacacacaggaccctgtcgaatttcgccttctcgttcgccaacatctcggtgctgacgggcgtcacggcgacctacaacacggggctgcgctacggcgggccggtgtcgatgacgctggggtggctggtggtggcgctgttcaacggctgcgtcgccctgtccatggccgagatttgctcggcgtacccgacctccggtggcctctactactggagcgccaa

SEQ ID NO: 46661 - DNA, 831 bp, Oryza sativa
atatgagcggtcaacatgggccggattggtttaacagcttgactttgggccaccgtgaaatgagtcgctaatcctaggataaagtacactgaaggtccctcaacttgtcgtcgagttacagaaacgtcctctgacaagatatatcacatccctcaacttaacaaaaccgtttacttcggtggttggttttatgtgacgtgacggttgagtcagcagacccacgtgtcagatgccacctcatcacttctctcttatttcgcctcttctttctctcgctgtgctcatctggccaggcggcagggtggccgacgggtggggactggggaggaggcccccgcgggggcggggaggcagaggtccggcggccggcgtccttcttcttcgcttctttccgctaggcggagtcgccagcggcggctttctccaccgcgcgcagccgggagggaggtgagaggaggaggtccggcggccggcgtcgcgccctccgcccgcatcctcgttgccgccgctgtggcggccttcttcttctcctctttccgctgagcagagtcgccggcgacggcttcctccatcgcgcgccgctcgacggggggatgccgatggcggcggggccgcgtctcgccatgtagcagccgtcgatgatcctcgcgccgttgaggagcatggcgaccaggagccggcggcgaacggagtcgaccaggctgcggcggcgaacggaggcaaccaggctgtggcggcaaacggccagccgccgaggtcgcccgctgcagcgctggtgaagttaggatgatgccttccagttttgctctgatatgaaggaacaatgatgcc

SEQ ID NO: 46662 - DNA, 720 bp, Oryza sativa
aaaggtacacccaaggtccctcaacttgtcatcgagttacaaaatcatcccccaacggtaaaaccagatatccagtgtccctcaacttataaaatcgtttaatttaagtcattcggtgattttaaccccggttttatccgacgtggcggctaagtcagcgtgagccccacatatcagtatgccatgtcatcccctcctctatctaacttcctcctctctctctctctctcacacacatttctcctctgtgctggctgccgacgggtcggaggaggtcgctgggcgaagacgggcggcggcagggggagaccggtggcacacggccggccgagggtcgcctgccgctgtcatcgccgcggccgttggacgccgacgccgacgtggaagcggtccctgagctcactgtcgtggaccccgacggtggtgaggtgagcaaggatgtgcggggtggtgggggcagccgtgtatgcagaggcaacagagacggcgggcggcggtcgacgtcgaccatctggaggcggaggcgcgccggtgccgctcttggatctcggccactacgcgggagtagatgaggttgggagcggagaggcccgcgggcaccgagcggtgtgtcgtcggcgcgtcgccgccctcaccgacgacgtggagagcgccattccagagagagacagatgtgggtgatggccaacgacgcggcgctccaaaaagttgctcgtaagg

SEQ ID NO: 46663 - DNA, 1693 bp, Oryza sativa
tatcacatttcgtatgatatatcgtcgtatatatatccgcgtatacacgtacgttggtacatgtagctaacgggtgcgtgcattcgtgtgttggtaatttttgtagcttatcctcgtccagccgtgcaatccatcggcgtgtgctacggcatggtgggcaacgatctcccgtcacgtagcgaggtggtgcagatgtacgtgtccctgggcatcaatcggatgcgcatctacaatcccgacagggaggcgctggacgccctgcgcaactccggcatcgacctcatcctcgacgctggcggcttcgacacggtgtcctatctcgccgccagctcctccaacgcggcgtcatgggtccacgacaatatcagcccctactacccggccgtcaacatcaagtacatcgccgtcggcaacgaggtggtaggcggcaccacggagagcatcctcccggccatgcgcaacgtcaactccgcccttgccgcggccggcatcggcggcatcaaggtttccaccgcggtgaaatccgacgtgatcgccaactcttaccctccctccgccggcgtgttcgcgtatccctacatgaatggcatagctcagtacctggcgagcactggcgcgccgctgctggccaacgtctacccctacttcgcctacgccggcaacccgcgcgagatcagcctcaattacgccacgttccagccgggcacgacggtgagggacgacggcaacgggctcacctacaccaacctgttcgacgccatggtggactgcatctacgccgcgctggagaaggccgacgccgggaacgtgagggtggtggtgtcggagagcgggtggccgtcggcggaagggatcggggcgagcatggacaacgcgagggcgtacaaccaggggctgatcgaccatgtcgggcgtggcacgcccaagaggcccggacagatggaggcgtacatatttgccatgttcaacgagaaccagaagacaggggctgccaccgagaggcattttggcctcttctaccctaacaagtcgccggtctatcagattgccttttcgaattagcagctgccaatataaatgagttacagccttacaggtgatcgatcgagtaatgcttcattaaatgttgggcgtattttaatgttctcagtatgttactttatgttttataataaaagctacatgaatataaacttttcaaggtttcttatcgattgacaacaattaaattggtacacagttattttctgaggccacaataccacgcaaagagaacgaataccgcatcatcatacttactatctttggctgtgtaatagtatgagggacatcagacatgtcacaaataacttgtcctgcctcttagcatgtactttctttcagaagttatagagatttgctgtagcgcccgttccgtcgtggcgcctagcggaaaaattatctcttaaaaaccctaattgcgaaatttgtttctttgcttgttgtctagtgtccgtgccatctcaagatctcaatccctgatctatcgtcgagttcaattccgaatccaaatccttccaatcaaattcctccgcaaaagtctattttgcctcccccgaggttgatgggccgaatctcgctcggcccatcttcccctcttccccggccccctctctccccgggcgctctctctctctctctctctctccccggg

SEQ ID NO: 46664 - DNA, 5404 bp, Oryza sativa
catcctcttgccgccgctttggctgcaagcgccgagcgccagctcgcgccttaaccgtccaatgtcggttcccctctcccaaaccgacattgccgtccatttaagcccaagccctccccctccaaactccctcattttcgcctccgcgccattgctgccctctgtttcgccgtcgccgatcgtcgttgcgcgtgtcggaggagccggcacgagcaaggacgcggaagaggactccggccgcgccctcttcttcctcttccccggcccgaggccggagagattactcccgcgccgccggcctctcgtcacagcgcccctcctcttctcggtgatgtctctctccgttcttcctcctcgctccatctcctccccctagctttcggtagtagcttgagtagcctccccgtagttagccggcgccgccccgaccgttgccgtcgctcgccgtgtgttcgccgccgtcaccgctcgagctccgtagcacccgctcgtcgccggcctcgctcggcgtagttccgtccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccggcgaatccgagccgttggctcgtctccccttgtcacgtgcaaccgcccggtgtgcacgcttttgcccgtatcaccgtggttcgctccgccgctcgccgccgtcgcccgccgtccattcgcggccgggtcgtcgtctacctcccgccggcccgcgtggcagccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcggaccgcgcgcatgcaccgcgtcccttccccgcccgcgcgcgtgcgtcgcgtgctccctccgcacggtgagccgaaccgctgacaagcgggtcccacccgggaccgcgcgtggtgagcccggtccacggcccctctctctcctccctcccgcgcgcgcgcgagtttgggccgccttgggccggccggcccatttagctcggccagaccgctccatttctcttgggccgcgccctagccgtcctagaaaagtctatattccctccctcccttcttttctttttcttttcccaaaaggatttaaataaatcctttttcctttagaccaaaaatccaataatcttagaaattcaatatcttcccaaccgtaattccgtttgactccgttcaacttctaaaatttctcaaatctcgagatctatctagtggcacgcttagaggtctttaatagggctttatttttgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctgtgcgagtatcgacggtcgccttcaaacttaaaatctgagaaacaacttgggtaaaactggagttttacaaaagacttggaaaacccgacacctgggtcggtgcttgtgaactaaatgaatttccaaaaccgcggaccggggaacgtaccgggtgtacggtttcccgctctcgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccataagctaggtgatccgggttagtaatgtcgtgtgggtaaagtgtaccacctctgcagaggttaacaaactgttcgaacagccgtgcccacggtcatgggcggatgtgaggtgattcctagcgtagttttgtttgactactgccttgtgaaatttgctgttgtggaaaggggatcgatgtttggaaaatctgcagctgatgggatcagctaggcccgggtggccgtttgaaggttgttggcccgggtggccgtttaaaagttgttggcccgggtggccgtttgaaagttgttggccgggtgccaaccttgaatcaattcaaaagactgatacattgcacatactccgaccggacgagacgcactgtctcatccgtgtcgtttgagaagcactcacttagttgatttcagaaaagagttcaaacaaaatcaattacgaaaacaacagcctttccttgaagcctgcattaaacacttatttcccgtggcttgctgagtactcccgtactcacccttgctctatataaataatcccccccagttgctgaagaagatgaagtggatcctgctgacgaggagttcttccaggagcaagccggctacgatgagttttagggtttcggcctagttcccaagtcgcgcctgtgatgattggtccaagtcctggcttccgctttccttttgtaatgcagttgtgagttcaggatctgtccgcagcccaacatgactgtacttctactctataataaagagacctctgttgctgtgatactctgtctccctgtgataccagcactgtttcctgggactggtatcgattaacaggttaatttggagcgtgacgggctagttccggtcgggactagttcggggcgtgacactggtggtattgcatgggttgacatcctggcctagggcttaataggattaatagaatactcatatcaacaagttgcaacttcttttccggaagccaatctccaaataactccagagttaagcgtgcttggcctggagcaatttgggatgggtgagatatgtgttggtctgtgagggcagtctatgacctatgaaagctatcagatgtaagcgggcctggcctgggggaaggcgggacgttacaaattggtatcagagccgactctcgcggtttcacgggcgcgtgtgttgcagttgcgcaggcatggtgcgcatggctggtgtagaccgggagtggttacacagcatggcacatgtgctggcactggacacatggacgtggccaagagaggacgttcctggcctagggttgatcgacgggggcgtcgatctctcttaagggggtgagggtgtaacatcctggcctagggcttaataggattaatagaatactcatatcaacaagttggaacttcttttccggaagccaatctccaaataactggcctggagcaatttgggatgggtgaccgatcgggaaattcttcccgggtgcacacgagtgaggacaaagtgtgcagaaaagatatgtgaccgatcgggaaattcttcccgggtgcacacgagtgaggactgcatgaaaaagataagagtgaattacgctttgggccacattttattacctaagtttcactttggaccacccttaaacatatattttcactttggaccggataaatttgccattgttgcatttggaccaccacgaacgatttttttcagtacaattaacgatcttaaacacatcagctttagtatacggccaaactcctatatgtatggttcatatgtttgttgaaagggaagttagtcatgacgagaaaaattgtttacggtagtccaaactgcaacaatggtaaatttatccggtccaaattaaaaaaataggtttaagggtggtccaaattgaaacttgggtaataaaaggtggaccaaagtgtaatttactcaaaagataactataggcaagcatgtgaaaacacactgttctctttgatccacaatcaatatgcattcatataaataacgaaatctcgtagtcataagcatgttgcaaacattgacaataccgtttgatattctcttcttggtttggtcacgtaactgaaaaaaggtttgctcttgacagttatggatttcaaatgcaatatggattgattggttggttggtaggtgcaactctgggatatgcctcggagatctaagctttttaggtacaaaaaattcagaactttgataattccctgttgtgtgattccttatttattttcttgtaacattgataattgtgcatgtgccaatatctttagttttttcaaacgtgaaagaaagtatggtctgtttatttactgtcaggaaaaaaaacaattatttgtgaagtagaaagttaatttggactttttctgcagttgaagatagcatgcatataacgttaaggattaatttgattctaatttatttatcaggaagtttcttggaccttagttagtaactctcattatatacatatttgtgttattacatctatgccctacgggctgcagctattattggaggctggtgcattttcctaactgccatttacattgtcaaaactttcttttgtgcaaactctctcttttcaacatcgtcaacaggaagagccaggaggataattttttcgaggcagcgacataaatcagttcgttctttggtcacctggtaccgatggttcattttaaacactccatgacgcaacctgtctcctgttatgcgaaaaatggaatcacaatcagactacagtgcagcatgcccctcctgatgatttttatattcgatgataggcgagacatatttttttctgcatttttaattgcaagttgctaccacatgtttgttttatataatttctttatcacagataaaaaaagttttatgtggccaattacgagaatgctaattgagcgcctttggtgacaatattactacattgaatgcacaccaacgaattgtaaatcagatctgaagcactttttgccattttggatctaaacactagtagcaaaacttgacaatttggcatttagcatttgctagtccatagtagtaaattgtgccaaaaagtgctttgggaccactcactctctctttctctctctcactttagtgctagaatagcaaaagtttaggatgcatctaaacaccaactagtacttttacaatatcaaaactttgccaccaaaacttt

SEQ ID NO: 46665 - DNA, 4791 bp, Oryza sativa
agatcagctcagcatgaaagagaaaaggaagggaaaaataagttctgaatatacctcccatttgatcaaatagctatgataactcgagctctgatctgcttgatcagtatctggagatggaattatgaatggcgcctcgatgctcgcgctcgctagctcgtgatcgtagctaggaaagaatgtccccccttatatactgcaagatggcgtgacttcttcctcttgtcaatgagacacttcaatcggttaaccagtaatcacgagatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctctattactgctccagctcaagctcgaacagcattccagcttgtcggccaaattggacatatctttcggcccaattggtttaatccccatctcttttagccgggccgcaagttatcccctcctcgtcacgctatctataggcccattattatctatctgtgttatgttttagaacaagctggaaatgctggttgagctcgagcagtagtagatagggatgaaaacagtccggaaagtttccgaattccggacgtgtttttggaaacgggaagtgtcggtcagaattttttcgaaacatttggaaacggaaacgaattccgaattctgaatttttttctcggaaacagaaacaaacatgataaggctgctattcgttggaaaccgtaatccgacggaaattttcaagaaatgaattcaaatttttttttcttagaatcgaaaagggagtatttctcatatacaactgattagtttcattcttctctactctttaatgtttaggtttatactagtattgatgtgcttaattaaatagaaatatttttagttccagtaatttagatttgtttgcatgattactttttaaatttttattagaccatgtcatactacttataattatagttatagatgaatatagttctttttctccaagaaagtaaagggtacaactagttattattattattattggtaaaaaaaaataaatatcggtttgttattttagaaaaaaatattgagctacatctctttcttaatttgaaaagttcaatttaagggctttttatattccgataagtatccgttaccgtattcgttccaaatcgtattcgttccgttttcgtatttgataaatatcctttgccgtattcccgttttcatcctagtagtagtagagcaccgacaccgattaggaaaacgtggaattgatctgagtgaaattactccgttctgcaatttttcttctaaaagattccatttcctccgcgtgcgaaataactacgaccgaatcatttttgtattaatcgagttgatatctgtttctgcgaggccgctgcccgctggaatctggagattgaagcagagaaagtgagaggaaaccaaaccgcgacttgaaacacctaacagactccatatgcggcttgtcagaaagagacaatgaattcatcaggctaccagtacaacaacatctcaaatgtcccatttgattcgcagtgttccatcacacggaatgtatagtatgagcagatgctggaggaggaagaaagcaaaggaacacaattccaaagcaaaagtataaccggagtcgaatacaaaagcgaggcaaacctcgtgatctcacgtgcgtccgaatcgaactctggtcgcctccaccgtcgtccggatcacgcagcctggccggccatccgcggcggcgggcttgcgccgccgtgctgctttggctggaagatcttggtggcagagggcagaggacccagaagtcgtcctcctcgccgtcgtcggtgtgcggcggtagcaccggggatcggtgatctcgtactcggccatcatccacccggtaacgaagggaattagtagcagcaagcgggagtagcttgagtggccataattaatccgagctggtggagcagtattctgcgttcatgatctgcatttgtgtcctctcttcaggaactgaaaagctggaaatgtttgtgtctatctgtttataggtgccatctgtttggcacaagatggtaccgatatatagtcacagcaggctgctgtcatcaaccgataaaaagatcctgaatttttttaaaaaaataaaataaaattggaattttttattcatgtagcattgtcacaaaaaaaaagggccatacagagtacatgcattaacgttcaaccaacattatttaatcatggattattcgtctctggaaatccttatttgcactggcatggtcagccgctagttcggaggaaacgtaatcgggtagaccggcgtcttgtcagggtagaagagcccaaaatgcctctcggtctcatccccgggcttctggttctcgttgaacatggcgaacacgtacgtctccagctgcccgggccgcttcggcgtcccgttcttgacgttgtcgatcacgccctggttgtgattcctcgcgttctccacgttcgccgcgaaccctcccgccgacggccacccgctctccgacacgacgacgcggacgccgggctcgccggccttctccagcgcggcgtacacggcgtccaccatggcgctgaagaggttggtgtaggtgaggccgctgtcgttgtccctcaccgtggtgcccggctggaacgtggcgtagttgagcgggatgtcgcgcgggttgtccctgtaggcaaagtaggggtacacgttggcgagcagcggcgacatggtgttggcgaggaactgcgcgatgggcacaatgaactgctgaaggtcggggcggaacacgccgtgcgacggagggaacgagttggtgatcacgtccatcttcaccgccgtcgacaccttgatgctgttcgagaggccggcggacacgagcgcgttgtacaagttctgcatggccgggaggatggtccccatgtcgccggggccgagctcgttgccgacggcgatgtaccggatgaagacgctcggccagtaggcctggacgttgttccggacccagtcggcggcggcggaggggttgttggcgaggttggccaccgcgccgctgtcgccgacgtcgacgatgacggcgacgccgctgccgcggagcgcggcgagggcctgctggtccgggctgtagatgcgcatagcaccgataccattggacttgtacagctgcacgacctcgctctgcgacgggaggttgtcgccgttcatgccgtagcaaacaccgtggacacctgcaaaaacataggagtgcatgtttatgccaaatcagacgatttaattgatgtgtaggaaaataaaatatatatatagagagagagatatcgaatctggatttttcacattttgatacttttgaaaaacttatttcacaaatagacccctaaaaaaacttatcctagaaatggtcttttttggggcgccagagtggctggcgccgtcatccaacgggatggcgccagcctctctggcgctgtcctcctgccaccgtggcgtacgcgaaccgacgtggctccattcctgtttctctgtatggagttgcaacggtgttatttttattttattttttcggatgtttttcacactcaggatcacgatacaaccaaccacaaaaaaaatttaaactcgaactaccacttagctaagtctgaaaatatctagcataccacttagtctactttacaccttcactaaaattagaccataactcatttagtaaaaccctttgatcagcatgttaaacataatgcactctaccactatatgaaattacttaatctaattcaaaatataaccacatgaaatgacatatataagttaaacagtatatagagatgcaattttttatttttattttatttttttgatattttttcacacttatgagaacataggaaccaaccgtataaaaaataaactcaaacggacaaaatatgtgacatgtagaattttccaaaattctaccgaaacggacaaaatatgccatctattaaaataggcgtaactttctcatacggactcggaatcaggcaaataatatatgcacggacatctacagaaaaagttacatccgattctcccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcttgtgagttcctaagtgtgaaaaaaatatcaaaaaaataaaataaaaataaaaaagttgcacatctctctcctctgcactagttcggagagaggagaggagaggaaaaattctacatgtcacatattacgtccatttgagttcaatttttttatggttggttcttgtgtgtccctaagcgtgaaaaaaattcaaacaaataaaacaaaaataaaaaatttccgggggg

SEQ ID NO: 46666 - DNA, 1098 bp, Oryza sativa
gtaatcgggtagaccggcgtcttgtcaggattgaagagcccaaaatgcctctcggtctcatccccgggcttctggttctcgttgaacatggcgaacacgtacgtctccagtggcccgggccgcttcggcgtcccgttcttgacgttgtcgatcacgccctggttgtggttcatcgcgttctctgccgtcgccgcgaaccctcccgccgacggccacccggtctccgacacggcgatgcggacgttgggcgtgccggccttctccagcgcggcgtacacggcgtccaccatggcgttgaagaggttggtgtaggtgaggccgctgtcgctgtccctcaccgtggtgcccggctggaacgtggcgtagttgaggctgatgtcgcgcgggttctccctgtaggagacgtaggggtacacgttgacgagcagcggcgacatggtgttggcgaggaactgcgcgatgggagccatgaactgctgcacgtcggggcggaacacgccgtgcgacggagggaacgagtcggtgatcgcgtccatcctcaccgccgtcgacaccttgatgctgttcgagaggccggcggacacgagcgcgtcgtacacgttctgcatggccgggaggatggtccccatgtcgccggggccgagctcgttgccgacggcgatgtaccggatgatgacgttcggccagtaggcctggacgttgtcacgcacccagtcggcggcggcggaggggttgttggcgaggttggccaccgcgccgatgccgccgacgtcgatgatgacggcgatgccgctgccgcggagcgcgtcgagggccttctgatccgggctgtagatgcgcatagcaccgatgccattggacttgtacagctgcacgacctcgctctgcgacgggaggttgtcgccgttcatgccatagcaaacaccgtggacacctgcaaaaacataggagtgcatgttgataccaaatcagacgatttaattgatgtgtaaggaaataaaatagcaagagagagagaaagagagagagagatcgaattgcatatgagagggttagttaattgattagcaatagatcagctcagcatgaaagagaaaa

SEQ ID NO: 46667 - DNA, 3646 bp, Oryza sativa
gtgcatactatataatgatcagttgaccatacgatcggttaggaataatccatgtggatacgcgcatactttaataatcagtttaccatactatcttggaatatataatatatacatggatatgcatattcctacgtaccttagagcacgcgcaaattgttgatcattgagaaaagttcaacataatttctatactactactgtactacatgatgccttagtaattgccactgattgtctgattaagcactggcttttgccaacctgtgatgcccatgttctcttggttcgttgatctctccaataactaccgagtcatgtgcaatgtatagaagatgcgtccctttaggctgagcaaattaaacttgatgatcgttttgtaatttcagcctgaaagaccctcttctcttcctccgctctcttaatatgtaactcaaaaaacttgccccgcagtgaattttcccaaaaaaaaaaaactaccgagttatgtcggcgacaagtctattcaattcatcaagcacgcatctatctttttcctatatagtttatacctattaaaatattaattcctacaaagtaacatatacatagagccacatcatcaacaatattttatcattagattgaattagtatgaagatagtagttatggccttatgggatcaagaagttatctggggtgtgtttgattctaggagagaaaaagagaggattggaaagatacacaaaacaagctaaaccattagcgtataattaattgattattaactacttaaatttaaaaaaaaatgactaatatgaattttgaaagtaactttttttatattttcataaatacattgtttagcagttcgggaagtgtttacataacgggttttttcatcatgataattcttcactcatctatgattgttcagttaattgttgagtactaactataatttaatttttatatttttcatagtgggtataaatttattagcataagagtgataaatgtcaactatcttacttactaacggatgggtgttatggcttacgaatggcaactacctttctttctaacgacttggctctaatggagcaaacacctaaagttgaagttatgtacacacacacatacatacatacatacatacatacatatatatatatatatatatatatatatatatatatatatatatatatatatatatatacaaccgatcaaatacatatttttatccattgttttctgttttatcatagataggtttcgctgcaatgcgtgatgttctcgctagttttcctaactatcaataccacatctataaaagatgacaatcgatgacacagtaagctactcttctcaaaaaccatatctgctatcctgcctactattggtagagacccaatttggtgatgggccaaatagacggccaactttttttggtggagcaattttacagtatttgactaggtatcatgaggtactaaaattttagtgtaaaatttagtacctcgtagtacctaggtactaaaatgtaccaaatttacaattaaaaaaagtggtacctcatgtatcttctcaaagaatataaaattgctctttttggtgggttcgatggaggagccacatgtgcagcacccttcgttgggcttattttggtctttgtccccattacaaccaacaagatgcacatcttttttccctctcaagagaaaattgcacaaaatttaagttactgatccacctgtgctcgctagctaatccagggatacaaattcagggtacgttgtacgtgtcaacgttggtgacaggcccttggaaccagaagcgagcgtgaagcacccacgcgacgagctgagcagcagcacgccaccgacggccaccggcgtgtagttgaacgtctccttggccaccgggtacgccaccggcagcgagaagagcaccgtgacggtggccacccacaccacacccacccagccgacgatgaccccgtacttgccgaggtggaacggcccgcgcacgaacgatctccgcgccgtcgtcacgcggaaaaacaccggcagcgcgcacgcgatcaacaaacccagcgtcgcgatcgacaccatcgcctggaaagccacctgactccccagcgactgtgccaaaaaaacgtacactatatgagaccagcacgtacgtacgcgcgcacgagaaatttgcagcagcagcagcagcaacgcgtgtgcaactcaccgtgagagccatgacgaaggccacggcgacggagagccagacgacgttgaggggcacctcgcggctgtccacgcggtgccacacgcgcgacagcggcatcgcgccgtccctcgagaacgcgtaccccatcctcgagttgctggtgatgcacgcggatccgcagaggaagatggcgacggcgatgacacccaggcaggcgagcgctccggcgccggtgccgtacctccggtggaagctggtgtacagggcctgcgcgatggcgtacccgccggcgtcgttgctggggttcaggaggtaaggtatgtcggtcatgatcgatgtcagggcaatcaggtagatccatccgaacatggttgacagtgcaacggacgtgatgatcccaattggcccactccaatccgcgttcttggtctcttctatctgaatatttatatgcgaggagaagattagtggatgaattgtatgtatgcaacgagaaactaaggattgttcagctatcagaaagttcagaattacgatgtgtgcagatgtatcgtagccgataagggagtactggctcatcagcaaccccgctgcgagaatgtatgccttgtcgtggatgcccgcgccgttttctgcgttgaaatgggtaaagatgaactcagggctcaccctctccttggcaaccgctggaatcaagatcgtcagcgaaaaggcacctggaattgtttgttcaaacagacaaaccgaagaatgagatgatgtatatatgggattcaacactgaatatctgaaaaatggccgggacgaacagcacctgcaacgttccagaaagctccaagttggccaaaccaggagagccatcgtatgggaaggctgttgatgaggccgtgcaggatgaggatggcagagtagatggccaacacgacgtacttggacgccatgtagccgccgccgttggcgcctcccgtggcaagcaagatgatcacctggagaagctgcgccagcgagaaatccacgctcgtcgtgcaagcccactggaggatcagttaacgagcaattggagtgtcagatttctgcacttttttccctcaaaagatttctgcactttctgaaaacagttcgagagtgtaaaattaactcttctttttactagttatatgcatgtatgttataatgaattagacccatataattagggatatgagccgcctatacgttaatgggccagcaccatataattagggagggatggtggttacttttcgtgaacagacgcgttatgcatattcggatgagagcatgaaagtagaataatttcgcttttaaaatagtagagatatacgatttagacttagtgtggaccagtgagaaacatattcatacttgtcccacaatattgaacctgtaaaacgttatgcatattcggatgagagcatgtaa

SEQ ID NO: 46668 - DNA, 2163 bp, Oryza sativa
tttaaaacatgataacgattaaaccatgagagataaattaacatgttagcgaagagcacaccagccagtgacccaggaagctaggggagcccattcctttccggcaagcttggcgctccagtagtatagcccgccggaagtcgggtacgccgagcagatctcggccatggacagggcgacgcagccgttgaacgccgccaccaccagccatcccaacgtcatggacaccggcccgccgtagcgcagccccgtgccgtacgtcgtcgtgacgccggtcagcacggagatgatggagaaggagaaggcgaagttggaaaccaggctaacaaaggattcaatatggtaagtttacactcacaagctacggtgaaatttaaaatgatcgcaatatgaaatgcatgggaaaagaaacataaaaaacgaaagaagaatcacatacgagaggccacgcttgagctcctgccggtagcccagctggtgcagccgggcttggtctgcatcggcgccggcggcgtccattgtcactccgacggagcgagacatcgctgtcgatctctgcttactacttgctagttgctacagtagtacggagtatatagtatctctgcgatttactacttgtatgatcggtggcgtactggcgttgctcagtacagaatataagcttcctagaagaagcaaagtctctgtttggcgtacaactagtcaagggagggagtggaaatcatgcacggctgcagcacaaacactttgccatttttgactttatgatttatattgctatcgacatttatcgaagccatcccattggtcttgcaattcaccgcagtcatcccattggtcttgcaattcaccgcagtctgctggtaagtttttctgcatggaacagtgaccgggccatagaaatgtcagacaatgatagtcgatacagcccaagaaagcaaacacacacacagagagtatatcacgtggctcatggacaaatccttacgcgcaaccgcaagaagccgacgtacggccaccggccgaccggcgtgttgtagaaggcttccttcgccaccggcagcgggaagaacacggcgacggtggccatcagaggaagtagaagtgggaaacacaaagatagagaactgtactcacaatagcaattgtaaaccaatacagtagtagatggattcagacaagaaagcaggatcaggcacgagaggctcaaaaaccagaaccaccgtttacatgtgtagaagaaagattgttattacatatggtacttccacaataatgataactacactgctgcctcgatctcatggcatcctggcacagaaaccgcattaatgcgttctaatggcaaagaaaaatttacaggatgaactgaaatacagattccacgtatgtcccgtcccgcttaagattaacatagtacaacctggcattctttatggagttgttcttttctccgtttccacagttcccttggaggtaaactaaaacatcattaacagtaacaagacagcaggctcagtaaggtcggtatcgccaatcagcccttgatctgctactgctacttccgctgtgaccataaccgtactgggacatcaacaagtttttgttagatgatttgcatgagattcaacagataattggtgacaatcacaacgaaccaacattaagcctacagctctgttatcacaaatgtactcggaccaattaacttatatataagcctactgtgcatcataagcataataatgtatttgtgcacttacatcatagtcgataccactgcagaacctgccataagttcgcattgaaccataagccccataaagatccatgggttccatgtaaccaccaccagagtcaccctcaagtggtgcagcagtgtctattgcaacctgaaacattggaatggtatgattagtgtttttcttttccccaaagaaaagctaaggttgacattgtcactttggctttggaggcatgggaagcagagacaaggagacaccaacagccttacctcatgtcctagaatttcatgacttctgcgagctacccgatctgccacaccctcatcagcaaaggtgacaaaaccaaaacctcgatgtccacttcttttagggtccttcaatacaattagaaaaggttgagattaacatagtacag

SEQ ID NO: 46669 - DNA, 866 bp, Oryza sativa
gtacatcttgtttgaagataataatatatttcataagtaactgaatgaaggaataattgcaagactgcttgcttatattcagacttactgtatcttctacaacataatctagtgaaggcacatcaccatgtagaccatcgctgccaccatggcctgacattgtatatgagttagagttagcctgttaatgttcaaaataaaagcagaaccaaacagatgttgttgataaaaaaacaatgcaaactgcatggataaaatcaatgaaattgcctactgtattttgttagtaagtgtgcactgcagagtcaatttgtgctatgagtgaacagaatgtggtaacattacaatcatgagctattctgaataaaatttcatgcttttgtccataacaaacggtaatactttgttattttgattgcaagcaggccgccgaggtggcctgctgcagcggcgtctgcacgacctcatcgccacggacgccttccaccgcgaccaccaggcaccagcgccattgctcccgccaccccatgccgctcttcttctaccgtctcgaccactgggcctaccccgaccgcgtcgcgtccacctccgcggcgtcgacatcgccgcccgcgagtcccacccggtcattcgcttcgcccacgccgacgccaacctccgccgtctgccgcacgcccggtcatctgctgcacgcccgcgccccgtctgctccgccggccggccgctccccgcaccgtcgcctggtcctccggcaggcccgtgctgcgggtgcatctgccgcagccgctccgcccgccgcccgcccactccgcccgccgcgcgctgctcctccccccgccgcccgcccgcagctcctcccgtcgccc

SEQ ID NO: 46670 - DNA, 2776 bp, Oryza sativa
gggggccgggggaattgcaggcgagggcaacttggacgtggcgcctctcctgcagtgcgtgaagccagcgctgcggagggaaggcgggaacacgcagctggccacctggaccgcctccaccccgctctgcctgtggcgcggcctccgttggtccaccgccgccacgctatctccaccgaatcctaggaggccgctgcacaacccttgtcgccgtccttgctgccgcatcctaggcgcctcggcttgaggatgcccttccccttcatcatgctacagagccggtggccggcagaggagaagagcgacggtggcgctcggtggcgtagacaccagagtccgccgctgccgccgccctccccttctcccacgtcaccggcgacctcctcccgaccctgcgagagcagaaaagtgagggggaggggggggggggggagatactgaattatataccacttttagatgtggaaactaactggatccatatgttatagacatatgtggacccatatgtcattgagatagacgtgacaaatagtaattgacaaatctaaaagtggcaaatagttaatacccgggggggaggggaggaagggaaaggagaggaaagagatgatgacgtggcaccctgatatgtgcggtcctacgctgactcagccgtcacgttggataaaaccagggttaaaaaccactgaagaacccaaaacgaacggttttgtaagttgagagacgttgtatatctggttttgtggtttggggatgtttttgtaacccgatgacaagttgagggaccttgggtgtactttttccccaagatattcttgtggtgtttattgggcctaataggccgaggactcatcaatttcatgggcttttcctcggagtttttcctccgcgcccgccacacaggtgtgaacaaacagatcgatcagagacagcgagggatccggtatacatcgaagagctgaagaccaattaatgcacaagctgaaacaatccaaaaatatcaaagcaatttgcattattgtccggaaatgaaaggcgacggttaaattttgctactatcctacccaatcaaataatatccccatccacatcttgattcttccatcgtagagaagctactgcctaaaccagacactagtaccatgcactgagcctgtaaagtttttgcaaatctactgcaaaggaagcacgatacagatggcgctctctcgctccgtcgaggtggccgtgcccgccgatccggccggcgatggcgatcgagataaaattcggctgcggcagctcggctacaagcaagagctgaagcgcggcctctcgtaaggagcagcttatcttatgaatttaccatgcgaagcctcgcaaactactactgttcattggcatctttggttaattgtttttggccttcgtgagctagtgttctctccaacttcgccttctccttctccatcatctccgtgatggccggtgtgacgacgacgtacagcacggggctccgctacggcgggccggtgtccatgacgctcgggtggctcgtcgtgtccgccttcaacggctgcatggccctgtccatggccgagatctgctccgcctacccgacctccggtggcctctactactggagtgccaagctcgccggcaacgactgggctccctttgcttcttggatcactggctggtgagtacgtgtatgtattgtgaattgtccgtctctcatgaacttctcgttccaagaaatgaggaaagccttgcaaaaatttcatactccagcatcttttaggcttcgtttaaaataggatatttttataggattttcgcggaaattgatcgatcgtatataaaaatcttgtaaaactcgcacattccaaaagagacctttattttctcaaaaagaaaaaaagagagaaagacctttatctcttgttctgtttttcattccttgtgttctgctttgcaggtttaacatcacgggacaggtaggtacattcggatttctgggcccgggcttctcgctaattgatgggcctttttattgggccatgagtacagaaaggaataagttcactttgggtccctttatttgttgcccagtccgattttcgtcccttaatcacaaaaccgggtacgacggatcccctaacttacgaaaccgtttaaattccctcggcagtatttgactctggttttggctgaggtggcaccgacgtggcttcttttgactagatttttgtccaacgtgttattgacgtggcgctgatggggcaattagatcccaaaaaaataataaaacttatggggcccacatgtcagttgcacacacaaattaataaaaaaggtgggcccatgtggacccacacgtcatcctcacaacctcttctctctgtcccctctctctccctcttgtctctctcccgctcatgggcggcggagcgacgaggaggccggctggaacggcgcacggcggccgagcgacgaggaggctggctggagcgggcgacggcgtggcggcgctgggggggcgggggtggacggagcgggtgccccggcgcatggcgtagaacacctcctgctcgaacgccgggtcgccgtcggcgaggaggcggtggacgagcaccagcatcttgagcgtgacgcccaggcagcgtgacagcgacgcgacgcaggcgcgggagtggagcgtgagcgcaatcacctcccggacgtggtgctcatcggcggggaagccatggacggtgtgggagaggtcacgcttgacctcttgacacatggatac

SEQ ID NO: 46671 - DNA, 2589 bp, Oryza sativa
cttttaggctagctaatattattacttgtagtactagaacacatgcaggaaatcttagccgattgcatgctactgagctactcgatcgctcatggattgactgagacgccagagctacaccttggtgtccgccttgccgctggtcgtcgagtcatcggcgctgccgccgtcggcgaccttgttgttcctcccctcggccatctccacgtcgtcgtcgccggcctgcttgccgcgattgccgcggcggcggcgaggaggaagacgaagatgctggcggcagcagcggcggcgaggaggaagacgaagatgccggcggtggcggcgcgctgggggtggtgtcggtgtgggggatgcgtcgccccgcctcgcctccttccccctgcgcacatgaagaagagaggacgatgaatatgagagagaagggagggggaagaagggaggagtagctgacatgtgggccaccattttaaaattattatttttagctgacatgcgggtcccatgttttttattattttttcgagatataattgccacgtaagcgccacgtcaatgccacgtgggacgaatatctagtcaaacaagccacgtagtcgccacatcagccaaaatcaccttcaaaaccgctgagggacctcgtctacacggtttttgtaagttgggggatgggtcatacccggttttgcggtcaagaacgaaaatcggactgagtgacaaatagagggactcaatgtgaacttattccgtacagaaaagcctaacagtgggctgacgctatatggatctcttgatgacatagtgggccgctaccacgagcgtggacttcgcgttggcgcagttggtccaggtgatcgtcttgctcagcaccggtggagccaacggcggtggctacatggcctccaactacgtcgtgctcgccatctacggcgccatgctcgtcatccacggcgctatcaacagcctcccgatccagtgcctctcttggttcggccagcttggagctttttggaatgcggcaggtaatgaaattatttttttttcctcctcttgcaatcgatctccttattaagtcaccatcgattccatcatcactctattgttcttcgtttgctaggtgtctttgtgctggtggccttgatcccggctgtcgccacggaaagggcgagcgttgagttcattttcactcacttcaacacagaaaacggcatggggatacgcgacaaggcttacattttactcatcgggttgttgatgagccagtacgcgatggccggctacgacacatctgctcatatggtacgttgcgatttcgcccctagacacagtagtccatatctaaactgcaaatactactgacactctgacagtatatcattctatgcatcagacagaggaaacgaagaatgcagattggagtggcccgatcgggatcgtaacctcggttgctctctcgaccgtgttcgggtggatctacatagtgtcactcacgtcggcggtgacggacattccctacctgttgagccccgacaacgacgccggcggcaacgcggttgctcaagctttctacaccactttccaccggagatacggcagcggcctgggagggatcctctgcttgggagtcgtcgctgtcgccgtcttcctctgcggcctcgcctgcatcactagcaactcgaggtcagatcgatcgatcagctgacgtgttcaggaatttagcttagcttaattagctacgtacatgttgataatttcctaggttaattagccactgcatgcaggatggcgtatgcgttctccagggacggagcaatgccgttctcgaaagtctggcaccgagtgaacaagcaagaggtgcctataaacgccgtatggctctctgtggtggtggcgttcatcatggctctgacagtgagttaattcgtaccactgctgattaattttcatgcttgattctcagttcagaataaccagaattatgctttatttttatgacagtcgctgggaagccaggtggcattccaagcaatggtgtccatcgcgacgatagggctctgcatctcctacgcgctgccgatcttcttccgggtgacgacggcgaggggatccttcgttccggggccgtttcaccttggcaagtacgggatcgtcgtcggctgggccgccgtgctctgggtggccgccgtcaccgtgctcttctcgctgccggtggcgtacccggtggcggaggagacgttcaactacacgccggtggccgtcggcggcgtgctgctgctcaccgtcggcgcgtgggctctccgtgcccgcttctggttccaagggcccattactaacactaatgacggcccgctgtgacggcccataactgtatgggccgatgcatgtgtgctacggcccatggagttctacggctgacaaggaagcccacgtacatgtagccttgttgggcggcccagtaagaggccgttctttattttgattcgtattcccatgtccttggatggaaattcaacggtctacgattcggctgattatgttagaaaaagacaggcatgaggtacagaactatactaaaaaagcagcatgcgtgca

SEQ ID NO: 46672 - DNA, 3018 bp, Oryza sativa
caacggctgcgtcgccctgtccatggccgagatctgctcggcgtacccgacctccggtggcctctactactggagcgccaagctggccggcaaggaatgggcgtccctggcttcttgggtcactggctggtacgtgagacatgtatgagctagtctgcatcaatttcccctgtctttatgcactggaactaatccaaaatggttaggtgcaattgttttcttgatatccttgaaaaaaaattgttgtcttgagatggtgccttcttgaagattatgtttgatcattactattttgaatatttgttgctgtggattatgcatgtatgctgttgttcaacttaatttgcgagcctgaatttgttattgtgttgtgtgttcgacaggttcaatatcgttggacaggtatactaccattgtctggtggatctagatactgtttttagctccagcttataacttcatttttcgagaaaaaaatttgcattgttgccctgtccttgtcttcaactgttgtggcagtgggcagctattgcgagcgtagacttctcgctggcgcagctgctacaggtgatcatcttgcttagcacgggaggagccaatggcggcggctacatggcttcaaagtatgtcgtgttggtgatttgcgccgtcatcctaatccttcatggcgtcatcaacagcctccctatccagtggctatctctgtttggccaaatcggggccatctggaatgctgcaggtgcatggtacacatggaggcaataatcaccagtccttatgaattgtggttcttggcatctgaagtctgaatattgaaccctgaacgaaatttatctgtctgaacaatcaacaatgataggtgtctttgttctggtgatcctgatcccggcagtagcaaaggacaggccaagtgttgagttcgtgtttacccatctcaacacggacaacggcatggggatccatagcaaggcttacatcctagccgtgggattgctgatgagccagtactccgtgctcggctacgatacatccgctcacatggtaaacgagtcctctactcctgtcaggctgcagatatctgaatgagcataactgaatatggatagaacacagtgtcacagtgacgagctgatgatgcgtgtatgcaggttgaggagacaaagaatgcagatcggagcgggccaattgggatcatcacgtcggttgtttgcgcgacggtgttcgggtggatctacctgttggctctgacgactgccgtgacggacatcccgtacctgctcagccccggcaacgacgccggcggctacgccatcgcgcaagctctgtacaccgccttccaccggaggttcggcagcggcgctggcgggatcgcctgcctgggagctgtcgccgtcgccatcttcctctgcggcatcgcgtgcgtcaccagcaactcaaggtgacgggctcacatcgcgtcgatcgatctgatgattccacagctagctgttcatcgaatcatcgtgtcgagttggtgatttacatgtcgggtttctgtaggatggcgtatgctttctccagggatggcgcgatgccgttgtcgcgcgtgtggtacagggtgaacaagcacgaggtgcctctcaacgtcgtctggctcgccgtcgccgtggccttcttcatggctctcacggtgagttgcatttgcattcgcattgctgctccggtgattcacggtgagtgcgcgtgatgacgacgccttctctgccttttgccggtgcagtcgctggggagccaggtggcgttccaggcgatgggttcgatcgcgacgctggggatgtacatcgcgtacgcgctgcccgtgttcttccgcgtgacgacggctcggagatcgttcgtgccagggccgttccacctcgggcgatacggggtcgtcgtcggctgggcgggtgtggtgtgggtggccaccgtcacggtgctcttctcgctgccggtggcgtacccggtggccaacaaggagacattcaactacactccggtggccgtcggcggcgtgttattgctcagtgttggtgcgtgggtgctacgtgcccgcttctggttccaagggcccatcacgaatgttgacacgcattgttgacaagtatggtatcgtgttgttagtcagcgagtcagtggaaatatggaaccacacttttatattgtgtaatctatacgtgcaattgtagtcgttcagcagttatccaccattccggttttctttttttatcctttttattttgaaaaaaatgttttttttaaaaaaaacttttttgaacggttgaagagcgcagcaacgtgcgatgcgaggggcctgtctagggaaatttcagtagctgtagcttctgctataatcttcagctgccagaaactccatcaaacaatttagattttcacatatattttgaaaagttgtagttgtagaatctagaaaataaactcgaaatcagaaactgggtttgccagcttctctagattatcactaactgcttataagaagcttaggactctatcgtttctcttattgacggaataagcgaaatgacatatttgcaaacagaaaataatttgtaaataaaacttttatataagtgttcttagcaatataaacaaagtctgaaaaataaactttgatgaaaaaccccaaaatctatctattatattattaagatagctcgaaaagaaggcactacgttcgctgtggaggctagaaattcccatattaatcgaagaaaaagaaaaggagagtccaagtaaaaatacaatctaaaaaataactgaaattcggaattaaaaataagcaatattaaaagaggtgtccatataagaacccaatacgagattaataaaaccattgattacaattctaaattttaacggtctagatttgtaggagaaaagataagtccatagatctgtattgtgtacgttacatactaggagtctttgtcctttctgtttctttagcggtgtacacagtacacgtataatctaattcaatta

SEQ ID NO: 46673 - DNA, 2104 bp, Oryza sativa
tgagaatgttccaccagcttcactcacattttagatgaaattaaaacgttttggctgactctagctcttgccaaacataaccttcattggattcacatttttattggatgcaaatttgaaaacttcaacggtctaagatccggctgattttattagaaaaggacaggcgtggggacaaaaactgtactgaaaaaaaagcatgcatgcacccattcaagcatagtttaacatgaaccgtgattagaagtagtactaacgtgacgtatatatatcctatattttctgagtcaacattggcgtgtaatacgaaaggaaatcgtgacatgggcagatcagtgaatcagtggtacaaaatttccaaccattttgttgactcgcgaatcatacatgacagatacttggactattctctttcggaaacttgactagttacactgagctgtctgagcatgtaaactgcagcatagcgcgactagtgagcaacagaggtgaaagcttcttcccaaggtagaggatctagagatccaggccatgtctcgctccgtccaattggcggtggccgccggcgatcaagtcgatccggacagtctccggcttcaccagctcggctacaagcaggagctcaagcgtggcctctcgtatagacgcatatgcttgcttgtgtttaatttgttcagactagttcttgattagcaattaagcatgcattttggatcttccagtcacaagactcttttcacaactaatctgcgtacagggcactgtccaactttgccttctccttcgccaacatctccgtgatgatgggggtgacgacgacgtacaacaccgggctgcggtacggcgggccggtgtccatgacgttgggatggttggtggtggcggtgttcaactgctgcgtcgccctgtccatggccgagatctgctcggcgtacccgacttccggcgggctatactactggagcgccaagctggccggcaaacaatgggcttccttggcttcctgggtcactggctggtacgtgctaatgcaaaattgtcagatgcaattcttgccttgagatggtgcctacttgaattctgtcttttttttgtgttcgacaggttcaacgttgtgggacaggtacacttgccattgtcaacttggataatcttggggattgttttttttcagttgcagactataattgcatcgtcgttggccttgtacttgtcttcaattgttgtggcagtgggcagctattgcaagcgtagatttctcgttggcgcagctgctacaagtgatcatcttgcttagcacaggaggaggcaatggcggcggttacatggcttccaagtacaccgtgctggcgatttatgccttcatcctaatcttgcatggcatcatcaacagcctccctatcgagtggctatctctgtttggccatgtcggagccatctggaatgctgcaggtacacaatgaagtgagttctatcggttctaggcatctgaattctgaaccctgaatttatctgtctgaaacaatcaacaggtatctttgtgctgacgatcttgattccagcagtagcaaaggacaggccaaatattgagttcgtgtttacccatctcaacacggaaaacggcatggggatccatgacaaggcttacatcctagccgtgggcttgctgatgagccagtactctgttatcggctacgatacatctgctcacatggtaagttaatcctgctgtccctcaggttgcagatatctgaatgagcattgacagacggtagtgtggcagtgattaactgacgatgcatgcaggttgaggagacaaagaatgcagaccggagcggcccaattgggatcatcacctcggttcttttcgcgacggtgtttggttggatttacctgttggctctgacatctgtcgtgacggacatcccgtacctgctcagccccagcaacgacgccggcggctacgccatcgcgcaggctctgtacaccgccttccaccggagatacggcagcggagttggagggatcgtctgcttgggagccgtcgccgtcccgtcttcctctgcggatcgcgtgcgtcaccagcaattcgaggtgcgtgaca

SEQ ID NO: 46674 - DNA, 713 bp, Oryza sativa
gaaaatgctactgtgtttctttaataaacttagtcaaattaaaaaaagtttgactagaaaaaaatcaaaatgaattataatatgaaaaggggagtagtaatattgtggagagtatggttactaagtgtacacacggtctacacatccgattacagataggtggtgagctatatgatataataggccagtgatagagtaggaccggtcgtcatgttgccttctatcctaaggttgtgttcggcactctgtttttccaactctcccctctcgttttcggcgtgtacgtttttcaaactgctaaacagtgtgttttttgcaaaaagtttctatatgaaagttgcttaaaaaatcaaattaatcctttttgaaaaaaatagctaatgcttaattaatcacgcgctaatggaccgctccgttttccgtgcatactgttccggttgggaaccagagatgccgaacatagcctaaaggtagtgtatagagctccaattggagacccgtgtaatagattagaaaaccgaagtcatgtcttcgagagggcttaaatctatctaaaccattgtcttcagtatctatgcaattttaggtctcacgcgctaccatatttattatcaccgatatagaatatggagaaatatatttttagggaaaaaaagtaaaattgggtttcatgctagagataatccattatatgccactaaggctgcaggaat

SEQ ID NO: 46675 - DNA, 29870 bp, Oryza sativa
  unsure (1)..(29870): unsure at all n locations
ctgagccggtttgtttcaaatccgggagatgatcattggcaagctctggaaagggtcatgcgctatctaaagggtacaatgagctatggaattcactatactggttacccaaaagtactggaagggtatagtgactcaaactggatatctgatgctgatgagataaagcacaagtggatatgtgttcacacttggaggtgcgctgtttcctggaagtcttgcaagcagaccatcttaacgaggtcaacaatggaagcagaactcacagcactagatactgccacagttgaggccgagtggcttcgtgaactcctgatggatttgccggtgattgaaaaaccagtgccagctatcctaatgaactgtgataatcaaacagtgattattaaggtgaacagttcgaaggacaacatgaagtcatctaggcatgtaaagagaagactgaaatctgtcagaaagcagaaaaactctggagtgatagcactggactatgtccagacagctaaaaatctggcagatcagtttaccaaggggctaccacgtaatgtgatagacagtgcatcgagggaaatgggcttgagacccacttagagttgcacaatagtggaaacctgtccgttgtgatcggagatcccgtgaatttggatggcgaaacaaactattgtgtaaccgagagaagagacccttaaatgggctcattttcatgatgtacttctcttctattctgtatggtaggatggcttatgcctcaatgtgttccgagtggctttcattaagcagagatgttgacctgcagaacatcttagaaggaacacacctatatgagttcgactgctagtcacaatctatgagatttgggtgatctctagatactcatgaaaggcctggagtatgacttataagctccaacccgagggaatactaacggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaatactggtatataaaagctgctatggaatagagagcattctcatgagccttgaaatttggtggggattgatagatttaattggataattgatccatttaaatcaattaaatcaaataaattccaaggctcattatgctaggaattcatgtgtattcatttttttatgggatatcaatgggatgaagagttttgagaattaatccatttgattagggaattggtaacttatatcaattagttctaattgatggatggttgatggttgtgtagtggaggatggttcatggctagttgatgacaattagttgctctattcctcttcctattccattggtaacttacatcaattactcttaattgattgttggttgatggttgtgtagtggaggatggtttatggctagttgatgataattagttgctctattcctcttcctattccatgactcttactcgtcatcttccattcctcttataaaatgagaatggatttgatctcccgcgagaatagtgagacacactttcatccattttccaacgttgttgctgctacggtaatcccatcccgacgagtgtgtgcacacgtgttgggagagtaggcctccgaaaccacgcgctgctgcgacgtttgcacggacgggcgggcgatcaggtttttggggagcgcaacacgcgactactcactgttcgtcaacatctacttcactttcaccaatatgtcgaacactggagacaacggcaacactggatacaaggagaaggaggctcccgtcaacaccaacggaggcaatactgcctcaaactccagcggaggaccatgcttggggtataaccttcttacattatttcaattagaagttttactgttaatgttcatcgcaatgtcaacattgtgttattatgtgattgttgatgcttattctacattaagcatgctcatgttgattacattcaccactgtcactggatcaaatcccattgtaaatatcatgtttattatcttgttattttggattaaaatataccaaattatgaccaaagttctaacatcgtcctattctaattcactgtattttagaacggatgtagtagtaattatgtaaagttttgaaaagtaagacaaatcgtcgaacgtgcgtgatatcaatcaacgatgttatctgttaaaaaacaaaacgtaggtagtacttttcttccgttggacgtacaaccagcacgaggcgccgtgcattgacattgcgttttctcgatcgccgcctcggcgtctcgtgatcgtgagctcatccaatccgccgcgtgatcggcgatcgcggcgaggcggcaatccatgtttctgttccgtccacggacacaaggaatttttcccaaggtcaccgcggccgtacgagagctagttgtcagcacagtgatcgtcatgtcgcatgtccttcccctgattataatacagcaacttaatgccggtttatctgttctaacagtcactgatgagtgatgaagcagctgtttgtgattagatctgtctgtcctttttcggttgaacgtttgtagccaattggtttctataaacagaaaagtggtcgtcctgcattgagaaaaaaagaacaaatgaacttaagacattatcaattacaaataattaatcttaactactactccacagtgttgtcttatcactatcaactttatattctgcataatcaacacttgctcgagaagtcggcactcggcagagatggttgtgctctacattcatcttctccatttctcttttgtttatttgtttttgaattggtgatataaatccgtgcaagattcaagagccaagacagtttttattttttgctactctgacatgaattggtaattttatataggctttatctcagagcaaaagttcattgagactttcagacgcagtagtaacagtaacagaacttgctagtcacaggaaacagaggggcaaatgggctcggctcgtgatattgcttgtcaatttcttctctcattcaaaatcagaatccaaaaggatacgtctattttgcctcccttattttcttgcgcaatcattacccacaacctcaaaactggatataatgtctcccccattttcattggatggtttgggggagcggtttctgataacatgcaggtgttttaatcagaagtaggacaggagggatgacaaatagacttattccaatccagaagtaggaagctataattattgggcttaaatcagcaagcaggccgagccgcacacactaacaagccacaaagccccaaaaaacccaatggaaatatcgcaaccttgggagccggaggtttatccccaccacgaacgcctcctcttcttcttccgatgcggggaggctgagctcgcaatccccaaagctcgcggagatggacgccaagctgctcctcctccccttcccctcgccgccggccactctccaccaccacccgccgccccccaaatccctcttcctcggcgcctccctcccgctcctccacccgccgccgccgctgcggctgctgcggcccggcgccccgcggcggctggcggtggtggcgcaggccgccgtgaagcggcgcaaggagatcccgttcgacaacgtcatccagcgcgacaagaagctcaagctggtgctcaagctccgcaacatcctcgtctccaacccggaccgcgtcatgagcctccgcgacctcggccgcttccgccgcgacctcggcctcacccgcaagcgccgcctcatcgcgctcctcaagcggttcccgggtgtcttcgaggtcgtcgaggagggcgtctactcgctcaggttccgccttaccccggccgccgagcgcctctacctcgacgagctccacctcaagaatgagtccgagggcctagccgtcaccaagctccgcaagctcctcatgatgtcgcaggacaagcgcatcctcattgagaagattgcgcacctcaagaacgatcttggactcccgccggagttccgcgacactatctgcctcaggtacccacagtacttccgcgtcgtccagatggaccgagggccagggctggagctcactcattgggaccctgaattggcggtgtcggcagcggaggttgccgaggaggagaatcgagcgagggaagaacaagagaggaatctgatcattgaccggccactcaagtttaatcgggtgaagctaccacaggggctgaaattatcaagaggggaggcgcgcagggttgcgcaattcaaggaaatgccatacatttcgccgtactctgacttctcgcatctgcgatccgggtcggctgagaaggagaagcatgcttgcggcgtagttcatgagattttgagcctgacacttgagaagcgcacgctggtggatcatctgacacacttccgggaggaattccggttctcgcaatctctgcgtggtatgctaattcgccacccagacatgttttacgtgtcgcttaagggggacagggactcggtcttcctccgtgaggcatacaagaactcccagttggtcgagaagagcaaactcgtgctgcttaaggagaagatgagggctcttgttgcagtcccacgcttccctagaaggggtgtgccggcaactagtgaggaggctgatagaaccaatggagctgcgcaaatgctgagtgaaggaagcgatgtagaagatgatgaagacgagggattgtcggatatggaagacttaattagtgagatttctggtggcaaatctgacacagactaccactggggagatggctgggttggcgagaatgatgactcgccaccagacttcgaagacgatgatggctcaagtcttaaagaagtcaaggtgactatgaagaaaactgctaattctgccaatggcaaggcacatgttcctgtttttcctgatggcagaccaagggaacgatggtaaaatgatctattttagattgtttggtagagtgtgtaatctttgttgttagttatttcatcatatctagaaagtcgcaaaaccctcagtcctttgaggtgctgcttgaattttgttaccgagcacatgaatagcatatcagaatttgaacagttcacatgaatcatcactaatatagtgaacgaatttgaagttgtgggggtttgtgatcaagcatacttggtgatataaataggtgcaaactgtaacaacttaagtataaatacaagcttaatttgagctatgttagcaatggacttctcttaagaaacagaatgaggtgatgttcctacaaagtaaaatatagtgttagtttgagtgatcacgcaacacgttataacttgttctctttcttttttttttttttttgcaaaacaattcataacttccaaatgtttctgaatcatccttctggtttggaaatttattacctcctagcaattgtagttagtgctaaaggggacatcatcattagctctccatgaatcggtgcttgtaaagagtatgtcccatcttttcaaatgaactcctatggagggaagaaattcaagccactggagtaatggaatgccctctcagaacaaggattgcttggtaaaaactagggaacacaaggcatatcgcttgctgtctgctagattggcattttaaaatggtcagtttgatgaccgaagctgaatttgaggaatgatgtccatttttacgactatgcaacatgttctctgttaccttatctgtctgaattgccaagtttcagaagtattcgacgcttaaacatctgcattcccagtccttgtatattcagaagtttgagttgtcagctatacttgatgtgctcctttggttttgtttttcacatcagtcacaggaaggttcaggatggaatactcggttcattgactactactttgttgttgatgatgatgatgatgagatattgagttctgttattctgtacgtttggtttatatttgcatctttgtgtaacattgagaagctggtgcagtggtgcataagcatcatactgcaccctgtcagtctcatttcacaaaattttgttattcagtcatgggctcatggcctacttccgctccttcgtcgacttcgcagggtcccacactgactcaacaaaattgaccgtagtcaaagcaccacgtcggatcaaacgggagctatactgccttgggacgtaagttgatatggttttgaaacttcggggacgcactatatctggactggcggttcaagggtaaacttgccgacaaattgagggatctgaagtgaccttattacttttggacgcgaggtgcacgtctctccatattgcgcgaccagagtgggcccaccaaggttcgcttctggaatggatcaagtcggcccatgcgaatttggcgctaccgcagcgatccaactcggcgatactgcaactaactacacgtgtcgtatcggctacacgaggcattatgttgggacgaaagctcatccatgcagaactgttcgatggagacgatgccggtcccggcgccgcgtaccgatgaatttcaccgttggttaccacgtatgcatcaatgatctgtgtgtgcgacagagaaggggggtggggggcggaggaggagaggaaaagagggaatatagacttatccagagaaaataaaggaaatagaaagtagggtaaaacctttttcatacccactctatttatttttatgacgccattaattttttaagtatatgtttgatcattcgtcttattcaacaactttatgcaaatgtataagttataaatcaagcttaaattactttgactgataaaacagctcacaacaaaataagttataattatgtaatttttattaataagacaaatggtatgtgataaaaaaatcaacgccgtcatctattaaatcagaggtagtagtttggagtgtaaaacgagctaaaaaaattatttagaaggtttaaggaataaaatgaaacttttttgtttagaaattcccaaggactcctcgtgccgcacggccaccagattcagagacgcacggccgccggatacagacggcgagccctttcgtcgtggacgtgtcgcgcgggacgggataacatacgatcgtgggaaccagcgggaatgcagcgttgcaggccgctgcaggcggcggacaagtcaaccggtcaagcactcgcgggatcgcgtcgccgtcatgcgacgcaccagaggcgaacagcgtacggacttatattttctcgcgtgaattttctgattttaaatcgagtttttttatcctagtttattttttagcttttatttctagattgtttagaacacctatataaaagttctattccattgagcagccaaaggatggggctgttagcctttgcggtcaaagcgtcaaacaagcacaggtgaataaaataacttccctagctagctatttgagcgatactccagtttccactccacttaaaggaaggaaatatcaacggcaacctttgtttctgcccctttttttcagtccaaaaaagcgatagatcgagcatgcaccagcaccagctcggctaatggctatgcctacaatatctatgccgctatgatgtaaaaagcgaggaagcttgactgaagcttctgtctggagagagagaaacttcggtgaaaagatgcatcaaacattggctcattttcagaccagagggtgggattttcggcctcacgtgaaacggtattgtttattagctgataagtaaggccccgtttagttccaaagtttttttccaaactttcaactttccatcacatcaaatctttcattcacacacaacttttctatcacatcatatcaatttcaaccaaacttccaaacttcagtgtgaactaagcacaacctaaataagtattaactactactccctccgtctctaaatatttaacgttattgacttttttaatgtcttatttaaaaaaattaagtaattattaattcttttcctatcatttgatttagtgttaaatatacttgtatgtatacatatagttttacatattccacaaaaggttttaaataagacgaacggtcaaacatgtttaaaaaagtcaaaagcatcaagtatgggacggagaagggagtataattttgaaaacatgatttatttgattcttttaagaaacctctacgtataatttttttcacaaaatatatcgtttaacagttcacgtcatgatttagagttgtagtttaaaactcagccaggtatgtgcgtgtggctctgcaactataggatccagtagggtagagtgatcgcttcaaagtaggaaatgtgatcccaaaaaggcatgtgttttttatgaactgaactgttgggttgccgaggagaaaaaaaatggaaaattccactactcaattgggagaatctagggcaaaaagaaaacacatcacctttcctgggtacctgtcgcttttgcattggctgcttggagattattaaagccatgctcttttagcttatttatcgaatcatttaaaacggattatttgctacacgttttgaaaaatattttccacaaacaatattcttttgatgcactacttatactgcttgtttaaaactatttgtcacatttatctcataatttatatctgcaattaagttaatagcgttttacagtaattcatttaataatctaaattgaatggggcctaccattcaattagtagtaagggcatgaacggtgtttattagtggtctctctattgccatgcaagtaaatttaatgacatggaagaaagagaaatgagtatggttagctcagagtcgacttttaggatttattagagcaaattttattgcatgatggtgaaagaaagaaaaaaagtaagaaaaaagtattttgatacattaatgattaaagaccatattatctctaattgttgtagcatatagtctctagataacgtagagctcatatcttaccctacctttgtagttgccctaggaccacaagctgccgatgacgcaagtgaatccatctctgctgaccagtctactgacgtggcgcacagactgagaccgacactggtcgttttcactcgacatgcttgaccgtccgcacgagcgctttgcttccaatacaccttttctactagtagtactaataattagtgttagtataaatcaccaaaattagtactactaagtactaatactaacagtagctttaggatgagtggcaataattaattaacctgatctcgtggtttagtcagcctggtactgcacaaggagtggactagaccactgaatcgcacaaatgctattcgtccggtgattcgattcggtcagtcgcttgatcgcactgcacgtacatgcttgcattgccgagtcaaatttaacatgatctacttctaaccaggccactgcataattgaacgtgacaatacaatgtactccagtgttttacaaatctagtacaaatcctgctgaattagcgctgtagacggtggtgcctactacaaacgaagacgaaaacgtcaggacaattcttacacactattgaagaaaattttcttgtctgaaaggttcatgtgcagcagtagctcccagccaaaatatcaagaatttgatcacacatgcacttttccgcccatatgtcttgttaagtttttttttccctcatttggaatgcagaaatcaaatttcgtaggaattgcagcagtagttcacttgctgtctgaaagataactttcatggtgtctcggataaacacacgagtgcgttgctgcgctataatactgtactaacaataattgtccacaaactatacgcaagaccagaccaacactacaaacatggtccagtgacagaaaaggtgattaaaaccttattaaggaccacttagctaaactataggaggagaagtgaactgaggaagaagccgagcaaccgcaagccgccttccaacctcctccctcccgacacatagccacctgcacatctccacactacgtgcaccccattttcccatgagaatttcaacgaatcaacacagtactatcccaaagtcctattttagcgaatgcggtatcccaaagtcctaaagaaatacaacaatcaggctggcaagaaagaacactgtgccaagctaattcactgtccaagctgataatacttatcattttgaaaaaaacacagtctttaaaaaataattttgaccatttttttattataatataaaaatatcaataaatatcctattccagtgaagcatttttaacacttgttcaaaacaacaactagtattatcaacccgcatgaagtagcaagaatcctatgatcaatactaaataatattccttcgttctaaaatataacaaccttagtggtcctattcgaatctaccgtaagaatgaagattaagtgtgcgcgcaaaacgagataagtcattagcatatgattaattaaattttaattattaaaatcttaaaaatggatttattagaatttttatagtaacttttatatagaaagttttcaaacacaccgtttagtttgaaaaacgtgctaacggaaaccgagaaaaaaatgtatcttaattaatttagaacggggccattattagattagatataatactaagacgaatttggacaagggatcagtacagcgtccaacacacatagttgtcagttgagcaatgcgcagctgcacaagtgtgtccgtctgtggtaggttgagagttgagaccattctattctaacaaatggtcagtcagacacaagttttttttttccgaacggtcagtcagacagacagaagtagtgattagattagagctggattagtctctgcacatctccatgatggccaagaaaccaaaagaccggtccaagtgtttgaatgacactcgggtagtgatattctctgcttagtcataatcttttccctcggtccggtcaaagtttggatctgaacatgacgcaacgaatcacattttgctccctataaatactcctctccctgtcactaccacactcgccatcctacctcacacgctctcaccaacacaagaaaccacacgcttacgagacgccacggcggcggcggcggcgatggtggagctctgcggcggcgagggggaggggcagatcatgctggcgacggagctggcccagctgcgggccatggcgagggagctggaggcgaagatggacccggacagggtggccgcgcgggagctctgcagggcgctggcgtcgtccgtcgaccggtccatccgcctcgccgcgtcctgcttcccgccgccggagcacccgccccccgccgccggcaatgccggcagggacgccgcgttcaagaagaggcaagtcatggttcccggtcatggtggtttaatttcagggttgagagatcgccggagcaacgctctgacatgtgtttcgatgcaggaaggggatggccaaggtgaggaggcaggtgagggtgacgtcggtgcaggacacggcgtcgctggacgacggcctgagctggaggaagtacggccagaaggacattcttggcgccaaatacccgaggtcagcatcgacgtcagcaaatcatccattgatgacgtcactctcaccttccgctaattaaaaaccaatcaatggccgccgccgccgccgccgccgttgttgtgacacgagcttgatctctgctgcagggcctacttcaggtgcactcaccggcacacgcagggatgcaacgcgaccaagcaggtgcagcgcgccgacggcgacccgctgctcttcgacgtcgtctaccttggcgaccacacctgcggccaggccgccgtcgccgccgccgcccagagcgcgccgcccgagcatgccggccaggagcagcagaggcagagctcgctgctcgctgcgggaacggaaggaattcatcagcaggtagtggcagagcctatggcggcgccgttcttgttcacctcgacggcggccggcggcgtcgacgacggctacttctccttcatctcgccggcgaactccgactgccagttcagcagcgacttctcggcgggcagcgtcggggttgacatggaccacgaggctcgtttcgaagatcttttctcgagcactcttgagtttttccaatcggagattcagaatctgtaggtggccgaatgcacgcagtaaccgtactttgttaaaggttcgcatcagtattagctactggcctactccatactactctgtacagcctctatgctttttccttatgaatgaatctactattagttgctaattgttcttttccatctccggaaagaccctttttttttctgacaacctgaacctgcatcatccttaattccttgttcatgtccaacatactctgaacttgtgtgattttctgaagatgttgacttcaaagcctgaatatatacaactacagtagccaatcaaggtaagccagggcatccgaataaaaattatgggaaacgttttcgaataaaatgctcatgttactgcaagtaatgacagtttcagtaaattgaacactgggctgtgtttagttcctgaaatttgggagaagtttggagaaaattggtagtttgaaaaaaaattttaggagtttatgtgtataggaaagtttagaatgtgatgtgatggaaagttgggagttgggagaaagtttgacgtgaactaaacacaccccaggtaaatagagagcagatcgattaattaggaaatgctcacggggagtgcgacgttctgacctgtggtatatgatatgacattagattagtattaaaacattaggcaatgatctcgttcattaggtgaggttttctcccatctttgaatatttatatatactttctttatcatacctactggtaagactggtacatgaacaacaacaatgtacacaactccaccaatcaaaatgtacaatcatgttattctttttcttctcaatgaaattnnnnnnnnnnnnnnnnnnnnnnnnaaaaaaaaagaaaactcacacaaaatcgatatcatcatcagagtcaccttcttcctcgtcggtgccttcatcgctattgcgataaatgaattcctcttctaacccggacaaaatattcactttgaggctattaacgataccatcgttggtgtaaaacggttcctcatcaatttctggatcaaattcgtctccgcaggtatcttctccacataccatcttctcaaaatccacctcacgcccatggaaattttctatcgacggatgcataatcccaaccccttcatgttcgcagtaaaggcaacgcacttgttctagtagagaaaagaaaaaaaaacacaaatagaatttcttcagttctgcagaaggggaaaagctaaagagaaaattcagatttgtacatacctgagcatggtggcgatatggttactgggcagcaaatgccgtcgtggttgaggcgatagttaccgcattctgcaaagaagagttgaagagctccctcgccggcaatggcagatggatcggagtctctccggcgagccaagaaattgacatgacaacgaaagtatatcagaggagtataactgacgatgtcatcgtcagtgcaatacacgggtcctgatacgcaattgttcatgccacagatgacatggagctcgtaaccaccgggttcctgaaatcccagcaaaaacaatagagatgtttaattacaaagatttgttacagtcaaacaaaaagtacttttaagatactgataacttacgataccaaataattttcaattgttggatctaacaatgaacatcatgtccagttaaatcaaacgatacgaggatctaacaatgaacatcatgtccagttaaatcaaacgatacgaaacgatttgatactgtaaggtactagtacctcgagttactttttgctggaccggagcaaatctcttaatcatattatagcaataataattgttcatcaagaaagaaagaatcaggttaagatgttgaattacgttgttctgcaacgcgtatctgtccaatgcagccttcaccttcctgcagatcttgttctgatcacggatgatctgcgccttcagtttgagctgtcttcgccgccgtggtttcgttggtttgcgctgcattggcgagacggcggcggagggagttggaggcagtaaggcggcggcgaggcggcgaacgtcttccgaggagagctggccgccgttctgcaggagcagcggcgtcgtcatggctctgctagagctgaggaactccacttgttcgtccggtttggggtgccgggccgccgcggcggcggcggcgtaggactcctggatagtgcaggagggacggtgctgccgccgatctgcttctcttgcggcggcgttgaggtcgccgtcgaagtcgagcaaacaccggatggcgtcatggaggccgaggttggggtagcgggtgcagaggaaggagacgaggccgaggaaggaacgcgtggcgatgctggacatgctcttgggcgggatcatggccagctcgagctcttccaccggcgggtgcgcggcgtcgtaccagacgacgttgaggatgatgttggagacggggtccatggggccgtagcaatggccggccttcaccaggctccggtggtagtgagaccgcagctcgccggagggcagccgggcgagcgcccggaggtagaacccctggatcgcgtagaggagcgtcctctggagaggcatggcgtgccggtaaggcggcgcggcgatgccgttgtcccggccgagaaatcgggacgctgccagctcccacgccctctccatgttggccgccgccggcgcctccgcctcgtcgacgaccagcgcgacgaggccgcgcacgtcgtggttggcgagcgcggacacggcctcgtcgaggcggcgagacagggacagccacgcgtggacgagccggtcgggatgcggatgcttcacggccagcgcggcgcatctgagggccaaccttacggcggcgccggcggtgtccgaggcgaacccgaatctcctcagtccacggtcccgcacgacgaggcgcgccgcgacgaggacgtcagcgtcggcgtcgagcaggtagcgcacggcctcccagtccgggaggtgagggaagaacgtggtgaggaaggtgaccgcgccgtcgagagatcgccccgtcctgtcgttcccatcttccgcttcggcgaagacggcggcgttgacgatggcgttggagacgggatccagcaagccgaagcagaggccggcgtcgaggtccgccgccggccgcagccgttccagcgcctccgcgtgggaggcacgaaccttgtcaaggagcaacgatctgttcttgtcttgcgtcctggaagacggcgtgcgactccggcaatcccttgacatgatgacgcggcggtggcgggcgtcgtcgtctatgtccatggcggctgcacggcgcacgcaaagatgcgatgagcgtgcgtgttggctcgtttaggttttgtttgttatacaccccgatccttcctgacttttatccgaatcggctcctcgcacaagtggcattgtcaaatctttgaagtttttgggatttgctcttgctgcgtttgatttttgcactggcttacaggttttgacacgaaaaggattgattctcttacagttcatactccctgtcacataaaaaaaaacaagatagaactgatgcgagacacatcctaatactacgaatctaaacagactgtactataatatgtcatatctaattctagattcgtatctaattctagattcgtggtttatgggaccgagggagtctgttctatttcttaatatgttcagactagagatagcaacgggaattcctggctggagatttacaccaccagacccgcctccacggaggagatggcaacggggaattcctagtcggaggttacaccaccagacctgcctccacggagaagaattttctccatcaccatcaccgtgaaatgcaaacggggcaagatctttcaccatcaccacctccgtgcaggtaatttatctccgtggagcctccatccccgcgagtggtgaagacgaagccatggccgcatctagcgattggtcgtcgttttcccctttgacctggtggggcggcaccgggacgtggcggcacggcgagccaacggccctgcgcgtgcgcaacgggacctgacggtgcgggcgcgccgggacgtgacagcgcgggcgcggcgagccggcggccctgcgcgggcgagggcgtggcgagtcggcaaccctgcacgggtgccgacgcggcagacgcacggtggccttgcgagatcgggagtcggcgccggcgtggggactagggatggaacacagaagggagaaaggattggaatggctagggttttgcagatgctttatatgctctaggtgttgggcctggtttctatgggccagatgggccaaatatacatgataatactacacatacactattatgtcgggcctccacggagagcggggacgagggacgctgaaacaaacctgcccctgccagacccgatggaaggtgtttttactctatttaatcctctgtggagacatattttataccacccccaccttctaatgggaggattcaccgcagggaatcggaggacggggaaccattgccatctcttgcttagacccttcttgaactggaatatcctacgtcaaatagtcaatcaagaaaataaaacaaaattccaaaaaataggtaggagtagttcgcctacggttcggaaaactttggcccagtggaactaaactctccctaaacatgccggtataagggctgaacatgaacattgaacatgtacacagctccatcaatcaaaatatacagtcatgtaaacctcacacaaaatcgatatcatcatcagagtttccttcttcctcgtcggtgccttcatcgctatctcgataaatgaagtcctcttcgaaccatccatagcacctgcatactcgaggttgttgacgataccatcgttggtgtaaaacggttcttcatcaactaaaagatcaaaatcgtcttcacagggatcttttccacataccatcttctcaaattccacctcacgcccatggaaattctccaccgatggatgcacaatcctaatcccttgatgctcgcagtaaaggcaacgcacttgttctagcagaggaaaaagtaaacacaaataaaatttgctcaatttttttgaaatataaatttcttcatatatgcaaagtgaaaaaagactaacacaagtactctatctggatttataatattcatcgttttggacaaggctaagatcgaacttcaaaatatttaactatgaataatttctaaaatatttattttgcaaatatagagaccataaatatagattagtcttaaaagttactttaataaaatcatatactcgtttgatatttctactacaaaatagtggttaaagttgtttttttgaaaaccgtgcccttattcaacatgattagtattagagcaggtacaatagcagactattagccagctacaaacatattttaataagataaaagatgagagagaatagcagtgggctacatatctgtagccagttacagcacggactccaagacgcaatgtgtgtatgacaggtgggaccatatactaatagtacagtaatcaattattatatgaattggctatagatgaattagagctagtaaaacttgctcttatcaaccggagtccggagggagtattatatacctgagcatggtagcgatatggttacagggcagcaaatgccgtcatggttgaggcgatagttaccgcattctgcaaagaagagttgaagagctccatcgccggcaatggcagatggatcagagtgtctccggcgagccaagaagttgacatgacaacgaaagtatatgagaggtgtataactgacgatgtcatcgtcagtgcaatacacgggtcctgatacgagattgttcatgccacagatgacatggagctcgtatccaccgggttcctgaaatcccagcaaacagcagagattaattgattaattatgcaaattgtgttcatcattagcaatggaatagtagtcgagcaagaaagaatcaggttaagatgtttacgttgttttgcagcgagtatctgtgcaatgcagccttccccttcttgcagattttgttctgatcacggatgaactgcgactgcagtttcagcttcccgcgctgccgtggtttcgttggtttgcgctgcgttggtgagacggcggcggagggattcggggacagtaagccggcggcgaggcggcgaacgtcttccgaggagagctggccgccgttctgcaggagcagcgacgtcgtcgtcgtcgtcgtgatggccctgctcgagctgaggagctccacttgttcgtccggtttggggtgccgggccgcggcagcggcggcggcgtaggcctcctggacagtgcaggagggacggtgctgccgccgctcggcttctcttgcggcggcgccaaggtcgccgtccgcggcaagcaaacaccaaatggcgtcatggagcgggaggtcggggtagcgggtgcagaggaaggagacgaggccgaggaacgaacgcgtggcgacgcggaacatgctcatgggcgggatcatggccagctcgagctcctccgccggcgggtgcgcggcgtcgtaccagacgacgttgaggatgatgttggagacggggtccatggggccgtagcaatggccggccagcaccaagctccggtggtagcgagaccgcagctcgccggagggcagccgggcgagcgcccggaggtagaacccctggatcgcgtggaggagcgccatctggagaggcatggcgtgccagtaatgccgcgcggcgatgccccggccgcgcaagcgagactctgccagctcccacgctctctccatgtcggccgccggcgcgggcgcctcgtcgccgaccagcgcgacgaggccgcgcacgtcgcggttggcgagcgcggacacggcctcgtcgaggcggcgagacagggacatccacgcgtggacgagccggtcgggatgcggatgcttcacggccagcgcggcgcatctgagggccaacctgacggcggcggcggtggtgcccgaggtgaacccgaatcttctcaggccacgggcctgcacgacgaggcgcgccgcgacgagcacgtcggcgtcggcgaggagcaggtagtacacggcctcccattcggggaggtaagggaagaagctggtcaggaaggtcaccgatccgtcgagagatcgccggcgtctcgatctcctgcgtctgcgcgtcctccgccgcgcccttctcatcttccggtttctcggggcggcggtgaggacggcgttgacgatgacattggagacgggatccagcaagccgaagcagaggccggcgtcgaggtccgccgccacggccgccggccgcagccgctccagcgcctcctcgtgggaggcacggaccttgtcaaggagcagcgaccggtgcttgtcctgcgtcgtcgaagcaagcgtgcggctccgacagtctcttggctcgatgacgcggcggcggcggtggccaccgccgtcgtccatggcggcagcaatgacggcgctggactgcggctgcatgcaaaacgcgcgtatcggcctaggtctaggttgttacacaatacaccctaccgatgccgataagaattgcaattgttgctgccccggattcagaacggaatcccgataattataagtcttttgacttctttatcagtcaaagtcaaagtgcaataggtttgatcaagtttatggaaaaaaattagcaatacctacaacaccatattagtctcattaaatttaacatcgaatatatcttaatacaaaatttatcatgtattgaaaatgttactatattttgttagaaacttggtcaaactttaaaatatttaactaaacaaaagtgaaatgacttataatatgaaacggaggcagtatttaggttaaaggcactggaacaacatactgcatatagatttgtcttataaagtagaatactaaaaactaaaaaaaatatttattgaatatgttatggtagaaaaatgtagttaaaatatattttggagaaccaaagagaatatttggaaattggaagtcttcgagggtttagcatatgcacagagcaaatcttcgagggttcttaatttcttacagtacagcgcacccttacacaagatttttagcagaagaaatatacattctacatcactacatgggacttcagctgtgctgataaaaatataaaacaaagtaactagatagaacctttttctttaatgtcctgggattcttcagaagcgctctcttttgtgtcctccaatttcctcaaggctccccttaaccccaacacgatgaataaattggtaagagtaagtagtgattctgcactcccgtgcagccagtcgacgttagacagcgaggttccataatgaacttttgctgcaaaaggttatatcaacaagacagttagtactactgactaaatatggggcagagtatgtgagaacaacaaaaattcacaactcgattaccatatatcccagcaggtactgctccagggataaaaggccagtgcatgaaacaacaggaaaggaattaatcatagggataaaatttcccggcacctagctaaaagaacagaaatcaaacatttttgaaagaaaatagggattataggggtgtgtgctaaaggatgatcaccaagtacaaacatttcagtatcaataagtctgcaaagcaggatcaacatagaatgccatccacttgattcgcttttgtgtattctgcctaatccattgtccttattgtgccactttatgctagataaccaaatcagcagtgaacttgatttgaattaaaccacatgaaaaagtcatttcgtgattattcttctcatcgtagtaatttgttgacagattgttcggatagaggctaactgtcatccagaatgactaagctgacagaagatcaattgccatagttcgttggatatccatatagtttaatcaacatgaaaatagaattaaaagtcactaactatgtaatatattatatatgcatccacatagcattgcatttatgcccctaaatctatgtcaggccttacaatgttgctgtgatcaatctaaagagcacctatttttttagaacaaagagcattgtgtttccacacctaaacctatatcttgtcttacaatgttttaacatttacagaccatctatagcctaactgtcaaggttaccatcacttctatcaaaaaggtagcagtcacaacatcacatgcatattcatacccatatgccacttccttgtatttttttcccaaccatactcaacacatttccgccaattacatgagcaatttgagactagagagtctatctatgaagtattattagcttacatatgcatcatctctgcagacaaggaagtattgacattccaaaacattccacaaaatttttaatacgtactactaagaatcagtgatccagggaaaaaatccccaacatatcatgttcagaaaaagctacatctacgtgaacggattaaacacaaacttttgcatcaccgttactttcacgggtcctatcaaggtgttattaccaaactcaagtttgacatgtatttgtcccgaaaatttcaacggcatacgtcggcacaataaaggatacagagtgacactcgaagcgagagagaagaagacgcgtactggtggcgccgacgaaggcgaggaggaagtagaatccgaagagcgtgagtcccggcgccgtcttggacctggtcatgaagtagaggaagccgaggtaggggaagagcgagacggcgaacagctgcgacgccacgctctgggagtccatggtgggcgcccacgggtccacggggagcagcccgcaccgcaccaccatcccgcgcgccgccgccgctctcctcttcaccccgcgagcgcggccgaggccatagcctcccctggctctaccggcggcgagcggccgcggccacgggcacggcggcgcgcggcaggtggtcggcagcatttgggcgtggcgaatttctccactcggtttgggtggttcgcgttcacctcgtggggatgaggctcttaactgggccgggccgtcaatgcaagagccatcggcccataagaaaatcaagttattttgggccgcatgggctcatccttaccattcatctgggccacagctggaaaggtttcttcagagaatcaagtgaacaagcataatatgaattttatattggttaaagtaaaaaaaaatgttactagttattggccaatcttccaagaaatgggaaaaaataaatttacatgaaattgtgttcggtatttttttttgcgaggaaatagtattgaatttagatcgagcgcttaaaactttttatctgtcgtttaatctcgaggagctagcttgacagagcaacatgaatcttgagttcttgaccactagctagtcctgagtcacccaacgtcctataaaaaagaatcatatgcatcgcaagtaaaacggtactaattaattaatcatttaattatatgctagaaggagtagataataggttgagtaggaagtgattccccgcgcattgctatgaaaattactaagtaatttttaatatattttttcgacaatcaaactagactaaaaaagaaagaaaataatgaaacgcgagaattaatcagtacttatcataaaacaaacaaatatacaccagtacaaagtttctatagattagtataaagtgtatatacattagtacacagtttttatagattagaagaaagctttttctatacaggtgtaaaattttgcatgtacatacttttgtgtatatacatgtatacatacatataaatatagacccatgaaagtatatatatgtatagggagagacgtggccgaaattttcacatctaagcacatgcaatcttctaattccaaatatgagaaggtaatggatgaaattctaattttaatcaagaagcccacatgtgtgtgcagtggtcttccatcggacttaacgtcaaacgaaatataacaaactaatggctgcttatcattggagaaatcactagctgtagcaacttgtttaggtctaattgattgtttgttgtcggaaaagaaaatcttattaccatttgcaattggttggatcaaccattacgagatagggcaccgtgccgtcgtgccgttagtctcgagctttctttgtctttttttttcttaatccatatttgatcacttggatgttttcgttttgaaaattggaactgtagcggtcggttgaaatataatcatctgcttggatcatgaaaatcattgacaaatcttaatttgtttcacatagaagctgcatcaacaaagggtaattataatactagcgaaacatgttaatggatcatttgctttgtggctgctagctagtttgattagaaacagaattcagggcaatacatgctcacatttggaattaggaggtcgcatgtgattaagattaaaaaaaatcgggagacgtggggctgggggaatcggtcgcgcggggactcctctgtcaccagtcgtgccccctcctggtcactgacaaggaaaaaaaaaaagagtaaaattagctatgttgggaatcacttggtgtaacactctagtccaaatagaatttggcatatgtgcgcatgtttagtaccaccttactagttagggtggaaccaacttataagttttccttcctccaactatataactttcgagttaacctttttacatgaaacgatgacgaaagtataagcgaaaccgtgtgggtaagtgggcccgcccatctaatgacgcgagcttgtctacttgtctagtttgtggtgaccacgaaatttccccttgatttccattcctttacctccccttagttttcttcattcaatcgataaatctgaattgaaatctccaaattttcaaattgtattcaatttcccttctcagaaaactatcaaggaataagttcaccggaggaccctcaacttaacagcgagatttttggatgtcctttaaccgcaaaatcagaaatcttcacccctaaactatacaaaaccgtccaatttaggtcccatgacagtatatatgcctagtttcgctgacgtggcatccgagtcagcaaaaaaaaaataaaaaaatatgtgggtcccatatgtaagtgaaatgagatagaaaatgtgggggccacttctcttcttctctcttctctctttttttcttctcttcagctcctctcccagggaggctgccgctggtggcagatgggggcgaggcgagccggcgagcctggccgagctccgccgccgccgccgctgcactcacggacacgcgctcacccgctattgtttcctttgccccctgcgttgtcgcttcccctgccccctgcgcccccgctcccgacggcgaagaggcagttccgggcaatggcggatctagaaatttttttcagcctgagcaagtctaatgagatataggcatacatataaaattcatacatgtacatatgtactccctccatccatagaagttagatatattttacatttgagtttttccaaataagttgttcctatttatagtctttatgcatttaagacttaaatgaagagataaattaaatgtttgatgataacccaaggagtcatctaaatactcattttctgcatgcttacattcactccttgattttacaatatataaaatgatttagtttctccttggtcttggtgacaaaagtaatatgtgtaacttttatggacggagagagtactatatatatgatttaatctataatttagtagaataaactcaacgtaaaaggttatatcgattaacgtagcatgcatgggagactagtatattcttgcattagccttaattactttgctaattgacttgttaattaagcaggtacgtgctagtgcagctggtggagccggggcacttgcccgaggtggccaggccgcccctggtcccggggacgttgctcgaggacaagtagcaccgccacctcgaccagatctgggagcgtcccactgccacgacagcggaagtggctggaggaggagtggagcgcggcgggtggagtagaccggcagagcggcggcggcggcggcggcttgactagccagaagttgaggatgcggcggctagtgaggtcgaggcgggacaaggggagggggaagtggagagggggttggagaagagaaggggaggcgctcgccctaaatctcgacagtgccatcggcggtgagcacggagtccacgtaggaagtgtagtttgcctcggcctcgatgaaccacaccccttcgctggtgctgtcgatctcaggctccctgatgatcggcttcatgatgcggctgacgacagggtagtggtggacgaccgatgcggcctggtcctcgacggcttcggcggagacggaggggaatacctggatgaagtcaacgaagatgcagacggcgacgatcttgtcgttgttgtcgatggaggatagcgggagggagctgcctagggtaggctccgcagtgggcatcagcgccgcgtcccccccaacagccggtgccgagtcactgtctcctcctcgccgtccctagtcaacgtcttgtcattgccgccccaaactcgtcgttgcagcgggtcacgaccccactccacctcctcaccaccatggatgcaacagccgctaccaccacatagcctgtgccacctcctctccccctttctcgccggtgcgtccagatggctctctcgcctgtcctcctctaccaccggcgtgttgtcaaccccccctcctgccgctgcatgggaagaagatagagatgttgatggggctgatacatgggccccatatatctttttttatttttattttggtgactaagatgccacattagtgaaatcaggcatctatactatcataggatataaattggacggtttttcatgtttagagggtgaagatttctggtgttgtggttaagggacgccaacaaatctcgctgttaagttaagggacccccggtgaacttattccaattatcaaactccgctgctcaaccaggccgcctccctctcttttcggcccaacctcccggggcccgttaggcctcctctcgcgtctgctgagtagattagtccagcctcctcaaaagaaaaaagaaaaagaaaaagaaaagaaaaaaagagagaaaagactagtccaggctggacgcggtgggcttctttttgagatccaacggtggatcgtcgatagatccaacggcagaaactgtgcttggcacggaaggaacgcgcggatcgatgacgtggcgctgatcctgcctagtacaaaaaggagggtggggatccccacacctgctctcccattccccatcgccaaccagtccgcggccaccacgtagagagagagagagagagagagagagcgcggcggcggcggaggaggaggaggaggagaagtcatggcgcttgtggcgcaggacatctacaccctcgaggagctcaagtccatcatcggctccggcgtggcgtaccgcgttcgtctgcatggggtcgagtccctcgaggaggccatcaccatgtaccgtacgctggacgacgccgtgcagttccgcggttgggcgtgcccccaactgaacaagctggccctcgtcgccggcatcgccgcggaggtggaccgcgtcatcgacgagttggttcccagcctcctggaggacgacgagaacagggtcctgatgcttctcctgaagaatgcggcctggtctatccggaacaacggcaagttggtcgacgcggacgccggaggcatcttccgcgtcaggatgcaccccatcgccaaccgcatcctcaaggccgtacgcctcttcctcaccgcgcgctccaccccaaccggtcgccgtgatcgcctccacgccatcgtctatgatctcaagatcttccgcgagtcctactacctaccaatcccatagatccactcaccggtacatgcgccccccccccccacccacacgacttggttctcagcgctgcgagttttggtggtcatattgatgctgtccatagcctgtagtttgcttcaaatcgtggtgttcctctccaaagctgtacgtacctgatggaggttttgaacgccatgggttgatgggttacgaaagtgagatttgagattctgttagtgtttcctcttgctgctttgagatttgaggatgagatagttcttgctgctttgtgaattgggatacgattgtttctgattagtattgtgcagttacaatacaatgtcatatggtggatatattagctgaaatcaattgcaaactcattttggcactttctgagctctgatgtttcctgacctctgagattttgatgatctccaatgctgaaatgattgggctggattcctgttatgattcttgttgtgtgctgcttgttgaaaaacagaattcggtgcaaaatgtatgtactgtaggtgcttcgatctctgcggttagcagttcactactgcattttggcactttctgatgagttccacctgtttcccctgtgtttagttaataggaaattggaggtagttttgtttctggatactatccttttggcgttgccgattgattgaattagttcatttcaggttagtgattgaattagttcagacgtgtgttctgtttggtatctgaaggaaaactcgttggaatttgggtgttcagcctgtattcgtgtttgagattgtttctgattgggaggctgtctgcatttcgtttctgttgtaggctaaagcaatacaatatgtccttgcgagggatcatttgttcattatctacacacgatctgttttcattgccgatattgtaccatatattttgctaaatagatgtttcgtgtgtctgcagcattggctatgtcaattgcttaccagtgagtctttctttttctgaaggaatgaaaaaatagtactgtctccatccatcattttctttcccttttcccacttctactccattttccgtgcacacgcccataaagtttagagcaattacaagggtgcttgagtttgatgtacagtaccatatatattcatactctctatattcatcacaaaataagtttattttctgtacattccacacatatcaatataaaatctaaaagtactaaatacttttacttttgtcaaatttcaatacaactattcttcatttgtcttctctcaatataattattttatatttttacaaattttgatgtaataattacttaaaaataatattattttggaataaatgagtggagcttttttttttaaaaaaaaaacttattactactactactactattcctttttggctgttcaatgcagcgctgcattttgctacaattaccagcctgctggacctgttaaatcacctcccacccccactcacacagtcacacatgtcaggttagcaagaatgatttggagaaaatggtcatcctgatcacttcccatgttgtcattgttgttgctgctctcaggtcgtcacattctgacttttggaaattgtagcacatgagtacatcaatgggtgtgtttagttcacaccaaaattgaaagtttgattgaaattggaacgatgtgatagaaaagttggaagtttatgtatgtaggaaagttttgatttgatggaaaagttagaagtttgaaaaggaagttgggaactaaaccagacctatatcacatttggtctaaataatctatgcacctcaatgaatacagtttataccgcttggtatttatttgaccgtgtttgtctccatgcattattcaaaaatatattaattctttctactttgtgggcctttcattgtttcagtaattcctcattattaacatattatcaacaatcaatcctacaaacacagcaaataaagaatcataagtctcaagagaaataacagaatgaaacattaccacatccatgtcattacaaacctcaacagtaaacagggctgatagcctgatagtttcggggcaaatgtacgtttaataaaacaacacttgtaactgacagttgcaatactggttattaagaacaaccacacgcacatatttgacatctaaaggtcaagagcatggcaccggctgcaaggctccaagacgtttaactcaactttggagggaactttgagctcgatgtatgtttgaacagccttgagtgctctgtgggcttccatgagtgtctctctgcgcatcaagaagcatttaccaagtctgttcacagaacatctaggcgaacctgacgttgtgtccaacgtaagacattcgagtgctgtcgctgattcaacaatgtgacatgttaactcaaccaaagtcttcacagaagagaaattgattatcttcacacacttgagtttgtcatgacggtgctctggcatcatcctcagacctgaaggatccccaaaaattgtggcacgttccgtgcgttctcggagtgcctgtaaaggtgaaaaaaccaaactatgagtagtgattccaccatatttacataaatatatttacaggatggaacttacattcaagataaaagtctccaagaaaggagaagcatcaaaaaaggaaaccagagaaaggtaatcataggtctgtccaccaagggcaatactcaagtacttgaggtgatagaatttgctaggcaccattggtgtattgaccatctgcaggttcaaacaggtttcattgtaagact

SEQ ID NO: 46676 - DNA, 1595 bp, Oryza sativa
agaaaacttttgactatatatagtccaattgtcttggcagctatggcaccaaataatgttttgttgcgaataaaatgctaaatagaagtcttaacaatgccatggcaagtgcttgcatgtagaggtgactgagggtaaagcatccacttgggttttaaaaaatgcatgctttctatgcattggagattatttacagtgtcatatctgtaggagctagccgatatgggtgctttggtaaatggtctgcctacaaatgccagcaaatgtcaaaatatctccagatttggcaagtttttaaggtgcaatgggcagaagagcacatgtgggttgtatgcttaacagcatgtctcctcaactgtaaggagttcatatgaggcagcataaaaacatgcagactgaggatggtagcaagagctgcacaagatactactagacttctcatttgatctacacggtattgaggcgcccggcatacattgcacgagggtgtggtagtttttgcacactacacacaaagtatgcagtggaaggggttagccacagtttgcaccttgagggttctagcagatataaacaacagcataatgaaataacaccagaacagtcaaagtagatgaagcacaagcaggaagacagcagtacaaaaatcaactgatttaaaaacaaacatggagactttatggtttcacactttcactaaagcgtacctccggaagcgttgggtctgaacacttcgcttggccactccaagagtgtgtgttattttgacaggctggagcgtttattttatcccgtggatgaatcaaaactgatccatctgcaacaccatgaatggttgtgaatataatgcaccgcataaccaaataatacaaagctcaaacacaataataggcagacaatcaaatttggttctctcatcaaaccactgtttgttgtgcacaagaaacaagcagaacacaacacaacagagcaattttgcaagaccatagatattttttgcaaaggattgcccccgaattttatgaaaatttgttcaaccaagcagaacaaaacacaaaatttctacaaacagaaaaaatggttacaaatactatacgctcaaaactgcagatattttgatcaaactatcacaaatttacagattgaaggtgttgtaccacgaaactacagatttgaggctaagtatatatcagaactatttagtaaaaaaaaaaagaagaatcacaaaactacaggtttagttccaatttaatcacaaaacagcaacgtttatagcccaaaaataacagtagtgctgaggattaaactctaaaacctatagtttgtgataacatcaatattaaatctgtagttttacgatactttgccatatatatgtagttttgtgataaatttagtgttaaacccctagttttgtgataacacttcaaatctgtaggtttgagataatttggtagttttgtgaaatttacacgaagagtgaaaactaagtaaactactgcttagataaaacaaaaatcagtaagccgccgtccatcccccaacgcgcacacatacaagattttccccagagggaaacgatccacagaacatct

SEQ ID NO: 46677 - DNA, 16776 bp, Oryza sativa
aaaaaaacaaggcaaaagatagatgcaatattgaaagaacgattcaattactctctccgtttcacaatgtaagactttctagcattgcccacatacatatagatgttaatgaatctaaacacatacacatgtctagattcattaacatctaagtaaatgtgggcaatactagaaagtcttacattgtgaaacagagaaagtaattaattgcgttattatagattgtgtatctcaattgaactagccatggttgttataaaggggtagtcttgccttgcataggatcttctccatgtcccactatgtgtagatgtcaattattaggactcgaataaccacagtacaagcaagaaaatccgagacccaacaaaacctaactcggaattgaactccgccggtctcacgggtcgcatgctgccggtcaaaccgaccccaaccgttggtctgaccgccatcagtgcagagaacattcagcccatcaaaaaaatcaagttatttgggcagcacaggcccatatgcctcactcacttgggccgatccggcctcgctgaacggccgatggtactgcaaacggtaacagttgaggcattaacaaccgtacaccgatgttcatcagcgacgcggatgtgcgtccctgtttctctcttggcgatgtagatgtcagtgtgaccacaaacagagggagtggccctgaacaggaaaccagaattgggacgcgcaggtcgcaggaatcggaatgttaagagtgctgctagtaatggcatattggcatattagcatgtccagtcgaccagtccatttccagcagctgttagttagcactcgccataattaagatggatgcgtgccactgtcactcgccatctcacccagatcacacgaccaaattgatccatcgctaacgttgtaaagctaagctgcctcttatgtgatctgatcaataatacgccagttaattgacagtaaatcagtaatacagcaagaacgtacatttttagtttttttttcttacctagtttgatggcaaagattatttgctacgaattgatatttataataaggtgaaaataatcctgtggtgaaacgaagcaatggaggaggtggtggtgcgccgccgggcatgggattgcgggagcccactgtacgactcgttcgagctcgcgtcggtgtacggcctcctcgacagcaatctcatggcgctgccgttcgccgagcggtccgcggagctggacgcggcggcggatcgcgctccggcgaggaggacggcggcgaaggagcagaggcggaggaagaaggcggcggcggcggcgaggaggacgggcaaggcggtgctccgttccatcttcaggtccgtcacctgcagcaggaagctgtaaagctgtaacactgagaattcagaattcagaattgcatcgaacgagatggttgagaaaattaacgatatgatatggattgatatgaattgattcatcggtccgcagtgcagatctcgctgcttttgtttcatttcggcagattttatgattcgagttgggttttcgtttccatcggtttcttgtccttctcgggaatctccctattttcctgcatacgataattcgatctcagaaaaaagagagactctcggtgggcaagatccgttttgcactaggggtaaagggtccactaccagcaatcgtgtgaactctgaagtaacacaactaaggtctgtacatccataccgaaatagtgcattggcgttgcactgaaaattgaaaaatgccaaaatgggctgaatatatggatggtactcctagcagaagtcaatcagagtgcaaagtactactgagtactattatacatctggaattttgatattaagaaaactatttatttttcctaaaatgaaatagtagttctgaacttccgatcagggttcacctttccgattaagcgctggatcccgatccctggcagtatgacagttttcaccaaatttcgacaaattttggtcaatcttactgtttcaaatttgaattcccgaaaaccatccaaacttccactcggactctgctttcttcccacgttgaaacctcaaaattttgtgattttcaatcagttctaaaatgtcaggcagaagctagctcaacacaggatctttgagaaaggctcaacacaggagcaatttgtcttatgggtgaacaaaaatggaacactcgattagtatttcattgctgttcttgtccaaacattccaattgtggatgtactggacagattgtgtgggtttttattcagaagtggaggtggagcccagctcaactaaccactgtttgatgcacatgcgaacagagaaaaattggtgcagatgccttagtcagtactaatctccacggaccacaactgaaaggtttctttcagaaaatcaagtgaacaagctctacaagatttgtactggttagataggaatacaaaatatagtggcatgctgaaatccttcccttctgttgcgtgtctcatagtttctctatcctcttgcaatcaatcctctgctctgcaccacatctgttcattcatctaaaaatgtgcaaaactgcacatatgtgtgatgtgtatgaaatatcaaccactagggaaagaacataaagaaattatctgtgcaaataatcctctctaaaattctcatggatgctctctagctatgcaaacaaatcagaacaagaaacagagtacgagcaacatttttgtagagctagaaattcagtgattagtttttacaactttgtcgatgcaaaaacccacgacagatcgagtattcgagtatacatgttgttactaattagtcatttctaacaaagcccaattttctcgggacgatttattgctgatatccttctaatatttctaggttataaccttcacaaataaccaataatccatcatcacctaacagcgaagaatttctaagagctcaaactctgcaaccaatcatggccatccatggaccttggtgtcggttggttcgtgtccatggttcgtactccatctacgcagctagaagttaagcatctcccagatcaactcgggatcgaacgacggcatccgctcgagcgggcagtcgccgtcgacggacgccgcgctcatggagagcacgccgtccggtgacccgtacgacgacgacgtcgtggttgtcgtcgtcgtcgtctcggacgcggcgcgctcggaggccacggggcgagacggcgtcgccgccttcgcgtcctcggcgcgttggctcttcttgctctcctcgcgctggcggcgcgcgcgcgcgcgcttgcgcgccatgcggacgcggatggcctggatcttggcgtcgacggcgtcgcggagttggcgcaggttgtcggggcagtcgcggccgtccatgacgccggggaagttgaggcgcgcgtactcgccgcggagcttgaacgcggcgcggtcgtaggcgtgcgcggcggtctccggcgagtcgtaggtgccgagccacacgcgcacccggttctgcggcagcctgatctcggccacccacttcccccactgccgctgccgcacgccgcggtacagcttccgcggcgcgccatcgtcgagacccgccgcggcggccgacgaagagctggcggcggcggtggcgctctgcgcctgcgccgcctgcgacgcggcgaagtggcgcaggagctcgctctggcggtagtagacgctggagccgagcggcgggatggtgacgggcggcgggaggtgggagaacacggtgtcgagggcgctgccgccgggagagaggaggagggaggagacggcggagcggacctcgccggggaagatcgccggaggcagtgtgcggaggctggcgtccatgggaatcccggaggcgggagggtaatttcgtaattagcagcggatgttacgggcaaggcgggaagggcattcttgtggtgatttgctcgagatttcgccaagtactcgtgtaccatgtggcttatataagcgaggaatggcacggtggttttaccattatacccctcacatgataattggagtatgaacacaagatctttatgttgttaacacttcacgctttggtttggtcaactagctcaccatgtttagacccgtgatcgtaattaagcacccaagctaccccaaatcacctgtcaaatgaatagataatcattctacggaacaacaaatctgactacttatttcctcctgtgcatatctataagttggtgtttggatgcatccctatatttagacactaatatagagtattaaatataaactacttacaaaactaattatataaatgaaagctaattcgtgagacaatttttttacgggaatgctaggggacgggataccgtcccccaataggatagctccttctccacaacgcaattcttatccatacacgcaccaggactgctcactcgtcgccgtcgccgtcccccgccgctgctgcgcccgtcccccgtcgcctccgtcgccgccgccgtcgctatcccctgccgccgccacgcccgtcccccatcgacgccgcgcccatcccccaccaccgccgtcgctgtaccccgccgccatcgtgcccgtcccccgccgccgccgctgcacccgtcccctgcagccgccgtcgctgtcctcgtctacaaggaacggctgcaggggccgaccgcacgtgtcggggtgctcctcccctaacggaatgcccagctatatctagtaggaatcacctgatacctggtaggtatcattcgatacctcgcaagtatcacatgatacatggtagaaatcgtctgatacctgacaagtatcacatgatacgatacgtggtagaaatcgtctgatacatgacaggtatcgcatgatacctcgtgagtatcacgcgatacgtagttgaaatcatctgatacctgataggtttcacatgatacatcgcgagtatcacgtgatacgtggtagaaatcgcatgatacctgataagtatcacatgatacttacaagtatcacctgaaacgtgtgtagaatcgtgtgatacctgataggtatcacacctgatacctactcgggatcatcctgttgtgtagaattgtctgatacctgataggtatcagacctgatacctactcgggatcatcccgttcgaaaacgggatcccgttatatagcagcccctttttttaagcctaattaatctataattaaagaatgtttactgtagcatcacataggctaatcatggattaattaggctcaatagattcgtctcgtgaattagtccaagattatggatgggtttttattaatagtctacgtttaatatttataattaatatccaaacatccgatgtgatagatatttaaaagttttagtctcatctaaatagggtctaattccacctactgtaacattctcattgaaacttgtgttacaccaaatcaatctatatatgcaccacatttgtttcggatacaagaaaatctcacatcaattaaatttatcagccgatcatggtagatttaaattagtaatggtgcaggccaattaagagttatacctaaaaatccaatcacactctgaaatgtattgaaaatataatcttatccatagaaaaaaaatgctaatatagttatccatcaactccaatttgatgttcactattatatagtagaataaaaaattaagagccgtataacaaatctaattacactctaacttctctctgcgtggaagttgtgcgggacaattcatcactacttaaaataacaattgaatactaattccagataaattccagactaaaaattcaatccaattccaaatgcagaaaagcccgcggcgtgcacggatcatggattcccaagttcttggacacgaaggccagtttgggaattttgacgggtgggtgggggcagggacacgtggccacggaggtggacgtacggaggtggcactgcaaaatgtcaaaacgggagaggtcggaacgggaagagagagagccgtgatgagaaggcccaaaagcaaacttttggcatttatgaggattagttgcggtgacagcggcggccttacgctgccacgtttccggttctcctggagccacacccttgcacatccatcatctctcattaacttgattagacccggtccaccgtgctccggtgacacgtcggcagcccccttcctgccaaaaaatcacacttaatcaaaattaactactcttatcagtttatcacaaacctgtttcactatttgcactgtttgttttgatgactgcatgttacagtacaaaggcccccatttttcttacatagaagtaggtaaaataagcctgagaaaacatgctctaaaattttgtagttgcatgtctttattgattttttttggcatcattggttggctacgagctgattctaagtaaaaacggcttattagaaaaaaaaatttatgtttaaagctttttatatatcaagaagaaattgcgttaacataccgtagaattaacttcaagattaagttttaaatttaaattttggctcttgttcatttgttttgtagggcaaactatgaggcttgattgtttccttactccctgttggcggtatggtatgaggcccttcgaccaaaatctgccaaaggctatgtgaggagtgggaatccaagcccgagacgctaaagttagtcggggcgaagccccctcccccatggcgaacactatggaacaagtacagcgagaggcgaaggatcgtgtgggtactctgccaagccggaggcctcttgggcgaaggacgcagggcgaagagtatatgccgaagggagacgacttcgccaaagcaagctccccccgcgagggccaaagaagccttttccggcccatcaagcctaggggccattgggccgacgatcgcctaacggcccatcaggagtccatgaacctctattacactatgtactcatgtaaatgtcctttcataagggtaaccatgtaaattcccctgtataaccaaaaccctaatagtaataacctgtaataggggctataaatagtcccatagggccaggtaatggggggatcccaagaaaaattctctaatcaatacactttactttttctcaaccactgttgagtaaccacatctttcgacgtatgcagttgtcgtttcgacaacagctggtgccgaccgtgtggacctccgagcgaaaccactgagagcgaatgccaccgaagaaggtcgtaaaggagaaggttacaaggcgaaaggaaagcgacgccggggcggatatggccgccgaagagggagcagagccttcggcgcctgtcgccgaagatggaggagcgccatctgcttccgcacctgcgctatcactaccgcctttggcccctgctacctctgtgcaggtgccgaacgcggctgacatggcgaaggcggctgtggcggcgagggcactccagaccagggcggagatcctttcgacaaaccaactgctggtgccctaagccgctccgtcacagccggcagtggccctaactgcgctcgccgctgtgcaagcctaagtcaaccctgacaccgagacacaaaccgaagccgacatggaagccatgcgacagaacatgacacgactctaagacatgcttcaccaaatgcaagaacagcagcaagcgtacgaggcggtccaaggtcgcttcggcaccaatcctccagtattcggcaggttatgtcccaccccaagtctatccacaagtgccgacccagccccttctgccataagttgtgcaagcgccaatgtacttcgccgggcagccatcgaccgcagcagtgcatccggcccctcacgtgcaactgcaagctcaaccggtcgctgcccaagtacatccttaaccgcctggccaagtgccacaaacaatggcagaaggggcttcagctctgcaggcgcagctccaagctttccttcagcagctcagccaaccccacaacatttcaagtacaaccccttcggcccgcccggaggggaatacaagtcaaggtgcgcctcgttggttgccttcgaatcagctaggtctggggacttcgccttggagtcaaggaccacagttcgactccatcaatgctgcttaggcgccaaccgttcggccgcaagcaccaacgccaggtttcggagcaaaccaagcaccaaaccaggtcgtcatgacatggtcacagccaactttcgacccattcatggcggtacagcaagcatcaccaatcgggccgggcagccgaatgccatggcccaacctcacgcgcaagccgtgatttcgcccttcgccacgccatacccgcagcaaggtgccatgaacagggcagggggcgaaaaggggctaccattgagtgggggaatcaagacccgtccaatcccaccccagttcaacttcccacccgtcccacgctactcaggcgaaactgacccaaaggaattcctctccatttatgaatccgcgatcgaagcggctcatggcgacgaaaataccaaggcaaaggtaatacatctcgccctagacggcatcgcccgctcttggtatttcaatttgccagccaatagcatttactcatgggagcaattacgcgatgtctttgtccttaactttcgaggcacctatgaggagccgaagacgtagcagcatctactcggcattcgccagaggccgggggagtcgataagggagtacatgtgtcgcttctcgcaagcccggtgccaagttcaagacataactgaggcatcagtcataaacgccgcttcggctggtttactcgagggcgaactcacaagaaaaatcgccaacaaggagccgcagacgcttgaacacctatttcgcatcattgacgagttcgcaaggggcgaagagaattccaagcgacggcaagcaatacaagctgagtacgataaggcttctgtcgccgctgctcaagcccaacaacaagttcaagttgccgaaccacctcctctcgttgttcgccaaccccagccggcgatccaagcacaaccgccaaggcaaggtcaagcccccatgacctggaggaagttcagaatcgaccgagcgggcaaggctgtgatggctgtcgaagaagtgcaagccctccgcaaggagttcgacgctcagcaagcaagcaaccattagcagcctgtccgcaagaaggtccgaaaagacctctactgcgccttccacggacgctcttcacacaccacggagcaatggcgaaacattcggcaacgtggcaacgtgcaagatccaaggatgcagcagggagcagcggccgaagcaactcgtgaagtagctcaagaacaagtacccccggccgaacaacgccaagatgcgcaacgcagagtgatccaagtgattacaagggccgacccgccgatccaactgtcgaagcgacagaagaaaatgcagctgcgaacggtccacaatatcacttcggcaggcgaaggggctccgcagtatctgaaccagcaaatcttttttgggccagaagatgccgaaggagtaatgttcccgcatcacgatcctctggtgatctcagccgagatagctggtttcgaggtccggcgaatcctggtcgacggaggaagttcggccaatgtcatctttgccgaagcatatgccaagatggggttgactacccaagcccttaccccagcacccacatcgctctgaggattcggcggagaagcagttcaagttcttggccaagcacagttgatagtagccttcggcacgggggaaaacagacgcgaagagcaagtattgtttgatgttgtcgacatcccatacaactacaacgccatcttcggccgtgcaaccttgaacaagttcgaagccatttcccatcacaattatctcaagctcaagatgcccggcccggcaggagtgatcgtggtcaaggggcttcagccttcggctgcttcaaaaggcgatttggccataatcaatacagcagtgcacaatgttgaggccgaaccgcatgaccgggcgaagcacacgccaaagcccgcccctcacggcaagataatcaagatgcagattgatgatgccgaccccataaaactcgtatcactggggggcgacatgggcgaagaagaagctaagaacatcctagaggtactcgaaaagaacattgatatctttgcctggggccctgatgaagtgggaggtgtttcggcagatctcatcatgtatcacctagcagtcaagccagatgcaaagccaaggaaacagaagctacgcaagatgtccgctgatcgccaggaggcagcaaaagccaaagtccaaaaattgctcaaggcaggggtcattcaagagatcgatcatcctgagtggctggcgaatccagtgctggtgcggaagtcaaatggcaaatggcgcatgtgtgtcgatttcacagacttaaacaaagcatgtccgaaggatgatttccccttgccacggatcgaccagctcgtggattcgacagccggctgcgaactcatgagcttcctagatgcatattccagctatcatcagatttgcatgaacccaaccgacagccccaagacagccttcatcacaccgtttggcaccttttgccacctcaagatgccttttgaccatgcgtccgacctacaggagaccttcgacaacttgcgcgcaacatgtatgaaactgaatcctgagaagtgtgttttcggcgttcgcgcaagcaagctgttgggtttccttgtttctgaaagaggcatcgaggcgaattccgagaaaatcgatgccatttatcaaatgaagcctccgtcgagcgcacgtgaagtataaaagctcgcgggccgaattgcggcactgagtcgattcctctcaaaggcagccgaaagaggtttgcccttcttcaaaaccctccagggcacgggaaaattcaactggactcccgaatgtcaagcagcgttcgacgagctaaagcaatacctgcaaagcccgccagctctgatcaggccaacataaggaagcgaactgctactatacctggcagcttcgccagtggcaatcagtgctgctcttgtccaagaaacggattcaggccaaaaaccggtctatttcgtctccgaagcattgcaaggagcgaagacaatatacattgaaatggaaaagctcgcttacgccctggtgatggctcacgcaagcttaagcattactttcaggcccacaaagtcatagtgccatcacagtaccctttgggcgaaatactccggggtaaagaagttactggccggcttagcaagtgggcaacagagctatccccttttgacttacattttgttgcccacactactgtcaagtcccaagtgctagccgactttgtggccgaatggacaccggcattcgcccctgaacccgagctcgtcgaacagccctgggtgatgtactccgacggttcgtggtcgcacaagggggcgggtgttgcggcagtactcacttcgccaaatggtgtgccaatttggtatgctgcaaggctacagttcgacacaaccaacaatgcggtagaatacgaagccattcttttgggcctaagaaaggcaaaagcattggggattcggcgcctgctaatccgaaccgactccaagctggtggcgggccatgtcgacaagtcttttgaggcaaaagaagaagggatgaaaaggtatttggatgccgttcggtctatggaaaagtgcttcaccggcataacaatcgaacatttacctagaggccagaacgaggaagcagacgccctggcgaaatctgccgcttgtggtggcccacattcgcctggcatcctttttgaggtcttgtatgcaccaagcgagcccacggacagcttggaggtcctggcaatcgaccaggtcaaattgggcgaagacccatacgactggaggaccccgtttgtgaagcaccttgaaactagctggcttcaggaagacgaagcagaggcaaagcgcttgcaattcagagtcacgaagtataagatggtctcgggccagctctatcgctacgggatacttcaaccccttgcttcgctgcatttctttcgccgaaggcgaggaaatggcgaaggaaatacaccaggggctatgtggcgcgcactaaaccgcaagaacagttgcctccaaagtatttagacaaggagtttactggcccactgtgttgaaagtatgtgttgagcaaatcaagaagtgcgaaagttgctagcatcatggccgaagccaaacctcgccccagtatgagttgcagcccatcgcaccaatctagcccttcgccagatggggactggacattattggccgttcccggcggcgcgaaacgggcacaagttcgcaattgtggccgttgaatacttctctcgatggattgaggccgaactccttggtgcgatctcttcggcagcagtatagaagtttgtatggaaaaacattgtttgccatttcggagtgccaaaatagttcatcactgacaacggcaagcagttcgactctgacaagttcagagaaatgtgagaagggcttaacctggaaatcaggttcgcatcggtcgcgcacccgcagtcaaacggagcggcgaaacgtacaaatggtaaaatcctagaagtactaaagaaaaggcttgagggggtagcgaagggcaaatggccagaggaaatgctatctgttctctaggcccttcggacgacccccacaagaccaaccaagttcagcccgtttatgcttctctatggcgatgaggcaatgaccccaacagagctaggggctaactcaccaagggtgacattctctgggggcaaagaggggcgcgagttgtcactcgaactcatggagggggtaagagtcgaagcactcgagcacatgcaaaagtatgccacaggcacttcggcaacttacaacaaaaaagttcgaccgacggagctgttgcctggtcatcttgtcctaaggaaaaaggcgaacccgatagccgttagcaagcttgaatcgaagtgggaaggaccgtacctcatcaagcacaaatccaggatggaatcctttcgactggcgacactggaaggcaaagagttcgaccattcctggaacgctacctctctcaaacgtttctatgtctagaacgggtggcacccaaatcgccaacttgtaaaaatgtatatatcgttatgtaagcccttcggcactatgtaagcctttcagcaagaaaaaaaataaaaaaagaggaaaatgaaaaaagacaaaaaaaaatggatgtagggctattatccaccacggaggcccgaaccagtataaaatctttgtatcctctgccttctttttatttgtttgtgcgattgataatttgcggaaaaaccccaaggcaaacgccttatcagcgaaaaaagccaggagggcgaaacgaatcggccgaagcatcgttcgccgaacgattgaaaccgcagcagcttgtttcagactcgatcgaaaggaaagcacgagtgcttcctataacgtagaacaaaacggatcgaaaacggaaaccgaaagctgaaaagtcaaaacctatttcgctaatatatgcaaaggggctgatacattccgacccaacgaaaagcacgcgaagtgacaatgcaaaaataacgaaatggaaataaaatgcacctttattgattttaaataaaaatgtatcgaagaatacatcacaatggtacaaatgaagagaaaggagcaatggcgttacagcccggcttacagataaattacatcttcgcccccacgatctctctctctctatggagtgattgggcgaactaggttcgtcatcactactaatatcatacacaaccctaagaggagaagggggcgaaatacagactagactgtaacgacgctgggagatcgcctcctgccgatcagtcttctgatggtttcgctaaaagcgagccatgtcctccaaacgtcttgaatgaacaagatcgtagtcatctaaggttcgcctagggtgcgcccgaagccacccgggaaccttaaaaaccttatagctgcgtccgtttatcaccatttcacgataaacaggccgaaatgggcatcgcacctttggcaaatcctttaatgccacaaatttctcgttttggtttcgccaactcccagaagggggccgaatgcacaactttcggcaaacaccctggtagacagtgcaaaaagggcaaaaggagaattgcatagtaagaataggccgttaggcgatcgacctcggccctagcctctcttcctttctccaactcggattggagccacttgttttcggctttcgactctttcagggtgttggcgagggcctccatctccaagttcttgcggcctatttcgtcatccttggctcgaagacggttcttaaatccgtcaagacgagcctgcactgttcgctctgtcgaacagtgagttgcaagaatctggatgcaaaataggaacggtgaagagagcaaatgttaattatgggacatgtaaaaaagaagaggaaaaccaagaatagagaaaaagcatacccgaaccgccaagcttttaatagcagaacacccctcatcgaactcattcagttcggtgaataggctcggggtgctggcaggtaagacaagattgcttactccctcgacaaagggaataaggtctgtccgggtctcgaaatcgccaggggcgaaatggggcgccgcaagagaatactccgaaccagatgtttcgacggtcgcacccttccccttcgccttgactagcggcgaaacaaccggctgacgcagagggctaccgaagaccctcgccgcagctgtcacaatccgttccacggaggctgaagccccggcggcggcgctaccgcctgctccaactgcgccaagtgaaagaacgggggcggtcgaaaggtccaggctgcggccaacgggctaagtcagagtctcgtcagaagacttgtcgtcgctgaagacgcgagcgacatcgacgagtcctttctccttggaaatctttttgaccaaacctcccttcgccgccttgcctgccgaaaacgcaattagcgccttcgccccatccatctcctttcgacgaaggggggagctgttcgactccaccccggtctcattgtgacccgggcttggagtaggagtatagccaggggtgtcgacgcggttttcgaccgcctcgtccgcggccttttcgaccacgacctcaacctcctcctcttcctccccttcctcctcgccgtcacgctcttcgacgtcatcctcgtcgtcggcgtcggaatcggacaaaacaggaacccttcgcttcctgggcgcaagctttacttgtccgcgcgttcgctttcacgaaggtcctgcatcgtcgtcggccttgtgggggttcgcccgcggaggcaattcgccgttgtaaacccggttcgcccggccagccgcttgtcgcgttagcagctggctatactcgacgaccgacacgtcgccgatcatactgcgggcttcggcatcagcctggtcgagggtcaacactacaaaaataaagggtgtagccacattaagcgtcgaacaaagcaaaataacaaagcgcaggactgcatttcgaaagggcagtcttaccgttcgtcccttcaaggagaaccaacttcggcaaaccatcaacctcttcgccttgctcaactgcgacttgccacgactgggagaggggaaagatgcgaagcatgcaaaattcctccaccaagtcgcggcagctaaggccggagcagaccttacgtagtagagcgaaccacgcctccatagcgccgtccacggcgatcttgggctttcggttcggcgcaatcgccctgcaccgtcaccgaagggcttttgcggagtcagaaccagcctcgaaggggatggtgtggtaaaaccacctcgccatccaatggcggtcccacttcgacatggcggcgttcacccaccagagatcggaccgctcggggcgaacattaaagtttacgctcccgaacactgtcttcttcgttctagctggggtaatcaccgtcttcgaattcacggtggcgaagaatatggcgccgatgagttcggcacctggctcaaaccacgaagtccggcacgcccagtcaaagatagcgatctggaccaacgccgacgggctcaactacgggagctccacctagaaaaggcaaagaatctctggcaacaacgcgttgcacggaaaccggagccccgcttcaaaaaacacggcgaacaccactgtctggttgtcgacgggtttcggtacaacggctttccccggggcgaaatcctgtccctcgactaacgccccagagctgaccaactttgccagctcgccgtcgtctatgagagaaatccccaaataggcggtggtgttgtcgtcaatccggccggggtcgggccctttcgccgaagaggggttaggcttgcggggagccatgacgaaggacgtatgaagtggcgaagggtgtgtgcagtggcgaacaagaggagtgagcgagaaatctaaagggccaaggggtgccgtgagagcaagaacggaggaagagagcgcgagcggtgaaagtggcaagtctggcggtgaaaagataacgggggagcatatatagcccaacaaggcgacggttcgcctacccaccagtaataaagcgccacgtgtcgtgagggtaggtgaaacggtaaattcccatcgaccgagctgcacagtaaaaagcccacaaagggaaggcccattactgttcctttcggcccggtaaaaaaatgggctgcaggaa

SEQ ID NO: 46678 - DNA, 14587 bp, Oryza sativa
cccccccccccctcccccaatggcgaagactatagaacaaggacggcgagaggcgaagtatcatgtgggtactctgccaagccggaggcctcttgggcgaaggatgcagggcgaagagtatatgccgaagggagacgacttcgccaaagcaagctcgcccccgcgagggccgaagaagccttttccggcccatcaagcctaggggccattgggccgacgatcgcctaacggcccatcaggagtccatgaacctctattacactatgtactcatttaaatgtccctttcataagggtaaccatgtaaattcccctgtataaccaaaaccctaatagtaataacctgtaataggggatataaatagtcccatagggccaggtaatggggggatcccaagaaaaattatctaatcaatacactttactttttctcaaccactgttgagtaaccacttctttcgacgtatgcagttgtcgtttcgacaatactccctttggctacaaatataaccatttctaggttgtttaacagaggttaacctgatgtctcttattaaatgagggatatgttcgtaggggtggagcttgagtcatcagggagggggggggcggttaccaggaacccgatgaaaaaaatttgtaactaaaatttacctattttcaccatgtgtgcatggtgcacccccctaaatataaatttagtcacccatatcaacttaaaatcaatataaagtagagcaaattaaacaagtgacaccccctccatttcgttctagctccacccctatatgctcctgtaagttggaaacaaatttgaatgcaaggcatttgataggataaatagtatttgaaatgtttacgtttgtgcagaattttttttacacaaaaaaaaattgagacacttcgaatgtttatatttagggtcccttatatttatggacaaggagagtaagctgttttgttttttcgagtaaaatggaacattgcatccatttccatgcttttagctagaggtcaggattgcaattggttgttcattgtttttttttcttggaggggaattgattgttcattgttactgtcacattatctccattgtatgttgtacacagagtttgatgactaaggcaacccaaaagtactcctttgtcatctattcatgggtggacggtaatcgttcacacactagcttggtttgcttatttcactttcatggtcaaagcacgggcggtgcggctgtatgtcgacggcttgtgttctaggagagtgtgacatttggttggaatctaaggagaaattcaaggtgaattcaagcaaaatccttcccatctgaacaagttaggtcgaaaatacttgagttctgtgtaggtagagacgtcaagtttgttctagaaaataaattgttcgctgatttgggacgaaaaagtaaaaaaaaaactcctttcaataattggtgtttaaattatttaagttggaaatgcaatatgattggcaattattcatcaagaatgtagatgtcaatcagtcagtgcttgccagccagctcagtcgatcagcatgaatgaatgatcagctagtcaaaggggaggccatggcaagggcccaatcagtgtgccccaatacagaggtcaggactttgatcttgatgacatatcgctaagctacagaaattcagcgaccgaccctaacctacctcgcatacatgtcaccggtttgtagaacgatcgagagatgtggtccaatgctcattgatggttcatcttcagagaacataaatccgtgttcatattgttagccactgtgtttccaattgttttgggtggtgaacttatgttcagattgagttagctacttctgaagggaagatgtgaccaaggcttttacccaaaaaaaaaagtgtttgcactgaattttatagtttctcaattgcttgtaaggaggaggcaatgcaacctactgaatctgctagtacaatttggtactcctgccaattcggaggcaacaaaagtccggtcaatattgaaccgtcgctctcagataaagattttgattggaaccctcgttgaacggaagagttggctcctttttgagctgatgaaaagaagccatctttacactttacagagcgcagttttaattcttgtgaatgctaagctgttcatgaattcgatcgctatacacgctgcaatcaaacataatactacgagtgcagcattgaaacgcaaaaggcagtagcagctacagctacagctacagcttgggcactgcgcgtgaagagattggcagcgaagtcaatggcttggggaccctgaatgcgagggcaagcgcagcagaggccacgaatcgcttgaaatcgaatcgcttccatgtgatcagcgatgtcgcggccaaacctttccatttcctgccttttttcttggccaaaaaactcgccctcgctgccctcgcgcgtcgctgtagataacagtgattcctgtctagaattcctctgactttcagcagagacgttcttggctgagctggttgtatcattgcccatcctgatctgttgtcacagagagcttaacatgtgtaattaactctagactggctactgaagctgattcttgcaggctgaatcgatcagtattcagtaatgctgaggttacaaactggattactagtactttgttccttttgtcaggataagatcaattgatcatttgatcaagccatatatgtgtggattgagggccctgcggtcaccccatttcctaggccggatgccacccttaacggtgacacaatcagcatgctgtcatgtctgacagggaatgagaagaagtttgggactttgcagccatgtgagtctcctcaagttgcatgaagcagagacagaaactgccatggacttggtgcatgaatcactacttagggtgtgtttagttcacgctaaaattagaagtttggatgaaattagatcgatgtgatggaaaagttggaagtttgtgtgtaggaaagttttgatgtgatggaaaaattgaaagtttaaagaaaaagtttgtaactaaactgagccttaggctgagttcgtataggagggttcccaacccttctccttcgtttttcgcgcgcacgtttttcaaactgctaaacggtttatttttttcaaaagtttttatacgaaagttgtttaaaaaaatcatattgatctatttttgaaaaaaaaatagctaatacttaattaatcacgcgctaatggactgctccgttttccgtgcgggagggtaaggttcccaaccatgatctacgaacacagccttagttcatttctacaactcgtaaaagttaaatttactcaattcgttgagtatgtatctttgtcttatcaaatttttcaataaatttaggtgaaatgtaagaaacgaggggatatttctactagcgttgaaaaaccatctggtacaactactccctgaacttgtcacttacttcgtccatacaaaacacctgagacgattgaatgaaccctagccagcaaggtaagctttagcttgtttcggctcacacatgtacacactgaaacagtgggaagaacacgcacggagagtcggagagaaacagtctagaacacggacactccgctgtgcgcacagcgtcgtccctgcagacagcctcagcgaggtggtcaaagctcaaaaccccagcgaggcgagagcgatgtcgccgtcgccgtcgcgtcgcggggggagtgctacgtgctggcgcgggattagatccggccatgccgccccacgccggcacgacagccacgcgccgacacgcgcgcgcggggtcagaaacgcagccaccgctcgcctcgcgatttcggcgccgggaacggcgaaccggtcttggcggtcgccgtcgtcgccgtcgccgtcgcgccggatagcgccaaacgaacgctttttcgggcggcctcccggaaccaacacctacacgaggcggcaattaatccaatccacagctcgaagtcgaacgctcgatcgcccggcgatctggcgcgcatacgacgcgtcgtcactcgtagtgcagctcgcttggaccgtatttaattatttacaccaccacttggctctctcgatcgcatctcgtcgtcaaggggctctggtgatgtgacgagacaccgggcggcacaccaggtgtcaggcgcgcggccatcggggcggctcctggtcgaggaaacggaggcgtcgagcactgtgattcattcgcgggcggtgtcgatcgatctcacctcgccatttttgtcaaaagagggggaaaatgtttgcagctgggtattgatctgcttaattaagatttaaggggagttcgttgagaggctccagttactagtagtttttggactcgtatctagtgtatttctgaactttccattttttttcttcttttcttttcgtttcttgcaaggatgcgtggcgcgtcgtcacaggggagcggaaagctcaatgattgagccgtttgtgtatttcgtgacgaagacttgacgtaagcacacgtaatcccctcaaaaaaaaagaaaaagaagaagaagaagaaaagaaaactaaaataactgcctagtgcaatacaaatggctcgggcgggcataggcccggtgaccacgcgcgggcgactcaggagaaacctagcgccaccgccggagcgcgtcaccggagcaccgtgcggccatccgggatggcgacggcaaggccaagcctcgatggcgccctgtcactgtgcgtggaaggcgggccggcgtgtgaagggtggccagtggcggatctaggaatttttctaagcttgggcaaacctaataatcgagaagaactaaaattaaattcatataaccacgtgcacgatttagcatagatcgagttctaatttataaagaagagaaccaatgtgtgaaattatattgatgaaatgaaactcgttaattgttaatgttgaatactagacatctattatattattaaaggaatagaaaaagaatgctccacgttcgctctcatggcctagaaattcccacgttaattaaagaaaatctattatattattaaaggaatagaaaaaagagactccacgttcgctctcatgacctagaaattcccacgttaatcgaagaaaaaaacagagtccgtataggaatacaattaggaaataactgaaattcggaattaaaaataaggaatattagaataggagactagagtccatatagaaatacaattaggaaataactgaaattcgaaattaaaaataaggaatattagaagtagagtatagagtccatatagaaatacaattaagaaaaaaaaatagaaattcagaattaaaaataaggaatattagaagtagagtatagaaataaggaatattagaagtagagtatagaatccatatagaaataaaattaagaaaaaaatagaaattcggaattaaaaataaggaatattagaagtaagtatagagtccatataggaatttaaaactaactaaaatttaaaataaacataataaaattaaaagtagagtttagagtccgtataaaaatacaatttacaaataactaaaattcaaaattaagaaaaacatgggaagaagagtttaaagtcaatataggaatagaagtaactgaaattcgaaactaaaaattaaagaatattgaaagatgagtttagagtccatatagaaatataattagaaataataaaaatttataaataaaaataaataatattggaagaagagtatagagtctatatagaaatacaatttacagaaaatttggaattaaaaaaaagaaatattaaaagacgagtctagagtccatataggaatatatataatttacaaataactaaaatttgatattaaaaataattaataactaacacgtatataaaatacagtatgaatattacacattaatagttttgtaaagttattgcaaaatttaaaattatgtttaaatataaaattttaatatatttgaataatataatgagaaaacatatatgctattatatgagagaaaatataatgatgctagcgcgtaatctgtatgggccaccatgctagttatatgtatatagctagtcactttgctagtatatgtgctgatccactgatctcacatccattagaactagttgattaagcatgtatatttgctattagtagtattttactcaattgtatgtggctgaacgtctgagcttgtatctaagcatgttaattaacataaactaaaaattactgcacatacggctacatccagcggagcccgggcacttgccgaggctagccgggtcctggctccgccgctaaggatggctgaagacacagggtggaggcgacggatctggcgccgccgcggccggatccagcctccccatgggtggatccgacgcctccaacaccggatctgggcggagcaagctgctcccgggcggcgtcgacgggaggtagtggtggcgtctggtggcaccgggtgaaggaggacggtgtgcgcggaggacgcggtggtggaagctggtggcggttgttgcggaggccggcgctgtggcgccggcagcgggcctcggcacggcctcgtcatcgcctccctcccctgcggccggtggtagaggctccttccggctggcgatgctccaatttgagcctctcgtggtcggatctgctgcaccaacactgggctatggcctcgacggcagcggtcttcggcgccggcggccttgccctataccctcttccctcccctttcctccctcctctttgaggcgcactgaaccttgctttgcttcttcccctccccttgtgccctcgttcgtctgccctcttccctccccgatccaaacatcgcttgtgaccgttcttttcaatccggcgtgcttgtttcggacttgtgctcctctagcagctcgagtggctgcggttctatgccctcctctgaagtcgccgttgatgttcttcctctgtgagattcccccttggtcatttcccttttatctagctccctgctcatcttcaccctcttcctcgagatgtccaggaccgcaaggatcagcatttctccctcctttgagacttccttcccttgaagggcgttggagagagttgatctaacaagcaacttgataaaacctgattaaagaaaactcaatttgggcggcctctggccgcaaccttcaatggccctccctcctttggggcttcctttccccaaagaacgttagcgagctctgatccaaacagtaacaagaccaagttagcttcttgatggcttcatgcgggtggccttagacttcaacagcattcccttggcctttcttcttttccggcttgtttgtggctgtgtgaggaattggatgttgataagttggggtttagcattaggttgatttggttcttggttgggtttttttgcaggtgtcgttcgtctatcgttaactttggggagcctttacaacctagcctccaaagcttagccgctgtctagctgtagcactttcaacgctctgatcgaattgttgttggtcagaaatcttttcccgcccttttcattcatatcctatgtaaaggctctgacgctgtcatgccaaacctttgtactccctgtaatatcatttcttttcaatggaaaattcaggtggggaagttctcccatccggtgatttattaagtttttttttaaaaaaaaatcttactcctggctagctttaaattgcgtttgacagtgacaggccctcgcgggcagggaaatcgatcctatccgctgggaaatatgtcaacacggtgaggtggcacgagtttgcgcattttgcagtacgcctcgactagctaacaggagttgcatgcctaaatcagtgtgggattagcatcaggcttctgtagctgatcagcaaagtttgaaaataacccacccaaatccatccacagcctgtatcgatttatgcatagtgttgaacccctgctttactgatagccatacaactatctaaggatgaaaacggatcaaaaacggacggaaactagctttatcatattcattttcatattttttttcagaatcggtatcggaatcgaaaactcggatacggaaatgaaatcgaatattatcgaatacagatacggagcaaatacgagacggaacgaatacggtagcgactatttaccggtatataaaaaacccctcaaattgagttttgataaggaagatatattgcttattattttaattcaacatctccaacatttatattgtcaaatttgtagacggtcccccaacagtacgtgaaaatcgattttcatggttgtttctctaagagatccatatgcaaatatgattatcattttctattcccaagaccttttactagatgtataacttacttaccattatataaattggagatgttatttattttacttcacatcttcgaaacttgtaatgtttgttttatactttaaatgctctcaaatacaaatgctataaactataaagtggtagatcccgttgagctctacaactttaatatggaacacatctccatcagatgtcgtttgaattgtagatctgagattttgtaaaaattaatatgatatattataatgaatatttagacccttaaatgaccccaaataataaaatagtcaataagaaagttgtagatctcatcgagctctacaatgttgatataaattttgtcttcatctgattccgtatgaagaagttatgtatatatacgtgttttttctaaaatttgctcaatgtctgcagatatccgaaaaaaattccggatagtttccgaccattttccgattccgacggatagtacccttactgtattcgttttcgttttcgagaaaaaaaatccgaattcgtttccgaatccgaaaattttccggatagttccgaccaaaactattcgaatccaaaaaaaggtccgaacggacggaaactactgaaccagtttcaaccctactactatcactgtcagtgcctcactgacgaaggcagattgaattttcaggttatgagccaacaaggcctagcatgggaaattggaggtagatactccatccgtttcaggttataagatgttttgactttgatcaaagttaaattgttttaagtttaaccaaatttatagataaatataataggggcatttacaaatttgctaccggttttttcaatattacaaggataccagtcgaatgatagttctagtggtatttttgcatctaatgacagttttacaataacgattcaaagcaatggtaaatttgtaattgtcctaatatagtaatatttactttaccaaattagttttattaaattaacagttaaatatattttttataataaaattattttggatcgaaaatattactattgtttttataatctgaaacagagggaatagctgaaactatccaactgagtggagtggtagagctgcggctgagggggtggagtaagggcggtggcagcagatcgagaggaaacttcgtctaatccgacggaaacggaggtagccaaggggagcacgccctggtggtggatcaggtgagagacgggaaaaaagggaaatgggagaggaggaagaagatttgatggcggacatattgggactcatgtgagtttcacttgtcactatattatcggtatcaaagttgacatggtataatgaggtgagcgatgagcggtattttagtcagggacgaatttcagactaagtagacacatttaggaacctaaagtgaacttatttcatccataaatgcatcaagaaattcaagcttacaacgcagtagaatgcaaatggttcgacccacgggcctaacacccacgggctttgtgttgggctaccgattccggcccaactaaccgaccaaggaggcaatgcgaggtctcttctgggtcctgtgtgacatagcggctctgcgagatggcatgaacgtaagccagtttacctcaccgcacgatgcagcaagaaataattaactgaagatctaacagtgcatgcattggatgctataattatcagacccgagagtccaacacatccgactactacatctatacaaaccacagaatcgatcatctcttctcaatcgaaaccttcatcgccggaaccgtttaattccggcgtctcgccgcgcgatgcccaaattaatagtatcatcgacgtaatgtacagggagctactagtagcttattaattagtagcgacgtgccgcctccatcgcggatgatgtcgaagctcaagctgccctgctcttgagccgcctgagctcgacgacgacgacgctgatgttgtccctgctgccgcgcgagacggcgagctcggcgaggagcgccgcggcgtcggcggccgagctgccggagacggactccgggaacatggaggccgcgcggccgttgaggcagttcctggcgatcttgcacgccacctcgttggacaccacgtcccacagcccgtcgctcgccaggatcaggaactcgtccttgtccgtcctctccaccaccctcacctccggctctgcgctcacgaacggcttcaggtagtagtcgcctgaaattcgagatgccttggcatttgttagttttacatatgccaatgctatgagcagcaagagttagattgggcttttttttgcttttacctatggatctagaagtggctaaaacaccaaggacacggtaaccgttccagttgatgactctgcctccagctgcttccactcgttccaactcgtcaggccgatctggctgcgtagtcaaaacaagcattattcagtttatgaccctgcataattcatgttacatctgaaccagtttactgatgggatcctaaaataatatcagagtccactcaagtgaagacacaaaatcggagcatcaacctgtttacgacaacagcgcaaacagtacactgttgctagtaagtggtgtaacccatatctttttcagaacggcggcacgggaaacataaaaagacaaggttctagaatgggggtaagctagctgatcgctgtgcccaacagctaacttttggcacatttagtggccgagacgcatcagacctactaacccatctcattgacgaacagtagtgtactgctgctactaccatgctttggagttaaccctgcagttgtgctgttcaaccgacaaagtaaaaggagactgtcaacgtgtaaagccagagatgaaatagatcttgcacttaccacaaccacccaagcgacagtatcagtaaatattttgaattgaagtacacgataatggcataatgcactgttagcatcaagctatagttacatgggcaaaatttcctactacctgcgtccttggcgaacattcgaaagatcaaactaggtacagtactatggagtagtaagcatgccacgtacggatctaaccaaaaaattaattgacggcaatcagagctaaatgtacacgagtaccatggattacacgaataacatttggccatccatatatcattataaagaagtagttgtacggagtgccacgtagcgtaccttgtggtcagtggagagtggcagcgcgacgccaccgcgggagagcacggcgcgcgagtcgccgcagttggcaacgacgatgcggcggcgtcccacgacggcgaccacggcggtggagcccaccgtcctgaaccccgacggctcggtgccgtcgacgcggggggcggcggcggcgacgctcccgacgacctcgccgtccatcctcgcgaagctggccaacatcgcctccttccagcgcacgtcgccgcccgacgcgctctgcccccgcagccgccgcaggctcacctcctccgcgagcacaacgtgcatccgcttcctgcacgcctccgccacccgcgacccgccgtggccgtcgtacaccgcgaagaagtcctcctcgccctccccgccgcccctgatagcgcccgcaccatcccccgtcgaagccatgaacgtccgctcgatggccaccgcgtcctccatctccctccgccgcccgatcaccgacaccgagccgtgcgacacgcacgccggccagctccggggaacaacctccgtcgacgagtcatcagacgacgacccgtccttcaccgaccggattctcttcgccgccgcatcatcctccgccgccagcccgagccgccggagctcgagacgtcggcgccggcgtgccgccgcggccttgccgtcacctccggctactacaacttcgcacgcgtgcccctcatccgtcgcgcccgtctccctcatgtcccacgcgtagtagagagagcaacggaggaatcaaagggaaaggctcgccgaggagggcgaggcgggctttaatacaagcccacggcgaaaggtaggagaagcaacccgagccgtcggatcgcgcgcggacggccagatgcgcgccaccgccgcgtgggacgtggacggacgagatcgccggtggcgcgtggcgtggccgccgtctgggatcccgggccgggagagagaccacgctgcgcctggtccaccggtacgctctcgcgcgcggtccatgtgggcccatgttttcagtgacataggcttaggtggaatgggtccacgtagcgttgggatggttgggaccattaggtaggggagtggggcccaggaaggggtttacgtggagggagagagtggaacgaggaagtgtgggggcgcccgctcccgctgcggcggggacaaatgttaaccagcggcaaggcaaaagggcgcggcttacgtgcaaggaaacgagattctacaggagcgagcaaaactgcaaaagccctctgtgtttttgacccaaaccgcgccaaaaccaaacccacgtctcacacacctggattccggaaaaacagtgttgggtcaaacaaaccacgccgcgaacagccggcggatgaacgaggtttcgtttcggcgtttcgaatggcggagatggtcgatggcgtacgcccgatttggagcgtggcgcgggggtgagggccgcgtggcgggcgaggtggacacgcgcggcggatccagaggcgcaagcgcgagagggagctcggctcatgccggggtggaagagccagcgccatggcgcggcctcgggctccgtttccggcgcagcgccactgctgctgctgagtgggggcgacgtggagacgacccgggccgtggtctccgcttcttcgtacgagcagtggtgacgtggtccgttgtggtcaggcactcggtgcaggcgcgggattcgaggggtgccacgacggcatgcgggcagcaaccatgggagggccatgccgttgctagctttcaacttttacggcaaagcttgttcattcatggtgatgcgttggatggcgcttttgtccggtcgtttctgatctcgacttccaaacgagggcgcgcacatgcatgctcgctcgctccatgatcagttcggaaccagcaactgttttgttccagctctcaggatctggacaggtgtggtagcactcccagtacgtcactgcattaacttgaaacccgtacgtagctcctgatcagcaaattaatgttcgttgctactagtaataggcattacacgtccttcacaatcacttcatctgtactcgagccatttgatagcatcatgatcacacagtactggacatgaggttaagcgggagcagagatgctttcccgtttgaaacttaatgtcacctgcacgctagctaaaacaatactgaatgctaacaatgtgccccttggatactatcatgatcacactactgtagagtgatgtattaaaaataattgttgctaattccgagcttagcatatttaagaaattcgaacataaaaaggagcagaaaatatcatctcactttctcagtactactctcagtacaataacagactataagccagatataaacatatttcaagaatataaaataggagagagaacagcagcgggctatagatttatagccacttgtagtaccaattataatttgtatagtatacgtttataggtaactattgtatgaatcggttattaaattgactataaatgatttaaagctaatagctggctataccattaaacttgctctaatactggtatctctctaagctagcgttgtgttgtcgctttcggagaacaacgcatgcatcaatgcatcatgattaattcatgcatggcttagcttttttaagatttttaagcacttagagcagttacaatagcaagctataaaccagctataaatatattttaaaaagataaaacaagagagagaagagcagcggactacagatctatagccagctgcagcacgaactctaagacgtaatatgtgtatgacaggtgggatcagatattaatagtatagtaagtaaatattatataaattagctattacattggctataaatgatttgaagctaatagttgactatactattaaactcttagcgagctaagctcaacttgttaggtctgatctgatgcaatgcaaagcggacaagattccgcgcgcggccgccataagcatggcctcgcaaatttgtgtagcatcgccttgacggcaatg

SEQ ID NO: 46679 - DNA, 15003 bp, Oryza sativa
caagaacccagattgttgtggtgacagaattgaaacttctgaatatcggcaattcagtcagacgaggtaacggagcactcatatataatcaaaagtcataaaaagacccctcgaattcagcttctgtcatcaaatcaacagtttcaaaattctgaaaaacggtgggttagttgattgtgccagcagcatcccgcatccggacccaatcctctcgatctcctccggccatctgtttccctccctgctagtcaaacgcctccaagattgctcctgccgctgcaagaggaaagctgcttccttaggggcttcgggctgctacttattcactggacatcaataatcgaacctatagaagaacaaacgatacaagacagtttagtttgtgataaatcgtgcattgccaagcaatcggcatacgactactatttatatcaaagataaatatctgcattttgcaaagctagctgaaatcaacaaacatcgtctctgatctcaaaagaaacaacatctatcttagcacgacaactttatactctacatagccacaagaggagacaagagtacaacgcacggtaaattaaggacatcttagccagattaccaacaacatacctcaccatgacaaactaaattgaacaccatcaccaagcttcaccagaggccctccattgcggcagactggcagctctcttcaacaaatttcttaacttggttgctggtatctcaatcttgaacctaaatagataatgttagaaagctttctaaaagtatgaagtgttagtgcggctaagcaatgcatacagctcaagatgacaatactctggcctagaggcgacgcggacaagaagctagctgggaagtttccacagaaaaatgtagtttcttctgaagaactagatgaacaaacaaacattactaagtagaactggacactacatgtacatacaaaaataagacaaaaaccaatcatgcaattgactttgaagataaattactcagtcacattagaatatgcctccttgtgatctacttcttgaatattgagggtaacttcagtcaggagtcgcatgtaaggaaaaattctatatacagcagttctcctccatcacttgatcaaaatagttaacaaagacattggttgctctgctacttagtcaacaaatccgcaaatgggaaagcaatagcatatcctcccttgttagtcgttaaaataattcacatatttacatcttttaactttgttcttcaaaaaaatgattgcatttccatgtccatgtcctaacttcacttgtcctctggagctgcgactttaatgactctctggtcccacctcaacatttatactcagcaaaaatgctcttgaatcacatatatggccaatcagctccattcagctgattcacgaggctttatgcaatcgacctttgagaaccacatattatatagtttttttttaagaaagggcaaaagctttgccacttttatattgacatattatatagattgaatcaccaatagtcatcacatgagcagactccatcttctatacaatgaaaccgaacagtgtcccttacaactattcttctgcctgtggcaagtgaaatgagtttgatggcaacatggcaatcatcacatatcctgacgtttttcattatacgaatagcttctcccttgggggtgcgaataaggccaaatgcaagagctaatttctcactgtgatacataagatgttcttccttttgttcatcctcaacatcatgtagggccactgcaatgtttggaacatatccaatcacttttatcttgtctatcagctcttggagttttttggtgatctgctccatatatgggtgttttttgtcctcagatgtgaaaacatggacctcactacccacttgaatccaactaacaccaggctccttcctaacgcccaactctctcatcagcctccgaaccttcacgacaccatcccaccggtttgctttcgcatacatattagaaagcaaaacataggttccaacatctttgggctttaactgaaaaatctgttcagctactcgatgaccaagaccataatttctatatacttggcaagaacttagaagtgatctccatgcaacaacatcggtaccaatgcagttactttctatgaatcgttctgcctcgtcaagccgtccaactctgcacagcaaaccgaccatgcaagtgtaatgttccttaccaggttttactcccacttccttcatcataatattcaggtagtagaacccttcatctacaagacccaactgagcacaggctgacagcaccccaatgaaagttacataagatgggacttcttctgcaaacaacatatcatgaaatgcttccatggcttctcttgcacggccatgatgagcgtagccaatgatgattgaattccaagaaaccacatcacgacatggcatagaaaggaagactctccgtgcatcctcaacactgccactctttgagtacatgttcatgagggcattacagacaggcaaaaggccccaatgcccagttttcatagtacatgcaccaagggcattaccatttttcaaggtggcaagaccagcgcaactgttgagagcaacagcataagtgaactcattaggccgaactccttccatttccatatccaagaacaactgcaatgcatcttcaaacagctcattttgtgtataagcagtcataatggctgtccaggaaacaatattcttttctggcaaaacctcaaacacgcgattagcttcatggggaaagtcacatttcccatacatatcaacgagtgcactccccacatacacattcagctcaagcctcctcttcaacgcttgggtatgcacctgactcccaagcaccacctctttcgtgctagcacaatgcccaagaactgcgacatatgacacatgatcccattgcccgacatttctcaccatgcttcttactatactggtggaaccatccatctggccccgatcaagaaacccatttatcattgagttgaacgcgaatacattaaaactggaaacattatcaaataccttcaccgcttcgtccatgtgtgcacattggcaatacatatgcagcaccgcactacaaacgtaagggtgctctgctagtccagccttgatagcatatccatggcactgcctccccatatcatagctccggacatgggcagtcgcggccacagccgacgacagcacgtactcattcagaccaaagtcagccaccctgatgagcgcgagggcgtccctgtggcgcccggaagaagcgtacccggacatgagcaggttcccagacacggggttcctggagggcattgcgtcgaacacctggcgggcgaggcctagtcgaccgcacttgacgtacagggcaatgaggttgttgtactggacgacgtcgaagcgcgcggccctgacaaccctcgcgtgaaccgccttccctaacgaaagctcgccggcggcggcggcggcgcggagcacggcaacggccgcgcgccgctggtcgaccgatactcccatagggcaagctcgggcggccgccatgccacagccgtccccgtaaaccccccacccctcccctcccggcgtgctcaagctcctcagccggcaccaccggagttgggaaggaggcgcgggggcgccggagttgggggggagcaggcgcgcgggcggcggaggtgggtccccttatcctgcgcgggggagccccagacaacagcagagaacaccggagctgcgaggaatggtggcgcggccgccggagttggggaagaaggcgcgcgggcggcggggtttaagcagagccgccgccagccgccagagagaaggtttgagtgttttccatgggcctattctgtgacctgtctgttgccggctggactcggcctactcctcctacaaggcatcgtccttcttttcttgggcccaacgccatttcccggtattcccaaatataatgagcattaatcctgtgattgccatcataatcgtcgtgttagagcaaatttaatagtatagcccactactaacttcaaattatctataatcaatataataaccaattaatacaacagttgctaactatactattaatacctggtcctacatgtcatacacacattatgtcttatagtctgtactacagctgactacagatctatagcatgctgctattctctctcttcctttatctctttaaaatacatttattgctggcttataacctgctattattgtacctgctcttacctatgctattacttcgttttcttctacttcccccatcccaaaatgttgcaaccctggaggtaggggtgaaaacggtacagaaactttccggattccggacctattttcgaaaacggaatctgttggtcggaattttttcggaaactgaaacgaattcggaaatattttctcggatacggaatcggaaatgataagggcagtttccgtcggaactcggaatcggtcggaaactttccggaaattttcttggaattaccagaaattttgtgactgaaataccctaaattctttttttaagcactaaatagtgaataccatggtgtttggctgttattttttaaaaatatttgttatgcaaatctaaaattacataagaatatttttttttcctatattgggatttatcaacaacattactcttttaaatatagataatttattcaattggatttatcagtttgaggggttttttattccgataaattttcgttaccgtattcgcgccggttcgttttcgctccgttttcggtttcgataatatttgattccgttttcgtatccggggtttccgattccgaaaaaaaaatgtgaaaacgaaaatgataaaaatggtttccgtctgtttccgtaccgttttcacccttacctagtagccgccacagaacaaaagaaactagtgctcgatgggacacaacctagtactatccagattcacattaataggataggaaaatgctacgcatacgatctttttagtacgatcttgttacgataagacgcaacggcatggatggcagcggaacgcacggcgcggacggcaacggcaaaacggcacgcacggcgcgcgcggcagtctaagcgtacttatgggccctaaagcccaattcacctctaaacctgactttacgttcactactccaaaccctaaatctgactttcatgttctgatctaatctgcaagtgtgaaactaatccaatagcatacgcatcgaagacgaaggtatggcatcttatttacttgatattctttagcttcacaatcatctttttttttacattattctctctttcttttttttcctaggcaatgttcatggccatgaaatgctttctttattattatggatttaatctaaaattttcctttgcaaaacatatgccattatttttaattcaatctgaaactagggttaatgttatcactgtccaaggttcaaggaacatatttgtatgcgtaatttgcttaaccatgccacatgataaattcaatgttgagtgctaagtacgattactatatacagtaagatattaggaagaggattgcttaagatatgattgaaaagaaaattgctttggttggctcattggctgtccaagtaggccaacaagatagcaggccaggacgtcaggagcttgggcttggatatgggatcaactgaggcctgagggatccgtttgatcgtacaaccatcgtacgaaataattcgtacgtatagcagcgctgaataggatactactacgtcttaactagtactacttctgactcaaaatataagagattttagagtgatgtgacatatcctggtactatagatctaggctggcttcctgtctagattcgtagcactagaaaatatcacatccctctaaaatcatttatattatgggaccaagagagtattgtattgttatgttttgggacggagagagtagtattcatcttcgagttttaaactcttcttttttaaagaaaaatgtataaatatctgaatgtatgctatgttaacgagagaatgtatcttattacataagtcttttcgtttacacactatgcacgccaactaaaaaatatcataaaaaattatacaaaaaattgtacatgtactttgattagtattgcatctatgtgtaaagtaatcatcttcaaattcatagggagtaaaaaaaaagacaaatttatacttttaaaactattaatttttttcttttattggttaaaatataatgaatttaaggttgagactttacaaataagtaaattttattggttggtgtacacgagaagacttgtgtgcacagggtatgttacctgttaacgaagcatgcagcttccttaatacaaccataaaactttcgtacatcaaccatctaaccattcaaaatttatttatggtcaaagttaaaattacattagtctacagatatttcaaaaccgaagggaagggaatattaagggctcatttgacatacatggattatatatatatatatatatatatatatatatatatatatatatatatatatatatatatatatatatatttatagaattcagttcaataaaatctctcaaaattgatccattccagaggaggtatatccagcagtaattgtcaatgaaagatatagcattcatctcaacaatttgttcattgttcggtggatctctcatccaactttcatgattgcaagacgaagttggagcctcagttggaatccatgcacaagtgaagcgaagctctggagatcccttagttgtagggaacatatcaggtgcacatatctacattggtgaacaaatgcacaaactgaaccagtatatcttagcccctgtagtctcttcttatacactccagaaatcaagcaaaaggtagcaagagaacaaaattttcctattataaagatggcaaaaaggatatatattctttcagataatggaacagaaaaatcatatgatataggcattggaactatttttccaatccatgaaaagggagtatattgtcattagtctttccagccatctttggtagatctccttgaagctagacctttggatgataggttgggcatatgtctggttggcgtcaatggcgcctcatcatcccactcgtctccccagttgtcatcccactgatcagattgatctgcttctttcttccctccagtcgaaagaggaagctccgccgcatcaagcttctggtatgcaggtccaccatcttggatacctcttctccgaagtttaatgcatgctaccacagctccaataagaagaaaaacaggcactaacatgtattttgaggtaagccgcattggcattacttgacttatctccctcgcaattgctcggtgaatgctaatattgcaggtctcttcagcaactctaagaattattgtcatgtttggtgcaccgttgttaaaaatagtcacctgtgtctaaattaacaatatgaaaataaaaaagaagatcagtacatcgattgaaaacattgaaacagcatgagaaagatccagttccccttgaataaaagctgataagaacagcaatagtatactgacattctgctaatcctgagatacactatcaacaagaactcaaaataagctaatgcaattatgcatgtatataaatcaatatgggaataacctaccgcagttcacgtgaaatatataactcacgaaccaattatatgacaaaacataaattaatgacaccatgaagccaggatcttggtaaagagcaactatccttctataagcttgcaaaaaacagctactctattttgaaacaacacatacagtagatagtacatatgggaaaaaataagccagaaaacctgcagtataatcctctcaaaagctcgctggaaaaactttcatatcaataaagaatataaaagacagtctcttctgaaataacatgtgtggaagtaacaccatgcaaatattgcataaagaaaagttaagccagaaaatctcattactataattatcttcaagatactcatttgcattagctcacctcattatgatcatttgcttggacatggatggtgtcttcagctgaagtgacaaattctggagttgtaataccaacataaagtgggtccatgcctttgttgtccatcagaagtgatagagctaatgaatctgatttcaacggtaacaagttatttatgtgcaaaacatagaaaaatctaattaataagaactaacacgactatatccatatgtgatgcaaaaccttcagagaaaaaacaatgaaaatatatctttgcaaagtattttttaggtaggtgataacatcacaggtacttttgcagaaacattatttgcttaaattcgtcaggggcaaaatttgcttgtgatacagcagttgtattgcatattcaatttggtcccagacattgtgtttttggttagtatagatagctccaactacgcaatcaattgtcacttcatcagcactagtcgtggctataagttgacaatagtgaattgcaattggtcaaaaataattgctgactggggaaaattacagttgcagaccaatttacgtgtcaatctttttatcaacaaacccagtatttggtagcactaattaaggcaaggtcaaatcaaagataaaataactgccataacacaatttgcaaacgatctgtcaaaaaggaaatgagaacttttcgtgaagacaggtatactgctatactacaacaatgatggtgcactaacagagattagagaagactagttgccgagaaaatcaccttctccaggaactttcaagcaggcgatgaactttttattttcaattacacatgtatgagatgggtcacaccccttgataagaggatcttgtgagaagtctgttacatgcgaggattttgctgtgttgatatctttatccacatgatgcacagctgccgcatattttgccgtgctaataacttctgttgatttgtccttcttgttgttcccatcagggtcattctttccttcatcatgatgtactgtattaggatttgtttcatcatgccgtcctgtcttcccaccatctgaatgtgctatgttgttgtcattatttttgtctgcttgtagaatatttgttttatcctaaattcaaaatgaaacaacatatcagcaacaacaatgaaaacaaaacagattatggcatttgttagtcactggatcgaattaagttttcatggtaggtattggtgaattgagctttgactgaccatcacaagttaagtgagagcaacgaaatctttcatgcgacttgagaatcacaaataagtgcacgaactctagagtgcacaaaaaggcgatagagatgcattgccgatggattgaagcataaacagctaccatcaccagcaatgatctcgccatctaatattcaagtcatcccaaatacagaagggatgacagcttttatgtttcgtcagaactaaaatgagccaacgtaagcacaagttaattagtaatcagtaatcattcaaccaagtcgtatataaatctgtgcatctatagccatctatctataccttacttgctccagttacttaatgcaaataatacttacaaatttggaagatattacaccttacctcttctgcggctgcagcaataacaagcaggcaaaccagtgggagcagccgcaggccgcaccaccgcatcccgccggcacagcaacagcagcagcaaagctcgcactgccccgcccccaaatccaacccaacccaacccaacccgagctggtccgcaccgcgcgccgccggccgggccggagatccgggggcagagcggagtcgccccaacccgcgtgcctgcgatagctgatgggttccccggagcccggaggagacgaggaagaggaacgagcagccgcggcccgcagcgacgacgagcatccgacgagaaagcagttgggacttgggaagggggaaggaaaccgccaccggcgactgaaaaaagaaaaaaaaaagatcgcgcaaaacgaagacggccgtgactgcggccaaggaggaaaaaaaaaatgttctttttcgccggccggtaacgcatcactgcaagattcagtgcagtcctaactgggaccgcaagttaggaactgcgtatcatcttagctatccattttttcaatgaacggtctaaatctgatgctatagtgttgctgtcacagtagttctacagttttttaagatgtgaacagtattttatagattttgaacccttaaatttacatcaaaaggtactaggtgactgcttatgttgcagtcacactaggtactgcaccggatctaaatccgtctgcatgtgtccaaagggaaaaaggcaccaaattacttgcagttgcaggcttgctgtattttcttaatcactggttgattcagtgtaaggaataaacatggtgactgtttggagtactaacaccgtgtttagttctaaaccttttttcaaactccatcacatcaaaacttttctacacacataaacttctaattttttcatcacatcgttccaatttcaaccaaacttctaatcttaacataaactaaacacggccttaagttaataatcaccgaaaaggacatcattagaccagagtttttggacttggtgatttactctagtggctctcctttgattttttttagagaaggttattttctacccgacctccatatccaaccggatatatacagccattgagatagggaacttagccccgtaaacaacctaatctgaaattcactccatagaagattttaactcagaacctcgtactacttttgtactactcaggctctcctttgatggggcagtatattactctctccgtttcattttaagtgtaaccatgagtttacatgtccaactttgatcgtccgtcttatttgaaattttttataattagtatttgtgttgttatgagatgataaaacatgaatagtattacttgtgacttatgtttttatatttttttaaaaaaaatttaaataagacagatgattaaagttaggcgcgtaaaatcatggctgtaataagacggagggagtatcactgtatcgtatatttggacacaatcaagcaagtcagtactgagaaataaaaatgatctgtactgtaaatgccaagttaagtacatcagcacgatgtagcacgttgtacttttgtaccgcggatcaggtgcagattcagggaatgattgagtagtctgctctacagccattcactggtgggctgggccgtgggcttcccaacggtccaaggtcgtgcactgcaggaaatggggcccagcccgaagcataagtgcaaacaacagcccaggtaggtggcacacccgcgccactggactgacagcaagtgtgggtgaaacggaagaggaataagttcactttaggttcctctatctgtcggccagtccaattttcgtccctgaacctcagaaccgggtacgacccgtcccccaacttatgaaaaccgggcacataaggtcctaaggcggtttggatagcggttttggctgacgtagcgcctacgtggctggtttgactaggtctccatctcacgtggtactgacgtggtgcttacttggcaattcaatttggaaaaatataatacccatgagacccacatgtcaattacataaaaaaataattaataaaaataattaataaaaggtgggctcgcgtggaccccacatgtcaatcccactcccatctccttcctcctcactccccgtctccccttctcttcgtctctctccgactctcccccctctcctctctcttctcctctctcgggtgcgacggccggcggggtggacggcgtgacaggcggcgaagagatgggtgactgccggcgaggaggatggcgcgacgggcggcgactggcggggagaaggagcgcccggacgggcggcgaccggcagggagaaggggcgccgggacgggcggcggccaatagggaggacgaccgacgagcggcgggcggcgcgcgtgatgacccgggcggtggtgggcagtgaggaggtcgacggtgggcagtgaggagggcagctgccggtgcccgtgacgaggatgagccgacgagggctgggcggttttgacggtgggcacctcgggcgctgccgctccaccgcctcccccaccttgttccggtcgcttccacccggaccaccccggccgaagcctgcagcttgcaaccgctgcggcatgtccggccatcgcctcgagaactgcccgctggagcgtcgtttcctcgccaggctagtagccctctgccagtacgccatgcccgccgtgccggaatctctgcgccgcactgcaagtcttgatcaccatgctgtagtctgtcgcagctaaggcgtcggtcgttgaaccatgacacaccgaagcctgcccgtctcaccggctgacagagaaatcactccttcgctttcacccaatttcagtggctaatctgaagaactctgatgatcccagacggtgaacagtgaactgaaaaactgagtacggagaaacgaacagagtgcaaactcggagttttgggctgcgaattacttgcagcatttgacaaatacgcccaagattgcattatttgtaacaccggccccccaaagcctcgtcgcgctccacacatgtcaacgtcgagcctccagagctcgagccttcggacatgtcaccagtgcagcagcgtggtgttcatgggcgcatctcgtaccaggtcggccccgtcgtgtctctttgactcgtcgtcgacaaggccactggcaaaccgagggccttcgtgttcgtcgagtacctcccacaacacctgccgcaacctcgaccgccacgcctattgcagccgcgtgctccgtgtcggcctcgccgaactggaagtagcagggcgctcgcgcggcagcggcgagccgcacgagctggtgggcatcgaggactccacacacgccgcatcgctcgtgaagggggcaccacccagcgccgacgacagctgtggagacggtgggcgccgtggaggcccagggagacgtcacgcgcaccgctggccgcgtcgccgttgtcccccgccggagccggtcgcccccgccgccgggctaagtgggtccctctatttggtcgcctgctcggccgcccacccgcgccgccggctgcccgggaaggagagagagaggggaaagggaagaagagatgaggaagatgaggaggctgacacatggagcccacgtgggccccaccattttaaaattatttttatgtgcagctgatatatggggccacactttttattattttttcgagatatacttgccacgtcaatgccacgtgggacggagaactagtcaaacaagccacgtaggcgccacgtcagccaaaacagacttcaaacccgttgagggacctcgtttacccggtttacataagttgagggacgggtcgtacctggttttgcggtcagggatgaaaatcggactgggcgacaaatagagggatccaaagtgaacttattccaacggaagaggagaaggcccataattcatagtgggccgtacttgaggactggcccaaattttgccgttcgtctttgcattgcaggtttttctctgaacctgattcggctcttgccgctcacagatccagccagcttctttcaaggcgaaactgatcaatggtactgaccaaaatatgaatattttttttattttttcatgaagtaatgaagagaaaggtaaaattaaataggtggactagtcgtaattggttaagatgaaagagtaagtaaagaaattaaacaagagatacattgtgtttgattgagatgaataagtatgccaagaaattattatattttgagataattttaaaatgctagaaactgctatatcttcggacgcagagcagtagatcatttgtcagattggatggattgtgctactgtacatgcatagtgtttcagactttcagcaggtggagcaaaatggattcagaatgttgtcaagagttttacctattgtttcagaaatcagaactccaattgcagtctgcagtctgcatactccctccgtccaaaaaaaaaaaaagtcaaacctggtttcctaccaacgtttgactgtccgtcttatataatttttttttataattagtattttcattgttgttagatgataaaatatgattaatgctttatacgtgacttatctttttaattttttcataatttttttaaataagacggacggtcaaacgttagacacgaaaactagggttcgtcttttttttttttttttggaaacaatacgatcatctttatggtctttgattgatgaaccagcagtggcgccaatccatccgtggctacaaaagcatgtccacgtaggacaggtgggccccaccggaagcgtctctatttaaaacctcgcctctcactgttcagtgttcagtgccaccaccatcttcttcttcttcttcttcttcttcctcaagactaccaatccaatctcctcctcgccgccatcgcgatctccgccgccgcccgcctgtcgcggccatggcatccaccaagatcaaggtcgccaaccccattgtcgagatggacggtcagtctgatccctctcccattttcccctccctacacggatctgctactagtctccaatggattccggcgtgtcctcaattcgtcatgcgtatcgttttgcgactctgtttgagcttatctttagtctaggttcagtagcgtgccacaggaagcctctcggatctactagatcctttgcattgtgcttggtttggctagaattggggatccgattcgcgatgcgagtttttttttttttttttgaggtggtcgagtgctcctctcgagatatggcacattggcactcacgtgcgtttccggattggattttccgttcgcaggtgatgagatgactcgagta

SEQ ID NO: 46680 - DNA, 1354 bp, Oryza sativa
attctgatattcatgtttctgctcttgctaccttcaggcactgtgttcagagaaccaataatctgcaaaaacatccctcggcttgttccaggtattggaaaacaccagacattattactattttttatgcaatctttcttacacttactgaaatgaaatggttgtgttttcaggatggactaagcccatttgcattggaaggcacgcatttggtgatcagtaccgtgcaacggatgcagttatcaagggacctggcaagcttaaattggtttatggtacgctaccttacgtaccttagacacacataaatggaatatttttcctagctaaacctcataatttatactccctccgtcccttaatataaggaattttgacattttgcctgcactgtttggccatttgtcttattcaaaaaaatttagaattattatttatttttttgtgacttactttattatctaaagtactttaagcacaacttttcgttttttatatttgcacaatttttttgaataagacaagtggtcaaacagtgcaagtaaaatgtcaaaatcccttatattatgggacggatggagtaattgcaacgtagatggtatagaccaattggcatgaattagatttttacctttttactttctttttttcctactgttaagagggaaaagatgaggagattgagctggaggtgttcaacttcactggtgctggaggagtggcacagtctatgtacaacactgacgaggtacagcttgccactttctattgttcgtttcaagcatgcgtatgtcattttttttttgtgattcatgctcttagcgtttgattttgtagtccatccgttcctttgctgaggcctctatggccactgcttatgagaagaaatggccattgtacctcagcaccaaaaacacaattttgaagaaatatgatggcaggtattgatgtttctagcctattctaacactgaccctttttgcccttgctgtacctttgccatcgtataatgcaattatgcattggtctgactagttgggatttatttgcaggttcaaggacatcttccaggaggtatatgaagctcagtggaaatcaaaatttgaggctgctggaatatggtacatttccacatttccttttctttccttgatttttcatcctggtatctagtgtttggtgactttggtctctgtcaggtatgagcatcgtctcattgatgacatggttgcctatgcactcaagagtgaaggaggctatgtttgggcttgcaagaactatgatggagatgtgcagagtgatttcttagcacaaggttatatacccaatttcttgcctttgcaatttgtactca

SEQ ID NO: 46681 - DNA, 7472 bp, Oryza sativa
ctgctaacatggacccattcttgttgttttccactaggaaatggtccaaatgattgtttgaaatttcctgcatatactagtaggtggttcttttacgtagcacatatgatttttatcttgttcaagacattgttcgtcaaagctccttggtagaatggtatatcaacgtaccacctagtgccttgacagacttccagctaaatggcatatatctcattgctggattcggatcagcttaagcagtagtagtgcatgctattggatgcaaatcggatgatccagattgcatgctgtactgtacatagtactgtagcaaaatactgtagcacgaaatactgtagccattactactgtagcgttcgatctgaatcgttgaatgtaaaaatggatggccaaaattatgtgcagtttccccattgctagatgttacaacctcttttctagaacttgctgcaggattgcttctgctgtaactacactacttccatcattgaacaattagtagcatttcaatgacaaattgaccctgatgtgcagatcaaactccagtcagtgaagttagcaatgaaatacctgaggagggtttcctctgagcttgaggccataaaagatggccctgacgaagaggagctgatgcttcaaggtgtccgattcgccttcagagttcaccaggtactcaatcagaacgaattcactaataagtgctcatgcagcactagtgcataggagtactacttatctagtttccattttcttttcacgaacacttatcaactttccgtagctcagtatggtattcaatccttttgttccatgcagtttgcaggtggattcgacggtgacacgatgcgagcatttcaggagctcaaggagaaggcctccacgttccaatcgcaacgggaatgccaaaatcagcatttgcaacagcacaagctcgctggcagaagctgaacgcctgaaacgatgtattatataccactcctttactgtaggagtataggatatatacccaatgtatcaatcaccatggaacaattttctctcaaaagtatttatttctctctcctcttgatctgtactgtggctgggagtccgggagtgaagtattaacaacagttactttcatgaattgtgttcatgtacaagaaagactacaggtgactcccactcttgtgctctaatttctgaagacagaactacagagatcacacagatcagacaaactgcatttgagcaagagcacagctgaaaagagaaaactgaacatttgctcacggagtcatgagtcatggatggagagtctcgcagggcaagctcttggagctagagcttccaaccagcagcttcacactggtcaggtccacggacgccgtggctctgcgcaatatggacttcatgttcctgtcgaggctctgcttcactatcctgtccacggcgttccggcgatccttggccccctcgccgccgtcgtcgcacgacgccgacgacgcgccctccatgcgagggccggagtgcgccctgatcctgtcctgcccttcctccttgaaccactgcaggatcttggccgccctcctctgcgccagggggctcccgaggagggacacctcgaggagcgcctgcacgacgccgaaccggcgcatccgccgccgctgcagccggctgccgtgcgcgagcaccatggcgaggtacgcggcgtgctcctggcaccgcggagcgtcgtgccacgtcatggcctccacgagcgccctcggcgccgcctcgtcctcctccatctcctccctccccgccgcggtcgccgccaggtcgccgaggacggacagcgccgcctccgacgtcttccggtccagggagagcgccaggagcgcgcgcaccgcgccgctcgacgccacgtcgcggacgtgctcgagcttggccgagaggttgtggagcgcgcccaggcacggcagcttcgtgtcggccggcgcgtcgtcggcgctgaggacggcgacgaggaacgggaggagctcggaggaggcgagggggaagtcggtgttggccagggaggagatggagaggaggaggagcgcgagctcctggcttcttgacatgtccttgtcgtccatgagcaatggcagcttcttcagaagaccggcctgcacaatgtgcaccttgtttctgaaaaccaaaaagcattgctacccattagcagagaacttagatgtcacaactactgaagaatattcagtgcaccgtgaactattgaatacattagaaacagaagtaaaagtcaattacaatataaaagcaaacatgaacatgattaaggtgaaaacaaatgagaaatgctttctcatgtagcaagcactacttctcctgcagttcatgcatcatggtctactagattacacctttgtttcatatgcttccacgggtgtaattgatgttagaaaattcaccattgtggaatatctgatcctacatgatgttgtataggcatatgaggaaaacagaggggaattcagtgtcagtctacatcaccacatgtaaaactgggattccatattcctgagtggaatcacacatacgagaacatgaggtctactttttctacagcactactccctccgtaaaaaaaaaaaaagacaaaccctgggtttacgtgtccaacgtttgaccgtcttatataaattttttttataattagtatttttattgttgttaaaatgataaaatatgacttatactttatgcgtgacttatctttttttttcataatttttttaaataagacgaacgatcaaaagttggacacggaaacccaggtttattattttttttttttggacggagggagtactatacactatcaacgcagtcacatcagtgatgtcacacggctgaatttgcacaccatgaacatgggcggctctatagccatatccacatagaaaatgcccttttatcatgcatgtccacacatgggtctatttagtgttcttttcgtagaagtgattcaaacaacgaaatgaaacacatggttaggcacacttcggtacgattctctcaagaaaacaaggaagataatatgtaagaactatgaagtttggtattgctccaagtcaatcttcagcaaccggcctatgcataatgcatgcacctgccgaatattatatccctgtgctgcctaatactaccaacgaacaatgctgaattttgagtcgtgtaaagttctgacattttgttcctggtcaatgattctgtcatgaagcaatggctttaagggactcaaagaaacaaaagtaggctcaaccacacctaatgcctacagaaactagaatgcaagaaatgatgtggcgtgtgtggctgttgtgcatgttcagatgttgttatggaactattggacaggctagagcagctaatatcactctcaattcagagattgaaagcaattgttgtcagaaatgcttgtaggttgagacatagtaaagctagctagtttcaagcctgaattctctgccagagacttgcagtatgaaagttgtatctggtctttgcatggtccagttgctcttagacattcagatcatggtgaatatgtcagtatcgtggctatagtgcagtctagatacgtggagatgtaacaaccaaaacgtattaaattctacttcttcaagaagagcgtacgggcagttgagtctcaagatcaactttgaacagcaggatcaaggctatgtgcagtaaactagtaaagttccatgctaattttctgctttagaaaaaggtttacatgttaattaacttgaacttgttggaacagcgtagatcatgacaagtttaaaaactaaccgaattctcagcatatacgtttccagagaaggaaagcaggataactcagccaaatgtgccaagttgatcaagaagatcagagcgcggcgtttccttttacagttctactcattgcaagaaccagtaactattcttcgctcatgtttggtccatgctttacttatgacaaaattacgcaaagcgtaattcccactcggatttaatttcagaacaagatcggtttcaacttcatttctctactgtatctctaccctgagaagttgcacttcatttctcagatcgattcacagaacgaaggtgatgctcaaaaaacaggttggcatccgaagcatgaactgaaagtctgaaactgaataacggatggctcaagcaaatcgcaaattcgcaacacacgggaagatatactactgacctgtgtgctcccctggcgagctcaagcagcgcccccgccgcggccatcctcgcgccggcaccacctcccctggcgtcggcgagcatcgagacgagcggcggcacgacgccgagctcggggagcagccgcttcctcccctcgtccgagcgcgccagcctcccgacctcccccgcggcctccgccctctcctccgccgtcccgaagctgagccgcttcaccgccgccctcatcctcaccgccgccgcggcatcatcgcccgctgcctccatgccgatcgatcgtacgcggccagcctccggtgcatgtgcagctgcgcgctacgagacgagacgagacgacgcagccgtgagacgcgaggtgggttaacgtttttttcgcggcaaaggcgcggggttgggttgggttgggggggcctcggcgtacggtggtttttgggggaaaagtgtgtgggatttgcgtggttccgggcgacgtggagagcacttgggggttggggtcgcggggggttttggggctttgcggggaaaaagcttggtgcgtgcggctttatcacgggccggtgagccgcgctgtctactagtgttggtgtcgatggcccgccgcctctatcaaccggcctaccaccgtaccaaggccgttgtgatctcatcacactacaattttacaccatgttttagtatggtttttttgtgtgtgtgttctttgatcataaactgtttatctgcaaactgcaatggcatcatagagtcgtgtccttagttctaaaattctgtctgcgtaatcattttgttctggcttaaacccgcctgcacacttgatgactatgatgatgctagtgacatcgtcgggaatccggtcgttggatatatcatcaaatctgcttaaacccattcgctcttaacttttgcacactcctacgtgcttactgctttggcatttatgatgtggccgaagctggccgccgaactcaagatcgctactagtaccagtgccgctacatcaggcgtatttccgtttgctcgatcggaccttgacagcgttgtaaatgctccaactaattaaaagaaagttcaactcaaatgcaacctttctaaaccaactaaaggaaagttcgactcacaggcaacctttctgaacatttcgatcgatagccccacactgagtaacatcaatcacgtacaaatattggagcagatcttttggtgcaccttggtaggctggctagcttgagcatgcgctgatttgataaaaaataaagaggcaaatgctaatatgggggtggtggtggtggtctggtgtgggtcggctggatattggatagaaaagaaaggcaagactatagtggagcattaagctatgattactccacttgatgataagtggagtgcttggacaaggactaagcccccgtaatcttatcctgtactactgctaattgtgtaccacgtgggcgtacgtgctcatgtgcaacgagttggcactgtaccgaactaactgatgaacaaacaagtgtacgtgcatgagcatgcatgatacttctatcatgtacactcctgagtaattgacctgtttctgacaaagtttggcaacgttactaacagtactgaagtacagtacgcatgggggtattatgttaaaaaatccgaatgggcctcaaatctggcctggttaagatcctctgcctttttttattaggccgagattgaggcccatataaacaaggccttcacgggctatgtcgctctgctgctttttatcgggccatctccaatactgggctaaatagaagtccacactctccgctctgtcgttgtcggagcggatccatgtgacccacagatatatccccgcgacgcagccaccgattgtgactactgtatacacacaccggtgcttcgcatcgcagccagggtttcacttatcgcacgataatcgcgacgtagccaccgattgcgactactgtatacacacaccagtgcttcgcatcgcagccagggtttcacttatcgcacgataatcgcgcgattatcgcgcttattgcggggatacggtagaggaaaccggcgatatggtttggatgaattttgaccaaattcaaaattccgaaaaaaaatcaaaaaaaactgaaaaaattcatggatgtagttcttgatttgtaattgccaatggtgaagaatttttttaaatagagtaagataaattcaaatttgaggacaaaaccaaaaatggtttacagattgaaaaatgaagaggatattggccttaagtatcctgcatatttttgattattctcagtttctagttttctacacatattcaaccgtatttttgattttttttaccctatttattttacatttacattatttcagctacacagcccgcgataaccgtgcgaatatcgcggtaaaccgtgcgattatcgcggtgaaaccgcgaaaccgttgagttttgaattcaaatttttggatgtgatttttgtgcgattttagacgattatcgtgcgattatcacggttatcgcgctaccgcggggtggcgataaccccgacccaaacgataaggtaaaccctgattgcagctcacccctttcgccaacccaaacggccaccgatgaagttgacacaaaccctagcccaaaatcgcacatcgcttcacgtaatctaccgtaaatgtactttctctattaaaaaaaacaaactctaactatatatctgaacatacataaaaaaaataaacatagctagaggcaaatgctatgatatatgtctagatatataacgagtcttttttttaaggacggatgaaatacgttgcaccgttgcacgagcacgtattattttttttcaaaaaaaaaatagcttgacttgctcggctcgcgctcgcgcatctccatgcgttgcacgctgaaaccgacaagttttttttttacgcgctgctcgccgccgcagccgtgcacgtgatcccatccccccaaggacgtgggtgccacgtccgcgacgcgacccgctggcgctgtggccccacacgcctcgacgcatcgcagccgcaggattcactgattcactcacgctgtgggtggttgggaagtttttcacacaaaaacgagattgctcattactagaacataattaatcaattattagttttataaacttaaaatttgaattaatacgattttttaaaatatttttttataaaattcttagagaaacgtaaaaaataagggagtagaa

SEQ ID NO: 46682 - DNA, 1239 bp, Oryza sativa
ccaccctcgccttatcccaccccaaaaccctagccgccgccggcgccgcggcccccaaggccccgacggcgccggccgccgtctccttcccggtctcacatgccgcctgcgcgccgctcgccgcccgacgccgcgcggtcaccgccatggtcgcggcgccgccggccgtcggggccgccatgccgtcgctcgacttcgacacatccgtcttcaacaaggagaaggtctccctcgccggccacgaggaggtccgctcttcttgctcccgttcctccctttttctggattacttctctctgttttttctcatatgcgatttgtttgtctcgctgaaatgttctgtcacgcagtatatcgtgaggggtgggaggaacctgttcccgctgcttcccgaggcgttcaagggcatcaagcagatcggagtgattggatggggctctcaggttcgacaaaaagaaaaaaaaacgctttctttcttgccttcagacttattttcccgttccatttagatggtcagtgtcgtggatgtgacatttccaatcactggttgatcaattgcacaacaaattgcttgaataatgaacaaattgatgtgaccaatgtagtgaatgggttgacaattgatttttactacatggatttctcatgctactcgggttcaggacaagaaaaccacctgtattgtgcatgacagagttaccgttgctttttcaggggcctgcacaagcccagaacctgagggattcactagctgaagcgaagtctgacattgttgttaaggtactcttatcttgtactgtattctcagttttcattcataggacactttttgcaatactttggtatgcaaatcgccctgttaactgaaagctctgaaccatggtttgaagcctcgactgaactaatattcgttctcctttgtatatggctagcttgttaaggtgcacaggctacaactgaataatccattcttattttgaaaaataattcgagttatacaatttgtcaatttggacattctaattcataagccattatatttttctcctcctcacttatgtacctttgcattgtcctgctagtccaacattctattccgccgtttcctttcagattggtctccggaaaggctctaagtcatttgatgaagcacgtgctgctggctttactgaagagagtggaaccttgggtgatatttgggagactgtttctggcagcgacctcgtgttgctgttgata

SEQ ID NO: 46683 - DNA, 11044 bp, Oryza sativa
agtggaaccttgggtgatatttgggagactgtttctggcagcgacctcgtgttgctgttgatatcagacgctgcacaggtttacttcaggctctagctgcatgattttagttgccacttgatgttgttacttttaccaatgcttgtttgaattgtgctgaatttcatggttctgttgtttcatggtcctgtttattgaattgaatctcctagttttattgtgccctctacccatttaacattttctatatgttgctttctcttcttacactttgctgtggtgttctgtcggtataatttttcttttcactttctccaggcagacaactatgagaaaatcttctctcacatgaaaccaaacagtattcttggtttatcacatggatttttgcttggacatttgcaatctgctggccttgatttcccaaaaaatatcagcgtgattgctgtatgccccaagggaatgggtccatccgttcggaggttatacgtacaaggcaaagaaattaatggtgctggtatcaactctagttttgctgttcaccaggtaagttggtttcattgaaaaacatattttcaattatagattttgtaaagacattcctctgtgcttatgcactttttttgcacaggatgttgatggaagggcaactgatgttgctctaggatggtcagttgcgctgggatctcccttcacatttgctactaccttagaacaggagtacaagagcgatatctttggggagcgaggtgagcctactttcctgtttatgttgcatttggtgattgcactgtagctaatcagttagtgtccaggcattcttcttggagctgttcatggcatcgtggaggctctgtttaggagatacacagagcaaggaatggatgaagaaatggcatacaaaaacaccgtagagggcatcactggaattatctcgaaaactatctcaaagaaggtacacaattattgatagttttatcatccctctttgttgttcacttataagagtatgttttaaaaaccagggaatgcttgaagtgtacaactccttgacagaggaggggaagaaggaattcaacaaggcctacagtgcatcattctatccttgcatggacatactctatgagtgctacgaagatgttgcctctggaagtgaaatccggagtgttgtgttggctggacggagattttacgtaagttattcctgcctaaagttcaccatacttttcttcgattgtttagtctggagttctcagagagagtaatgcctgtaactatttgttaactcattggctatgcttccacaggagaaggaaggccttcctgctttccctatgggcaacatcgaccaaactcgtatgtggaaggttggtgaaaaggtgcggtcaacccgaccagaaaacgatcttggccccctgcatcccttcactgctggagtctacgttgcactgatgatggctcaggttagtcttcccataattcctcgtcaacctctcatatagtgacaaaaccaactgacaacagtatatgcttgaatcaatagcgctcaattttccaatctgttttgcaatgtttgtagatcgaggtccttagaaagaagggtcactcctactcagagatcatcaacgagagcgtcatcgagtccgtggactcactgaaccccttcatgcatgctcgtggagtggccttcatggttgacaactgctcaacgacggctcgtctgggatcaaggaaatgggcgccacgcttcgactacatcctgacccagcaagcattcgtgacagtggacaaggatgctcccatcaaccaggacctcatcagcaacttcatgtccgaccccgtccatggcgcaatcgaggtgtgcgctgagctgcggcccaccgtcgacatctccgtgcctgccaacgccgatttcgtgcgcccagagctccggcagtcatcgtagagtgagataagataatctcaagggagcttgcatcttgttacagtttgtccgagagtattgtatgtgtgtgcgtgactgtctgaacttgtgagcttgccatcaggtgacctggaactggcctgagcatctttttcccgaataaaatgaggcccggattctgaatacttagctttctcaataccatatactccacttctctggacagattcgtaataatagacaccacggtgtgtctagtcgagtactagactaggctcttttgatttatatgaaaaacatagaaattaattttaatcctataggaaaactttaatgaatttcttcgaaacaaacgattgaatcatattctatccttaaaatttctacgcaatatacaattccatagagattgcaagggaaacccattaagaaagaaaactcattaagagctttagtcattttgaaaaaaaaaggtctatatttctctcaattgatttatgcgtattttctatggcccaatcaaatggttatttttgtgtttttcacgcgtttataatttcacctacatttacattcatctcagaattctgtttttttttcttttctatcgttttctattccaacaatttaaactcctaatatattttaatacggaggtaggagtgagcagtgaaaagaacgtgtgattccgccgaaatctcgacgccgacgctcccagccggctcgctgccggccatcggtattgtcaaccacaacatctgcgagtctgcgacgccgatgcgcatgcaaacaccgcgctaaactcccaaaaccaacggcaaatccgatgaaaaaaaaaacaagaaaaacagcgcttgccctcacctacttaaaccaccccaacacattgttcacagcccacacaccaccaagatcggcgagctagttagctacatcgatcgaggccatcagctagccatggcggcggagagggagggagccgtggtggcgaagggccacgaggaggggatgaagatggcggcgtcgctgctggaggagttcggcctcccgctggggctgctgccgctgggcgacgtggtggaggtcggcttcgcgcgggccacgggctacatgtggatcgcgcagcggaggaaggtggagcaccacttcaggatggtgggcaagcacgtcagctacgacgccgacatcaccggctacgtcaagcccaggtgcatcaagaagctcaagggcgtcaaggccaaggagctcatgctctggccccccgtcaacgagatcgccgtcgacgaaccctccaccaccggcaagatccacttcaagagcctcgccggcgtcaccaagaccttccctgttgaagccttcgccgccggccagtagccatatgcatgcagcatatatacatgcttgttcatgctctacgtaatattcttactgctatgtatttcctctgtttcaggttacctttagttaaagtccaactattctaagtttgactaattttatagaaaaaagtagtaatatttttaacccaaaataaatatattatgaaaatttatttaaaatattactatctttttataaaattagttaaacttagagtagtttaaatttgaccaaagtcaaaaacatctcgtacctgaaacgaagaaagtacttattactatctcgtttttcttttttaaacgagccgcacgacacagcgcgaggtttcctcctcctactactgctgtgtatgcatgcagtcacggtacgtgatggtaagttcatggtgagagttgctgggtatgaaaaatcgtgagttgcatttgctgcgtagagtggggagagcgcatggagtttggtttggaacttgttcggtttacatggttttcatgaaaccttaaattatgctgaataaagtttttaataatcccgtgctaattaagccatatccatacatgatcaagtgatatgtagagagacggatgtacctcaaactcgtaagaataaaagaacctgtgaaaaagggtggatgcgcactcattctgtatattgaggttatggaggtcgagagattttctgaaatatagtatcagataattaactaaagcgcgccgtcaagcagtattagtactactgtggaacagttaatcaaagcaatcaggaatgttacaggtaacaacgtactgttctctttcaatgtgagaacaataattaatgttgttgtgaggaactggcttctcacaaatcacagctagccgtaattgagacttacaggtaactactactggccactgggaagagaaaataaccgccaacccgggttaattaattgaaaatggagcttatcacgtaatcaagaatgactaagctaataaccttcggttgttctttctgaatatattttttggggtttgtcgttttgattcaaagcggcaaatccagttcaccgtggcttaattacctctatgctctatcatgcacgctagtcagtcttctatgcagaattttttttttaaaaaaaagttttaacgagctccgatccatgcataatgcatggccagaaaagaagcctaaattttgttcatagtggcacagaaagtagatgaaacgatgtgttattcatagattctgacctaaatttacaaagtaaagaaaagggcagaaagattgaaagaacattagaacagctagggtagaaatgaagaggaactaagattaagtaatttactaaaaaataataattgaagaggtagcatgcaagttatgctatgcttattcatgcagcaatagcttctttattagctgctcttcttttcgctggaggagcctaccttgtgatcgccatggcgactggcctctctccctgagccaaacctctgggcactattcagctccggtgcatcgccggcgacggcgtccttgccggtgagcctctggacgacggacttgaagtcgtcggcggtgtcggcctccacgtacaccgtctcgatgatcttcacggtcaccggcttcgcttcatcctcccctgacatcgaagaagcgacacaccaaacaatcacagagagaggatgataatgggcagcttagctacagtttcttcaggatgaggagaaccgaggaagaagaagaagaagaagataattaagtagatgatgagccgtcactggcagaaattttgactgtgattttggacagaacttgaataagaggtagagagataggtaacacaaacatcgaactactcttccttctcggtgcacttaatgacttaaatatactacggtagatcatgtagtggcactgacttgtcatcctcactcgatatactataattgaatcagtcatgaaagcccataaaaaagtacagctttttcaggctaagtatgatattatatcaactcttaaattatgagaccaacgaaaaatggtgattttcatgacggccacacgtgttaggaatatgcattacgcatgcagttggcagtggtgctctctggatttttacggaggaggaagaagaggtcgaggtggtttgcattggcgtctgctctttgggccccgtagttgacaagctaccatggtcaacatacgttacatcagctttactacatgctgctgctgtttgttcttcagtcaataccgtgaccgaccaagacactgttaccgctgtttttagacctgttcaatcataatattgcagccaacagacattggctgtggttagttctttagccaaattttttttaagtatacggacacacatttaaaatattaaacgtagactaataacaaaacaaattacatattccgtatgttaactgtgagacgaatttattaagcctaattaatctattattagtaaatgtttactgtagcaccacattgtcaaatcatgacgtaattaggctcaaaagatttgtctcgcaatttacatgcaaactgtgcaattggtttttttcagccacatttaatgtcccatgcatatgtctaaatatttgatgtgacggaatttttggaagtttgaaaataacttaacaaggccattatcaactataataagctgcagaggtcgcatcgtaaatagcgaaacttcaaaaggatgtgtcctttactcagatagtagaagtaacattgcagagctggtctattcaagcggtgcagttctgcagttgtttggtggcatgatagagtttttaatgtttgtaaaagtattcaacagattagaattgaatttgaaacccaactttgcataaacttgtgtcagcatcacacctgcttgcgtaagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttagaagcatcctgcttacaacataacaggatgctggagcgttctttccctaaaaacgatggttctccttcctagatgctatcacactcctcgtcctacatgccttcaaactgtcaagaaaataatgctccagtgagatttgcttgcaccattatattcatccaaaaataacttttcaatattactaatatggctaccaatggttaccgatcaagaatagcaggaaaaccaaaagtaaggggaacaaatatatcatgatacagaaatggtattaaaggttgaaaagcaaaaggaaagaaaatgcatggctcaacaatgtgcaatctagaagtgattgatttttgaaaataacaagtttatacaaagtaagccagcttccatgaaaccttaaaacaaaaccaggctttatgtttggcttttcaatccatttttataccagaaccagtcaaaggctagcctgactacagccctccaacaaaatcacagacccataatgcagcagcagaaataacaggttatgaatatgtttacagcccaaacgataatcttagaaactaaaaaaaacagttaacattttcacgctgctgatgcatcagctagtggcatactggcatgaatagaagaatggtcaaaacaatgagagttttgtgcatattgatgtagcacttgcaaaaaagataatacagcaagttgtagggaaaaatatgtgaatgtgtgcttgacaataaagaaaggcagatggtagtgcaatgtttcgttttattaaaacttggcacaaggaactatatattaccgatgatccaggatctccattaagtacaacatctttctttactggcagttcagaagctcttgaaccctttgtgtcaccctagaagatcaacaagtaaattgaataaaccttcattaacaaaacttaaagattaacaagtaatacaacatgggaaatacctccgtcttcagtaccatcaagggtaatcaacggccgttgttattcatgcaagaaaggggaaaaaactatcagtgcacgtaaaaatttgtgtataatatggaaaagaaaacaaaggaaattatatcggtaaatatctttttctggaggacaatgaaacatccttttgttgtattttatatctcactagtgattgaaattaaaaatatatgctgatgaaaaaaaatcaatcttggtccaggcactaatgtcagttcagcaaaaatgttacatgtcttcagcataaatgtagttcataatctgacaattgcaagtttgcattggcgttcatcagatatgtagctttatggacataaaacaaaattacagtccatgttaacctggccactctgccagcagcacgcctacagatggaagactacggccattttgaatcggttcatgccaataagtacaaagaaaattccacctttacagtgcatgccctggacctagaaatattgggcgcttaacattcaggcagcacattcaacctttccgcaatctactgttggcaactaaatcaaccatccatcaatttggagtgaatcaacccatgtgacagaccaagtaatactaagtcaaagccttgatataagtacaatcacgaaagctctctccttttgcacgaatcatggcctcatggtatatgcacaatccaatcagtgcagagctcgtatgagcatcagtctgtgtatcaaaagcttaggcaaactgtgtgcgaatatagaagcctacgcctacctaatcgaggtgaaccagccttcacttcccacgtagtaacatatgcatcactaggcaatacaatactaggaaacactctggaagagagaggagaggaacaatacctcccggtagagcctgaggtagagcttgagaggctcgacatagtcctcgaatccgagcgtgcccattgaccagatcaggtcgtccccattgatggtcttgcgcttctccttgaggcacttgtcgcttgctctgcagggaaagatgccaaagatggccgtcagtcacccttgccatctgcacggcaggtgcacgacaaaatgcgccgccgccgctccgaactggatcggatcaagcaagctccggcaccgatatatacagcaaatacaaaggcgaggcgacactgactcgctggtgatgaagctgatgaactcggagacgcactcctggacggactccttggagtccttggcgatcttgccgttctccggcacggcccggcgcatgatgcggccgatgttggcgatcggcaggaaccggtcctgctccttccctactccgcctccgccgccgccgccgccgttctccgtcccgtcgaacccctccgacatcgctgggccatggcagaggtcggtgagaaggagagcgactaccactactgctggtgtcaagggaaagttggtggcttaccttagtttttttaggcggagatggacggagatggcggaggggatcagcgccgttggttggggaggagggagagggaggaggacgccaccggccgccggatctcgacttgtctttgtgtttgactccgctggagacgatgctgtgccttgcctttgcttagatttcttctctttttcaacttctcttcccctttttttcctcgctctccgtttctgcttctctcgttgcagtcaaaatgggccgaaagggctagatttgttggcaagtatatgggcccgatcgagtctgctcggcccatcagtaaagtagcgggctaactgcgccggtagcgtcggcgacacttgtgtacggcggcgagtcggtaagagcaagtttaatatagccaactgatggctccttatcatctatagtcaacttaatagtcaatccattacctataaacatatactacataattaatatttagtcccacctgtcatacactcacgtgtcttagagtccgtgctgcagctggctacaaatctgtagcacgcagctcttatagctggcttatagcctgctattttacatgctcttaagcaggtacaataggagagctataaacacatctcgagtagataaaaaaggagatagaagagtagcgggctatagatttgtagccagctatagcacgaactctaagatacatatgtgtatgacaagtgggaccaaatattagtagtgtaaatatatgtttataggtaactattgtataaattggctattaagttgctctaatagtatagccaactgttgactctaaatcatatatagttaacttaatagacaattcatataatagttatatataaatatatattacataattaatatttggtcacacatgtcatacacacatgcaccttagagtatgtactgcagctggctacaaatctatagcccgctatcattctctcttctcttttatcttcttgaattgtgtttatttatagcttcccattgtacatgttcttaaacttgctctaagttgacaagtaagttctcccaaaaacaagaaattaattaatcccataagtataagatatgttaaagtgttaatccttcagacctaagtacccaactctacaggatcaagcaattaagtatcataggccggcttcccaaatgatcacctgaccatacacatagtgtgtgtgtatcgtgtcgctaactgtgttttgtcctggagcaccgtatgcatgttgcatcatagatacatatagccccatgcatgtggccgaattaatgatgaataaacatgccatgagagtatatacgagacatacacatgtgcaaaactattatattactgtatctcacaggagaatacaggatgacatcaattcaggactagctctcgatcgagacacgttgcttagcagcaggtgcgtaccactcactgttctcctaaacaatgacgaggaatcactggtggagaaaccctttatagtcccggttcgtaacccccctttagtcccggtttccaaaccgggagtatcaatccgggactaaagatcgctatctttagtcccgggtgaaataaccgggactaaagatcgagctgaccttttttttttcatggccctgttgctattttataaaaccttgtttagcaaatgaactaaatttctatatattctttcttccccacacacattttctctctcatcaacttacaactaaattttggagacaaaaaagtgtgcaaaacataggtgcaaatgtagtatgacaaaaaaaaacattggaggataaagttgcaaaccttttaggcacctccgatttatatgtaatcaccaaaataaattcaatagaaattttggcatgacctcccctcttttttgaagaaattttgaagcttgctcggacagctggaggaggaaaaagacatatatatataggggtgagactttagtcccggttggtagcaccaaccggggctaaagatcaccgggatctttagccccggttggtgctaccaaccgggactaaagtctcacccctatatatatatgtctttttcctcctccagctgtccgagcaagcttcaaaatttcttcaaaaaagaggggaggtcatgccaaaatttctattgaatttattttggtgattacatataaatcggaggtgcctaaaaggtttgcaactttatcctccaatgtttttttttgtcatactacatttgcacctatgttttgcacactttttt

SEQ ID NO: 46684 - DNA, 14910 bp, Oryza sativa
tttaaattttaaaaataaattaatatgattttttaaagtaacttttctataaaatatttttgcaaaaaatacaccgtttactagtttgggaaacgtgcgcgcggaaaacgaaaccaacaaactcactcccttaccctctcaaacgctgcctaagtatgtagagtaccatcaagcgcgtgtaaaaacgtcgctttatatatacatcgcgttagttataccaactcgatcgtaaatagagtacgtgtttgtgcgctaataaaattccgtgtgggtcgcgtcatatgcatcacagtcgtcatgatatcacccgggtggccggctgccacgcagggccacgtacgcgcgcccacgcgtgagacaagctcacgcacagcgcgacacggacggccaggtgcgtgcagtggccagtggagaattaaggtcgagtttactttcaaactttttcaacaaacttttaattttttcatcacatcaaaacttttctacacatataaactttcaacttttccgtcgtatcgttttaattttaacccaaatttttaatttaaacgtgaattaaacacaccctaacacaaggagaggcacacgcaagaagagtatcgatagatgaggtgcggcggagccatgtgatcggcggtccaaggagcaacggcgcgcgcatcgtcggcctctcgtcgcgtggcgtgtcgcgtccggttccctggtcgggcggccggatgacggggcgataaatggggcgtcaccgaatccgtggggttatgtggtccgggccagaaacccggcagcataacggccgatccaacggtttaatttgttgtcagcagaagcaacggtaggcccgggggagtctgggcttgggccgttgggcgggccacatcgggtagttgcgatggggtcggtgtgtcacacacaaggttgttgctctgtgcgctgctccaactgatagtagataggagtagtcttgtttataccaggcaggtttcagtacactctagtacccactccgttccataatataaaggattttaagtttttttcttattttatttaactactcgtcttattcaaaaaatttgtgcaaatataaaaaacgaaaagttacacttaaaatactatagataataaagtaagtcaaaaaaattaaataataattccaaattttttgaataagacgagtagtcaaatggtacaaataaaaacttaaaatcgcttatgttataggacggagcgagtagtacactctctcaaccgttaaccgtttaccggttgcacccgccatcacgacgccgcccgcgccgaccaaaccggcctgttccccggtcccgcctcttgatggcgacttggcgcgcgacctcggattgaacccgcaagctacgggcacacgcaggctaatagcgtgctgcgtgcggcgtgccgaacccacgacgcgggcgttggcaactttgcaggcagaagctagctagccaaattcgtgtatgccgcagtgtcactactcactagtgtggcaggtcggttcgatcaatccacgtacgcatcgatcgccgtcacgtacgccggccacctctatgtataatctctccaccaccttatgccgccggccggagcaatgcaaaagcggctgtctactcccgccccggacgcatcctacgggtgtgttcgctaccaagggatgggaactgtgtacggtgcgcaaggaaaatagatggtccattagcacacgattaattaattatttgttaattttttttttcaaaaatgaattaattggattttttaaagcaactttcatatagaaactatttaaaaaaacaaaccatttaacaatttgaaaagcgtgcgcagaaaaaacgagggagaggagttgagaaaagtagcatccgaacacacccgtacctacacgagaacccatggggttatatggcttgctccctccgtaaaaaaacgaaaaccctcacatcccctcctggtagaatgaatctgaattacccttttgtccaaattaagtgacctagcatgcatgccatttttaagtttttttcggatagagggagtacctaacatgcactgcgtccgagacctatgtgaccgatcggaccatcgggatcaaaggctgagttttccgacaatacaccacttcctgaaccgttaaccgatactgtcttcgtattatgttgcaagtcattttttttcaaacttattaaatattgaccaagtttataaaaattaaaaacatatatgtcagggttatgaataccacatacctaatagtagttgattaaatctcggtaggacccactacataccatgtcctatacggaatcaaccttcgaatataggaggagttccggataagaaaagacaaccagagttctacatgtaaacgacaaggactacttagattgtatccatattgttttccctagttttacttgaacaaaagaacacctatgggtataaatacaagcccccctaggaagagaggggagacgaggaacacccaacacaatcgacatagaagacacaacataaaagcctacatacgccaagacacgctgccggatatcgacttcagggataagcacgactggtaccctacggtgtctccggatactgtcaggagagacgaaagcgctatctctgatctcgccgggcacggattcgaggaggaaagctaccctgttgtcgactacgagtcagatcatcagaccgccaggtcgacaacagttagataggctaccccaaatattgtactggtgtgattatcataaataagagcaataccggcttcggccaacaggatgtagggttattacctgacaattcaggggctcgaacctgtataaaaatccctgtctccatctcttttaactcagtctcgcgtatattctagtaccaacgatccccataccatgcaaataccgtagtcgagacatcaaacgtcgacattatacaacaccaaattaatttaattaagattaatattaatatattttagtagtatgcttattttgtgttaaaaatattgttatattttttataaacttggacaaacttaaatatttttattttttactaggatggaagttaaagcgagtatattttatttatatatagaatttttttaaataattaaataaatatatttttactttatattagttagtaattaattattatgtgctagtaagctatttcgttttgcgtgctgctaatatgctcttcaatatggaggttcaaacatgtcctaatttcgttacacggtggtgcgtaaccagcaagacatttgggctccgccatcaattttttactgtccttttctttggtagtaacatttacagtataaaacatcgatcattaataaacgttactatttatcttttaggtttgacgatatcgctggctccaccagataaaacaatgaaagtaacatttttctactctatcaacgcgttacacagcttgcggtaagtcggctccaaccagcaccttaattaattaatatgttaatgctggcatgatggatttggtatggttggtactcctgggtgatcgcctaatttgagccctctctcatgtgacgcaacaacatcgacgactagtcgactaggattaagatcaggtgagctgacgtacgacatgacatcctttacttaaccgacttccccctagcagaacaaatcacaacagagtttctctcaggaaacagacctgtatattccacatttgtcacaaagatgttaactgaaacctacgtactaactaaagggaacagcctaacaatttttaaacacgggattatgatcaacgaagccttttcttatacaccgcctgcgcttgcgtgtgcaaaagagatcttgccggcactacttttatcatttccatcaccacttttatgtctctatgaccatcgataaatcatgcatgatcacaaacaaaattgtggcattgctctactaatccatggatttctttttgttgttctatccaaaacaacatgatcctgtttgtaccgaccacgctagctgatgcagacattcatagacactcacccgacatgtggtcgtatcagacgtcacaggttgtgatctccaaaatgtttgctttggtcagtggcctaaagccagacaccgagcccaattaaacaaaaccaggctacttccagttcagaaacaacaacgtctagtcgcgatgcacggattattcttctcaccggcgatacgaaatggaccgtaggacgggtgacatatggaaccggagagaatcgcccacgcgtactcacggcagacagctacgcgtgagccaactgcagcgtggcatgggcgcgaggtggcgccgcgcctggcagccacatgacgccctccctggttggccggcgtgtctcatggcccggggccccctgccctgagactcctgtcttgtcccaacgtgcgtggccggatatatcgatattccatcgccgacgacgatacgtgccgtgtccagtcgcgaccgcccgtcgtcgtcgtcgcagcagagaagacactgtcgatctcacgctgacatgatgcggatcggccaggcacagcgccgaccattcgcaaatggaaatctctctgaatcgtggccagggacggacgcttgccgacagttgcgacggagacgagcagcggacgcggcggatttaagttgacgggcgacgtgggttggtgaggatggagaggagagttgatcatggtcacttccgagtcgttacaagtctttgattttgatttagcagctgaacctgatcggcattccttcctactactactacttccacgacggttctactacctaccattgccgcgttgtctgcttcaagaggctaatactagcttaattagctaccaaccctaccgctagtatagctaattgtgagcctccagaaacagacaccagcgcgagattgcgagatcgtggagatggctgcattcagggagggtcaaatttaatttggatctgaccggccaccaagccggcaggtgcagataattggatgcatatactccctccgtccaaatataagaatctaggacagttaattagatgtatagtactagaaaatatcctattcggtcctaagtttttatattttaagacggagagagtatcacactactagtatactactatgtcctaaaagaattaaaccctgagtctgaatctatatacacatttctattttaagatatgtgtctgatttaaatccaggtttaatttttttaaggacagataggtatgcttgtgctccatatacgtacacagtgcgttttggtcttgttggtagtgagtgtaaaatacgaagtgctcgtgagggaacaacggaagaacaggacgaaacggcactagtacccggagttgctataaatatagcgtcatatgctatagtcgatttttttttcagccacttacatagtagttacacctcatttacaccccacttacatatgtaattagtatgtaattttcgaatttacatatgtaattttagtacttacatatgtaattttgagacttacattgtaaatatattaaaattacatatgtaatttagtgacttacaatataaatacatgccgactattttttgataaaaaatatggcgtcataaatatagctacccctagtaccagcgtcgatctctgtaacttgggagatgattcgatcatgcgtctgtcgcgtggaccatggacaaattacgcgactattcgatcaggatcattttgcaaatcgcattgatcgcatggtcccaattaaccgactcgttcgattgcgtacaagaaatttttaaaaaccaagagacaagatcacaccaaatgatcaatctatacctaactggccaattattagcatttggctcgctatgcttgaagagaaaacagagtcgatagtgtagaggcgtcccctgtaactaccaacggtcgtggtggggcccgggagggagggagggccacgtggttgggaggggggtgggggcccaccggtgctgtcggctgtatccgcaacgtggtggggcccacgcacacccacttgccacggccagagggtggggggcccacctacctcccttctcctgccttacgtggcggctcgtagttgtgggtcccacttttttggctcctaggatccggtgcggggccctcaaaaatgcgagatttggcttggctgcctccgtccctcccacttcactgctcccacgttgctccacatgttctcatgaatgatggtgctagtgataccaccactgttacaaaatttggtcaattatttgtatatgtacacaatacattggacatgctatacactctctctgttacactgtagacatcatagtttttttttaaaaaataaaataaaatgaagctttgggataaacttaacgttgacaaaaggttgctttcctaaaaacaatgaaaaatatactactaatctgtatgagcaaaaaggtttttcgcacgatcagtgtgtccatgttcactggagattctatgaatgctactaccacactgttagtacaaaatctggtcaattatctgtatactcatcatacgacatgctgtacactctctctgttagtgcagcgcagtcttcatatgtatttatagtttcttttgtgaagctttgggatagttaaacttaatgttgccaaagattatcatcctggaaacaccgaaagatctactagtaatttgtatgaacaaaaagggttttggcacgatcgactgatgttcacatgcaggagattctatggaatgtgcttggggtgatattcctccacggcgcacgcgcgtacgtacggcagcgattgccacgataccgacgtactgtacgtgtgtagtgtgttcaattcgatcccacagcgaaaacattccggcgaagtgaagaatccgtacgtcgacgtctagctgcccacgcatcgtcgtccacttctctcgatcgagctactaatcgtaaacagtacgaaaagtatatatatggagattctttcacacgctctggccagtataggcttcaatctccagctacaaattaatacatgtctaaagcaaagtaggaataataatttagaaccatgaatcttcttatcttccctactaattactacatcctttgttttttactataagttgttttttttacattttatctaattaaacttttttaagtcgatcaaatttatagaaaaaaattagtaacatatataatattaaacggagagagcactaacattttgttacaccgtactatatgattagtggcgtccttggaaatactaacaatttttgttacaccgtactgtatggtatgatcagtggtggttcaaaattccaaggaccacccttcgttttagtgtaggagtatcccatcttttaaatctgatgaaaatattaacaaaatagatttaattttgatattatgcagttttgatgtatatgatatatagaactacccaataaaaattcatagaaccgccactgcgtatgatgcatggcagctagctggccgagctagcacacaaaaagtgcacctatcggataagccgataacgcacttgccttttgacccttttctgcaccattaaccggagtatacgtacgtacgtggtagagttaattggtctcggcatgggcgtgagaacgcattctggcacactatgggagattggagagtatagtaaaaaagctcaaaaagtacctaatgcccatatactagctactagtattcctagttgctttcgatggaagaaagaataatacgatggccgtgtcggcccaatcgacgccacatggtacaacatgcgcgagtacgcgtgtcgtcgctctcaacgtagtacgtccatttgacgcgctcgccgccggcagatcgtccacccttgctttttttccccgggccgatcgatcgatacaaccaaaaccggcaacgtatacctgctagccagccgtgcgtgtggtgtgttcgtccatatgcgtgcaaaagctcaacgatcgaacggagaaatggagcaaaaaggcgcttttttacgcccgtctttaatcggaaagaaccgcccaaattgcgacgtgcttcaacacgcttatgtactggatctatgctgttcttttttttaatgcaataatttctaatacacgttaaccacattcttctgattaaaaaatatgttattaacatttattttgttgtcgtctgtttctattattaaagttacttttaaacatgatatttttttaaaaaatctatatcttgactttgaaggcaaagtcttgttcaaaaacatggttcaaacaatgataggatagcagtgacattggtattgggaggacgcggagggtccctacttgacacataaaaaatgatataattaatcgtataatatttatctcctgttggtgaattctacccgatattagagtttggtggtatgatttttaaaatgtaccgagatatattatatttatgcttagagactgtaaaatttctcaatccggtcggttgtccggcaggaagactgaatgaatagtttggtccagagtccaacaacagtactcaacatgtgctgccttcagtgctagctcctacattactggaccagcaattacacattatatttcacataattgggtgttaacttccaaattttccccactaaccacttcatgcccctttcccccacatgatgcatcaggttgaaaaaacacagaacatgcagctctgccacctggagttctgccttggccaaaagcagctcagtatcatctgaaacaatgtgtaatttgcatcatgcatggcaggataagcagggattaatccattattaactgctactaccatgaacagctagacaagacagcgttgggtcaattaggtgggggttctgctgcggataacgtacgtgacggaaccaacaaccacccagatgatctggacgtgcgaaaggaacgtgtagctatagcttaattagtttttggataacaatttgggcacaagctggattagggataatgatggccacggcgtcattaacattagctgcccatgcttagattaatgcaacagtactctgatgaaaggtggcatacgtgttgcacaacaccttgatttgaaacggtaacctatcagttaattatgcttctgatcatcagcctgattgaatgatggatttcgatctgacggcatggctggccatgcttttcaatagttggagttggactattgacagacaagaagtattgtcagtactcacccgtactacttcctctgttcgaaaaaaaacccaacctagcttaggatgtaatataatctagtacaacaaaactctgactagattcgttgtactgattatgtcccatcccatattaggttgtttttttttggacggagagagtatataataaaggacaatacttgactgttaatccaaatactaccaaaatgcaagccaagaatttcacttgaaaaacattgttccattaaaatatagtactctctccgtcccaagatataagaggttttagggttggacacggttattaagaaagtatgtagaagtgagtaatgaagggttgtgattggatgagtagtggaggtaggtgggaaaagtgaatggtggagggttgtgattggttattaggaagagaatgttggtggaaaagttgttatattttaggacaaatactgagggctaaaaactgttatattttaggacggatggagtaaccggtaccggatactacgaatctagatatacttcatttaaattcgtaagtactagatggtgtctataagtactactatattactatattttgaaaatgaagtactcctctcaacctaaaatataacaatatagaactgaatgagacatgtctagtcctacgaatatgtacaagcttataatatgtcacatccggttctaaattattatattatggacggatcgagtataaaacaagcgcagaagttaggtagattcgttactcttcaaacaagagagttgaccacaaagatatttttgtaaaaaagtaaaatttaattatttgggtactcttcgtttcgtgcagataaggaagatcagttcaactcttccgtcattatggctcgaactcctgttgctcacataatcagctagttaaatccatctagtaggtatagttgattgcagagttagatcgtaatctgggataggctgatggcggcaagtaggtgtgcaaacctttggcgccaagtttcaaatgctaaccatcttccaataaaaaataaaataaagtgctcatcatcttgctgattattctccaagttgctagctcacctacttcgttgtcagtcgcagaggatatcttacaggcaaaaggaagcttttcacttcacaaagatcatggccgaataataatggagaccataacgtaaaagatttcactgaaaaagaagtgagaaacctgaaagacggatgtcagcaggtcgagtaacactgaagcaaattcgagttgtgaacttgctggcagagattaggatagatcgatcgattagagagattttgatcaaagaattcaaagaaagagataacacaaaccccacatctcgattacgacgttctctcaaatcgatcgacagctaattaagaccacagggttgttactattagtcggcatatgttaattagaggctggcattgcgacagctgagcctctctgaagaacacacggttcttcggattcagaaagatggatgagattacacggttcatggcgattggagatgatcatgttttcaattgttttcaattaatttctagaatcagattcgcagtaggaaacaggcctaaaagctgctgccatagcatggtggcttaaatcatcgtagacaattaggtcaaccagcgaatatgatttttagctttctgcacttgatgaaagccttgattctctggtgaaattaacgaatgatagtgagcaaagaggaatatggcatttcttgataatgcccgacagccaaaacgagagactttcacattagacctgcaggactggatggactgaacagaactgattctgaagaaaaagaaaaaaagttagccaggtcttccaatagtcaatctcgagacatggaagcttcgtactgaaatggaggcatgaatctttaccagtgccagcagctgatcttggtacagcttttatataaagaaaaagagagaacgaatttctgtcttcttcttaggctgtgtttagatccaaagtttggatccaaacttcagtcattttcagtcacatcaacctgtcatacatacaacttttcagtcacatcatcttcaattcaaccaaactctaaactttgcgctgtactaaacacagcctataaggcaaatagttatgttgatggcaggtgatgaaagtcataaaagtcttttacatgaagctcattagtacaagggcccatcggagtgcagtagtttggtggaaaccacctgaactctcccgggagtaaaaaggttctccttttgttaacaaggactttaatttgatgcagtcctgtcattttaaaaactcaacgcttctgaaaccagttcagactaatcaactacagtcccaacttgagggtagtgcgacgggtattgtggctgctggtactcccgcagcagtaacgcagaagatctgcgttcaggaaactcatgatttttttttcaggagttttatattagatcaattcctcttaaaaccttatgaaattctccccctcgaaactagcactaacgtatgaaacgtacaaatgcattgtcaatgtatattcttgttgggtgggtatccaacacataagaatttagcttgtagctactaatttaggcccccgtcgtatggctaaatacgaataagcatatgacgtattaacaaaacaataataacttatactaaaacttatatatatatatatatatatatatatatatatatattctcagcgatttaaacgtcaatgctgaaaaataaacttcaaaattaagttttgaaatttatattttggtattggctgatgcttaatagaggaaacgattagtgtattattaatttttagattagattttgtagacaatccaggccttgcttgaggaagtttcgaatcttcagttctcacaaagattatgagaatcatctctagttctcacccaaattataaaaatttataactataggacctgttcggttgtccagcgatcaccaataattacgcgcatacataaggtagcaacatgtttcaattgtagctattgtagccgatcgccgaataagggcatagaattcagaaaaaaaatatataacccaaaagctagaaaaccaaccattctaaattccaattcgttctttctcgggaccctagactcccataaatgatgattgacatgtggggccccaccactctcgggtccacctgtcagtgaccacgtcagaggatccctttcccctaaataggtcttatactgtttgagtagctgaagattttagcgatagctgttctgcaaaagaagggagaaaaaaacatacaaaatcaggtgtggtcctccctgatgctagattttcacagtgaataaattatgaatgacaagattaagagtaaattatgaatgagaagacagagagaaaggggtctctgatagtctgatttttttgtcctttctcatcaaatgagtccaaactccaaacaaaggccaaagccgcctatttaacccctctcctcctccctccaaacctcctcacacacatcccaaaaaccaaaaaccaaaaaccaaaaaccaaaacctctcctcttccctctccttctctaccctcttcttcgtcctcctccatccgagaggcagcaagccagcaactgcacgagcaaccacccgtagtcagtgacctaggcggcggagggagatcggccggcggcgagcgacgacgatgaagtacgtgctggtgacgggcggggtggtgagcggcctcgggaagggggtgacggcgagcagcatcggcgtcgtgctcaaggactgcggcctccgcgtcacctccatcaagatcggtaactcccgccgctcccgcctccgccgccgcccgtttttctctctcccccgaaacgccgccgtacttggcgggtgccgtttaattatttttttcctcggtcaaaaataggccgcagcgtaatgggtggccacgtgatcgcacagagcacgaacgccacgcatccccgtacatactagactgcacttctaaccatatactaataccgaatcatttttctttcatttggttaaactagctagctactcctcgagatcactaaactggagaaaacacagttaaaattcttgtttttttttataaaaaaattgttttaaagatgatgggctcttggatggatggatggataaagctctgatctttcttgttaacgggaatggaagtgctaacctttctgcaatctcaacagtgccatgttgcacttttagtgatcttgtttcctcacttctctttcgctgtagttcatcttttattattattattattttgggactaacaaagtcgttccctcctcctccttttgaaccaaccatttcatgtttcatttcttttgaactgtaattatactcgtcgttgctcgctgatgaggtggccatctgatactgtgtcagtgtcactgtcttggttccttgaaacagatgagtttctatattttatatgggtgtagtaatacaggtcaaatttgtcatctcgtgctatgaaaatttgtcttaactgatagctttgtctcttcatccagaggccaggtgctgcgcacctttcttgggtctagtacttaacaaactattatttttcttgtctcgtcacttgcaacctccttgactgtttgtgttcattttttaggtactaagtctgtacagtatgttagtaaattagtgaacaagtttatgaaatagttttggctttgtcatgtgatgatcgatgacccttctgatcttttacctttgttactgctttgctgcagatccttacctcaacaccgatgctggaaccatgtctccattcgagcacggtgaagtgtttgttttggacgatggtggtgaggtagcagctctgcttcaccatctcctttcggctttcacttagctatttcattatgagatagtcgcagagagtgcaccataggttacaaaatgcacgccagaaactgcactgcactgactcgagcatattctcctcatgcttggcttgaattatcatggactagcagttggtcactagcagcattccatgcacttgtcctgttgtccacttgtttgtagaaaggaggttccattgtagagtgtgtgtttttgtgataactacaaaattttctttctttgactaaactgaacttcatttcgttctctctttttgtctaaggtggacttggaccttggaaattatgagcgatttctggacatcaagttgactcgtgacaacaatataaccacgggaaagatctatcaggtaattggaataaagagtctctatctgagtgcgcacaagactttcagtatgacttgctttctagtccaaagttagtggtttatatctcacaccacagatctttttctattccgtttatacatgtggacaatatcctggttctgtagtctaaaggctggtgatagacatgtcgatattgaacctgtcatagggtagattcaccgtgagcagtttgaatgtcaagctgcagctgtttgctatcatgcaactgtcggtatttcaggaccacttgagtattatatgcttctatgagcatagataccctgctaattatacctatttttctaagagtaaatttaaacttaacaagaatttatcgtctactaattattaatatttattcttgtagggctgcaggaat

SEQ ID NO: 46685 - DNA, 6354 bp, Oryza sativa
  unsure (1)..(6354): unsure at all n locations
nnnnnnnnnnnnnnnnnnnnnnnnnnnnnnnnnnnnnnnnnnnnnnnnnnnnnnnnnnnnnnnnnnnnnnnnctgggtaataattccctccttattgttttccttttcatgctttcttcttacattgtttgtgtttattatgcaacatattttaatctgtgttaatgcttttggtgtatgtagtgacccgaacctgcatttcgttgaagctgttgctcttaaacctccggaagttcccattgacctggcaatgcagcaacagtaagtgtttatgctttgtccaattcattttcagatagtgttgatgaaatacctagtttctgcaaacatttcaggaactaattttaatactcatgcaggcatgaggctgagcttgcggctgcagcagcacaacctctcccagatgacgatgacgatctgatcgagtagagaggatcatgagtctatcatgcttcagcctgagtctcttcataagagtctgaattaggccaatgcatgctagtgttagcttgtctgtggaatgtggacgtttcctgcgtgcctgatgggttgaaaacttttgatgtgtggtgttacatgttgctgccatgaatttgttggctcttttttaacactgctgtgttacttctatggttatgcttaaactatttgtatcatcgagctggtatttatttatccggtgttgcacaatattcttcttcactgccctaactgcgagtgctgaccgcccaagattatgtaatgttcgcatcgcattaagttttgtatatctgtgatgaaagctaggctcaactgttcttgagaacaggggtggtgactggtgggtgtccggtgtccctgtatcggtaaacaaggacacatttgactgctggtcctcgttgtcgttggtggcgatatactgatatagtgagtatgatggcagtatagtagtacagctcctctaccaacttactcactataccgtatgctcaactaaaatacaccatttcattcgacctggtaaagctgaactgaaaatgagtaagctcttccagttaccaacttaccatatgctcgatagaaaatgtagcatcatcttactgcaactctaaaaaattaaaatccaaagggagaacgaaccgggcgtgaagttatgattaagagctttgatggggaacgaacctggaggcacatggacaggaaatcaggattaagtgatcacttaattaatcccaattccaaacgtttccgacattgattaaatcatcaaacagcattaatcgacctcatttcaaactttgccaacattgctcaaacaacataggagtacaccgtattagtcctggcagaaaaagaacagcaaaccaaagagagatcgtcatcgatgatgaatacgagtacaataaagtagcaacgtttctggaacactccagaagtcactctctctcgaagaaaagatactgcaccgaaatcaccttccgaaaggcacaagccaaatccatcgttggtgcaggcggcaggtccagccagtgtagtgcgcgtcactacgaactctagtgcgcaagtggcctcggccagataaccacacagtcacagcaacagaaaaaaaaaatcgcctcggcgcggcgggcggagacgtcgatacccccgacgaatcctctctctctctctctctctctagatcccatccaccccttccacctctcctctattaaatccgccgctctcactcccacccaccgccgcgacacacacacgcacacctgagccgaagcacgcacgaatccaacgccgagatgaggccgtcgctgctgagatacgccgcgcaggcgctccgccgccgcgactactcctccgccgccgcggccgctgagcggaaggtggccatcctcggggcggcgggcgggatcggccagccgctcgcgctcctcatgaagctcaacccgctcgtctcgtccctctccctctacgatatcgccggaacccccggcgtcgccgccgatgtctcccacatcaactcgccggcgctggtacgtctccacccacccgcctgcatccctctcctggctggatctagccgtgtgacgatgctgggttttggattctgctcctccgcaggtgaaaggcttcgtcggggaggagcagctcggggaggcgttggagggttcggacgtcgtaatcatcccggccggtgtgccgaggaagcccggcatgaccagggacgacctcttcaacatcaacgccggcattgttaagggcctctgcactgccatctccaagtactgccccaacgtaagcaccctaactttgatttacactgtagagtttagatatgcagtgaggttcatggatctggttgtgaagcatgctgattgcgctggtcacggcttggggattgcacttcattgcccatcgtgtagatctagcgtttatttgtggtctcggatcgtacactgacataaaactgatgatggagactaaaatagctggttgcccccaaaattcagtgagaatttaatagtgacaaggacttgatgggaatagaaatggacgttttgcccaaattcattgagatttaatactataggaaggtgaggtgctagttgcctgcctcaatgttgtgtggtgtcgctcgaggctgcctcaatgttgtgtggtgtctcactcgaggaggctcgctctcaccaggccttgttttgctccatttaatcgcataccgccgagaacgaatgggatgttagattgtgttctgtgcatgtctactccaatatatcagctgaccattatgaagtttattgtgctcactatatatgaatacaattgttaatcttttgattgtatgctttttaggctcttgtcaatatgatcagcaaccctgtcaactcgactgtccccatcgcagcggaggtgttcaagaaggctggtacttacgatgagaagaaactgtttggtgtgaccacgcttgatgttgtgcgcgctaaaactttctatgctggaaaggctaatgtgccagttactggtatgaccttgatcttttactcataattttaggggacattgacattaaatatagctgtggattttatgataaaattttatctccgcttttctaatctttgtgattgctgtgatcttctgcagaagtgaatgtccctgtggttggtggccatgctggtattactatcctgccactgttctcgcaggtatcatagcttacgatcttgttttttgcaatttccttccgtggttacccactttgagctcaatatacatatacagagtgtaaatactcgatgatgatgatgatagaacctcatagaataggtgttggaatcctgcatgttttaagcttgctgtataaacatgcattttttattcaatgaagaggttgtgctttgtggattggagtcaatacagaatggttatcttcatttgacaatcacgaaaacaatatgcaattgatgtcatggaattttttcaaaaaatcaaagtgcatttatggcgtgtggcctacctcctaacggagtaattttttgtgtgatgtaggcaacccctgcaagtaatgcattgtcgcatgaggacattaaggctctgaccaagaggacacaagatggtgggacggaagttgttgaagcaaaggctggaaagggttctgcaacattgtctatggcgtaagtcttcatatcaaccttaaccaactatatccttagtttactagttagtctgtcaatattagtatgctactatgcctatttgtgatattcttgataaaacatcaggaaaaagttctcataatttgcaaccaaccgatcccttggatgttcttgccatcctttagatatgcatgcctcaaagtacattgcctctaggttcaacatattggcttcagagtacatatatgcttggttctgtccattggatgttagctggttatatattttcctttaaaagtcctgtccacttgcttccagactgttgcggagttgttttttctattctttatagatcctactccatctatgagatgttagttggtatatatttgcctattgcactattgcccgctggctttaaaaaaaaacagtagcaacatatcagcaaaattcagttctaacttcttgctgttcccatgcccatttgattttcattgcagcaaagctttactgtcataattggatatatttaggttgcaatgctgccaataatagatggaaaccaaaatttttctatcccatgattatacatttttataaacagttggcatatctgagcttgttttcagttcttgtatgcaatgcaattgtacaaactaatttatccaaatgaatttccccttcagccttataactctctgttattgctttcatgtgagcacacatgcattcaaattttggaaacatatttgtgctcatttggctcattgtgctggagtactatctggaactggaatgaataggccacttggatccatgtagataaactgtgattttatggctttgcaagtttgtatacttcgccctgacatacttctccttttccctagatatgctggtgcggtatttgcagatgcgtgcttgaaggggcttaatggagttcctgatgttgtagagtgctcttttgtgcaatcaacagtaacagagctgccattcttcgcctcaaaggtgtttttcttgcttctttatggcattgttatgttgctaccagatttctatcgctagatcttcacagctcttgctttttctttcttttcccacactattatttccgtaaacaggttatggatgcaacatacaatgtgttatagacagttctactatatgtcttctcacatttattgactgaagtattgaactattgcagcttgtgttcatttgttaatagcagctgttctatggtcatagtttgaagatttgaatggaatagtttgtagtagcaatatatatgtttaccaccagggactaagcttttacaatatttgttgtgttccgctgccttttcagttagttgcaagttgcaacagatcatctcttatctttggttggatcaaaatagcttttaagacacctttttatttaaatgtgctgttctatcgttgtactgttgtcttggctgtggtttgaacactgtttcgttacttgtatccttcaggtaaggcttggcaagaacggagtggaggaagtacttgggctgggccagctttccgagtttgagaaggagggtctggagaacctgaagggtgagctcaagtcttcgattgagaagggcatcaagtttgctcacgcgaactaggcaacctatgcagattctaacaattcagatgtgaactagagggggggtccctcgaatttttggtttgactgttgttctgccccgatctgctggggcaccgagatgttgtgctccagaataaaatcttgcggttgatgccaacctgaactcaaacttgtacctgaaacagcgactccggtgctatttttcaccttgtacctgaaactgcgtacagtgaacccaaatcatgacccgagtgtcggtcttcagtttgttgggcgattagaacacttgtgttggacgtcgcactgcaaacactaaacacagcagtggatgggattgcatgactgacctgactttgctgttctagcagaaatcgaagtttgttaaggttctcttggaagtgtaggctgtcgagtcgttaaagacgcgctagtgtggagcatcaggcacttggctgtagttcccaactctctctctctctctctcttccctctccccttttgtttttcacgcacatgttttttaaaacgatatatttttttcgaaagcttatatatgaatgttgctttaaaaaattatattaatccatttaaaaaaatagttaatatttaattaatcacacgctaatggaccgttcggttttccgtgggagtcgcacagtaccatcaggcgagcacagtgctcttcagcgcatgatctcggcgagtttccgtggcgcacaactgcaaaacagcacaagaccaccacttccttgtctcgttcaccgttacaaggttgcaggcttgcatctcccgtagagacctgaaggacagtgctacaaatcgagcggtccgctgctgtgtgtatggcacgcatcaagaattgtgatgcacgttgtcaacaagcagctttatgcagctgtactttgtcatcctagtaccagtattgatgttcaagagcactcacggctcacgggtatttgatccttcatcgctgctactagtacatactacatgactgtatgcatatgctcaatgcttccactcaaaagaaaaaacaaaaaatgcatatgctcaatgcaactaaatgatatcaaacggatcagtttcccataacatgcacagt

SEQ ID NO: 46686 - DNA, 23759 bp, Oryza sativa
  unsure (1)..(23759): unsure at all n locations
attggattcaagagatggataattagctatccatggtcaaaatttctcaagagcagaagcacatccgcaaaaggtactgctgaggatctgcgtccgacaggttgggttccaggtgtgaacaatggatgtttctatatacttcctccatttcacaatgtaagtcattctatcatttctacattctatatagattcattaacattaatataaatgtggaaaatgctagaataacttacattgtgaaacggagggagtaattcatttcaaaccttgttacaaacagcatactcaccttagaatgtttagaggaaagatcattatattaataatgacccggctttttgaagaaagcccagaacagagtcttgatacagaaaagtaaaggacacatgcgaacacctcacttgctttctggaaacagactccaggcaagctaccaaatgacaaggcgctaaactcctacagcaaaatatccaacaactacttaacaggttacataaaacaccctagtcataagagacacatttaaaagatcttcaggtaattgaatatcaggtttccaggacctcatcctccctcgcatatcctcaatccacgccttcaatacacccttcatttcctcaatttgtaaaagactccatttctgcagaaacatcaacacattatgaattaagtggaacggagaattgataacaaccccttcaaacacaaatttgttcctggctaaccaaattgcctaacagcaagcagctaaaacaacccaccagaaaccccccttttttccttttccttctttaataaaaagaaagaaatccgagaacgaaattggagacatctcccacccagctatttccctaatggcacaccataaaaatcttgctaaaggacatctaaacatagtatgttctgtgtcctcctctagaccacacattttacaattaatctcccctttccattttttctttttcaactgagcagcacaagggatcttccctttcatggccatgaataagaagtgtttgatctttaaaggaattttagctttccacaagccctgtgccctggtatctatcacccctccaaaagttaaagctttgtacaaagattttgaagagtatccgttcttctcatccagagcccatttcaattcatcccacccttctttgatttccactccctctaacaaactttttagttctacccaattatcccaggaaactccctccaaattcctcctaaaggttaggcaccactctccttcttgccaaatctcccttacagtaccaccttgttgctcatttatcttatacaaatcctcaaaatacaccctcagagacacttgtagtaaccaaacatcatcccaaaaactggttctcctcccattattcaccgctctctttgtgtatagctgacagaattttttagcaatctgcaaacctttccaaaactgagacatattccctttttgttccctaaagaaactctctcctttcaggtattttttgtgaagcagctcagtacacaaatcatgaggttccttttctaacttgaaaatccactttgccagtaaactcacattcattttccttgtttccaaaaaaacctaagcctccataatctttaggtctactcatagccccccagcttaacatatgatacttcttctttttcttctgtatcccctgccaataaaatcttcctctgactgaatccattttcttatgcaccccttccggcagtttataaaatcccatggcatacaaaggtatagaggacaagcaggagtttattaagatctctttcccaccataagaaacatagcccccaatccaagttcccagtctcttttccattttttgtcctaaaaagaaaagatctttgttcccaatcttctcagtacttataggaagacctaggtacacaatgggcatattccctctttcacagttcagaatgtcagcaaactgttgaagatccccatcctccaatcccactccaaatacttcgcttttctggtagtttattttcatccccgacatctcttcaaagcagaacaacaagaacttcagagttatgatgttttgtttgcatggtttcacaaatagaatcgtgtcgtctgcatattgcaggtgagtgatacccccttcaatcagattaggagataaacccacgagaaccccagctttcttggctgactcaagaatcagatctaatgcatcaccaactaagttaaagaggattggtgataacggatctccttgtctcagacctctatatgttctaaaaaactccccttgttctccattaatgttgattgccactttaccaccttcaacagcatttctcacccacccaataaatttttctccaaaatttttcttcctcatgacttcaaacaaaaaaggccattgcactctatcgtaggctttctcgaaatctatcttaaagataatacccctctctttcttagtgtcgagttcatgtaacacttcatgcagaattaccaccccctccaaaattgatacaacatactcaccttagggcagtagcagtgcggtgagcctgggagaggaacccaaatgtccacgtatgaaagaaactcaataaaagtggttgaagctcccctctccacagtgcacgcgcatgtaacccaaccccaatttttttcaggctggccccaccacggaatcgcttttcagttcgcatccttccccctctctctctctcccgatggttttgtgcatgctcagtcctttttgcagacatttttgcaggcttttttgatgaggaactcgttgctcaccaaggaaccgagcaaccatgcggaagaactctggcccacaccctctctcctccacgccatcaaccatcctccatggagctgtgaagtaactcgccagctcactacactgtgaagagccttatagtgatctaaggtccaatgggaaacagcataaaaacatatgcaaataccaatgtattctgcaggtcttacctcaatctaattctggaaatttctcttttacagtatcagcagttgtgactggagaaggcaatgaacgagttactgagcccagcacatactccctccgtttcgaaatgtttgacaccgttgactttttaacacatctttgaccgttcatcttattcaaaaacttttgtgaaatatgtaaaattatatgcctacataaaaatatatttaacaatgaatcaaatgataggaaaagaattaataattacttaaattttttgaataagacgaacagtcaatcatgtggtaaaaagtcaacggcgtcaaacatttcaaaacggagggagtatatattgtctccagccacctacataggtcagcatgtaatatcgtagttagagagcattttgctgtttggaggaacaatatagaaaaattcaggaagtctacaacaattaaagaaaataagtagtactccaattagattacaaaaaatgttgcacatgctattccttatcctatattttagctagcatcgatgtgttccatatatatgaacagcaaactttgaaggtgtgccatttctgtactgatagtttgaattacagattcttcacttgacatatcatctccagcttctctctaagctgaaaaataaaagcttctggatattctagcaatctggcaaagttgtcacctacacaaagagaacaatgactgatggaccttagatcaccacaaacctaatcccatgttaccttgcagagggtttatcagtctagaattcactacaggataaaaaaaatcaactccccataacattacaaagagtaactgcagaggttagcgaagatccacctattcagtgaaattcagacaagcacatatcgatagaggcacgatgaacaagaccagacgaacaaataacatatgcaacgaggaaacaaaccaagaacagacaaaggcaagctgattaaagtagcataactactatttctccataataacaatgatagtgttccttatccaccaagatagtcaatagccagggtaaatacaccacagtaccaaactatccaaatctgcaaactaccacaactacaactagcattagcagcgacaagacgagacaggaggacagaggaaaagcctaagcggaggtgaacttggtgacggccttggtgccctcggagacggcgtgcttggcgagctcgccggggaggacgaggcggacggaggtctggatctcgcgggaggtgatggtgggcttcttgttgtagcgggcgagcttggcggcctcggcggcgagcttctcgaagatgtcgttgatgaaggagttcatgatggacatggccttggaggagatgccgatgtcggggtggacctgcttgagaaccttgaagatgtagatcttgtaggtctccacgctcttcttccccttcttcctcccggccttcttcccctcgccggcgccgcccttctcgcccttccccgcggggagccgcttctccgccttgggcttcttccccgccgccggggccttctccgccgcgggctcctcctccgcgggcttcttcgccgccggcttcttctccgccttgggcgccatggatggctgcttctctcttcttggatttcgctgggtgtgtgagcttgatttgtgatgtggggaagacgaaggggacgagtttattatatagtactagcaggctagaggtgggcgctgattggtggagacgcttaccacgcggatcggtgacgtggagcgacgtgggacgtccggtgctgtttcggtagacggtcgcgatgagttcccgtgcggatcggtgacgtggcaaaaatttgtaggcgggagaggggatactgtgattggttttctggcgcgggatggtgcttttctggttggtggggcctttcaatcagtttttgggctttttggcacggagcccactactatccatttaaaggcccatttatcatttaaaagcattttctaggtaatttagcaaggatttggtcaaaatttgaatttgaattgcctagatgcatttcccaagattcggattgtttcaaaatgtgtggtttttcgtatattaaaattggtgtacacatacatagcaagacagttaccatggcatcaaccgaaaaccgtgtgaatttcatcttcgacctttagaatttagaattttgaagtttttaaatctcacgacaacagctcgagtgaaaatcataggcatgtcggatgtcatcatcttctacgctgttgcttggagagcatccgctgtaaacaattttcatacagtgatactagtgccatccaagaaaattattcaagttattcctagcagaacatttcctcccacgttctttctccttgcctcttgcatgttccatgatattggtagaagtactgaggactatgtagcctgtagccagacaagtttgtcctattgcatttctttaaatgtgtacccactgaaatgtgggtccaattggtgtttctattttctcttctagtgttacgtagttgtatcgtaggcgtcacacaggatgaagaccgagttaacaagcatataggcaccagtcgagaccattcttaatattgtcgagggctcgatttacagtggttctagtagttggaagacactttcgcatcttgtttgcgattgaggaacacagatgaaacgctacctaggtagcgtttgaatctcatgaaaatgaagatgaagataaagattgagtgtttcacataaaacaagatggtaataacgtgtgattaattaagttttaattattacaaacttaaaaatggattattcttatattttagaacaactttcatatagaaagttttcgcacgaaatacaccgtttaacagtttaactgtagattttctcactagtacgaaaaggcatatataaatcaggcatagtgagagcccaatgtgcactagtcaatctgatcagtaccagacataatagtgtatcgtcaaagattaccaagacaaaaataatctttttatttttcacaagcctcgctccatggctcgggagacatattgtcttgccaagacatccggccatgcctgcccaagctcaattaatatatcacaactcaaagtgcccaactaagcagctctctcaagacctggtcattgatgcttcggaatgcttcgaaatgtgatccaggataattcttttaacctatcatctttaggaggagttgaaaggaaacagaggtgcaggaagcggtgtcatcaccgatcttggtgcgcccgcgtatatttatatggttgccaatagccggcaacatggctttacaggatcataacaaccttggctaatatctctctaactaatcctgattacaatcattatctatcagctaagataagatcgatatggccaggttgttatgcttacacatgattatatctaatactccccctcaatcacaacctacctacattgagattgtacttaaaattttcaagttgtcttgccgataacgcctttgtaaatccatcggccacttgatcacctgtaggaataaactccacttcaagtaattttcgttgcattctttcacgtacaaaatgatagtcaacctcaatatgcttagttctagcatgaaagacagggttagatgataaatatttagcaccaagattatcacaccacagtcgagccattggaggacttggcacactgagttcctctaacagagtttgtatccacatgatttctgctgtagcattagccaaggccttgtattctgattcagtactagaccttggcacagtagcttgtttctttgcattccaagaaaccaaattatcccctagaaatactgcaaaacctcctgtagatcttctatcatctatatttcctgcccagtctgcatctgaatatccactaacaagcatagactttgacttactaatctttaaaccaagtttagtacattgttttaaataccttaatattctcttcatagcagcccaatgaactatagtaggagcatgtagaaactgacataccttatttactggaaagtaaatgtctggtctagtcagagttaagtactggagtgctcctactacacttctgtaattagatgcatcattgggacctaataaatctccttcatgcaaagtgagtttctcactagttgacaaaggtgtactaacaggtttacaatcagtcataccaactcgtcttagtagatcagtaacatatttttcctgggttagaacaatgccactagatgccttgtttacctctatgccaagaaagtagtgtaagtcacctagatcctttaaggcaaaatccttttgtaggtcctttagcagagctggaactgcatcctgtctcgagctagcaacaattatgtcatcaacataaacaagcacaaaaattattagaccccctttattataaaagaatagagaagtatctgccttggatccttggaatccaaggtgttgaagcttctgacttaacttagcataccatgctctaggtgcctgttttaaaccatagagagctttgtcaagcttacacacatagtcaggatggaccttatcttcatacccaggtggttgtttcatgtatacctcttcttcaagaataccatgaaggaaggcattttgcacatctagttgtcttagagtccaacctctagacacagcaattgatagaataattctgattgtggctgccttgacaacaggactaaaggtatcctcataatctatcccatacctttgtttaaaacctttagcaactagcctagctttatatctgtcaaggctaccatcttgttttcttttaatcttatagacccatttataatctataatatttcttcccttttgaggaggaactaaatgccatgttttattatgcaataaagctgtgaactttgcatccatagcatgtttccaatttgtgtcatgcaaagcatcatgtaaatccctaggttctccggtggtagtaagacagccatacttaacagtacgatcggtataaattttctctttgcgaatacctttttgaagatgtgtgacaggacggctcgcttctccctcgggcgtagaggatctcagcgcctgctggtgttgttgcggattgggaagtgtggcttctggtgccgtggcgacggacgattggctggcaggagaagccgacgcactgatgctgctctcatgtgtcgaactgtcattcaaattggggttggcggtcatgtcacctgctgcatcgtctgctggatcagcgttggagatcgtgcctgtgtcgctgccaccggaatcagctgcatcatcacgagtgctggcgagattttcttctgtattttccacgggattttctgcagcaaccatattagcaggagcagtagggtaatagttcacatgatcattcagctgaacatccccagggttaagcatatcggcaggaagaagattaacttctttacgaagattggttccagcatttggatttagttcggcaaaaggaaaaacagactcatcaaagacaacatcacgggagatataaatgcgtccagtagatgaatctaagcaccgaaagcctttatgaagaggactgtacccaaggaaagtgcatctcttagaacggaaatgcatcttatgagagttatatggcctaagatctggccagcaggcacacccaaaggttctaagggcttgataatcaggagtttgtttaaacaaacattcaagaggagaggaataaccaagaaccttggtgggcatgcgattaatcaaataaacaccagattgataggcctcatcccagaattttagtggtagagaagcatgggctaaaagagaaagaccaacttcaacgatgtgtcgatgtttgcgttcagctgagccattttgttgatgggtgtgtggacatgaaacatggtgtgtgatgcctattttattaaagaaggtattcaatttttgatactcgcctccccagtcggtttgcatggatatgatttttctattaaacatacgctcaacaaggcactgaaactcttgaaacttctgaaaaacttcagacttatacttgagaaaatagatccacgtaaacctactgaaagcatcaataaaacttacatagtacttctttccacccccagcaacaggagcgggaccccaaacatctgaataaatcaactcaagaggattgctaaaaacgctagacgacttgggaaagggtagctgatggcttttccctttttgacaagaatcacaaactaacaatttattggactctgctgaaactggtagatcatgattatggactactttctctactatagcataggagggatgaccaaagcggcaatgtcatcgctcaagggacggtgtggtggctgctagtgcttccttgtcttgttgagtcgaaagcgatgaagatggaagcgggaacagccggccatgacagcgtcctctaagaagnnnnnnnnnnnnnnnnnnnnnnnnnagagaaaaatgtttagggtacagttcaaagtaggctgcattgtcaaccataagacaataggctgaaatcaagtttttactagcattgggaacatatagaatgtttttcaagtgaagggaacgtgttggggtgttaacaactgaatgacctatgtgagtgattaccatacctgcgccgtttgcagtttgcacttggtcctggcccttgtatttgtcccggatggtcaacttctcaagttccccggtgacatggtccgtagtgccggtgtctacataccaatttgaatctactccataggatgctgttgtgcctgcatatttctcatcaggaacaaaatcctcatcatacctgtaccagcaatcaatcacggtgtgcccccttttgtaacaaagttggcacttggggcgataatcaacgccattgcctccttgtcgctggttggagttgttgccgcgtcctctgccgcggctgtttcctccatggccgcgttgctgctgctgcggctgcttattgttgcggccccttcctggattgccgcggccacgccctctgttggcgagattggccgagtgttcctggcgcatcttcatgcgctgctcaaagctgagcagctgtgagtaagcctctcctaggcttacatgctcagatttggacactagggaggagatgatgggctcgaaatcttcatctaatcccgcaattatatacgagatcaggtcttcttcatcaacgggcttgccggaagtcgccagctcgtcggccaacaccctcatcttgctgacatattcagcaatgccgaggtcgcccttcttcgtgttcgtcagtgcgatcttggtgttgatggagcgcgcccttgtggccgaagagaacatcccttcaatcgtgctccagagagatgcagcactgctgcatgtagccacctgggagagaacatctctactcatagtggttagcagataacctagtacctgctgatcattggcgatccattcatcgaccgccgggttggagacctcaacctccttctcatttttcttgatgatgatggtcgccgacggcttctttgtggcgccggtgaggtagctgtcgaggcgtgctcctcggatgacggcgagaacctgaaccttccagatcaggtagtttcccttgctcaacttctccgtgaccgtgattcctccgagggaacctgaggccgaagactgggacgaacttgccattgatagattggattgaaaggagtttgtggtgctctgataccatgaaaggaaacagaggtgcaagaagcggtgtcgtcaccgatcttggtgcgcccgcgtatatttatatggttgccaatagccggcaacatggctttacaggatcataacaaccttggctaatatctctctaactaatcctgattacaatcattatctatcagctaagataagatcgatacggccaggttgttatgcttacacatgattatatctaataggagtgattcttgagattaaacatgtagttttgagctgttttcattccttctctgttagctactcgccccgaagttgtaataaggtggcgcatgagcttgccgcgtatggctgtaatctccagaccgtgtcttcctgggcaggctgccctcctagtctgtaacggctagtatccagcgattctgctggtttggtaatataaatatctcggtttctcaaaaaaaaaagagacctggtcgttgagacccatttaatatgcacgtagatcggtcaagctagggcacttgcactagtgggaacacggaatagcgcatgtttgacgtggagcggcatgtgcgacttgggttcagacatgttagttgggagcgatggagcgctagatgcggggaaggtgacatcaacacttatcccgttgaaacggaatcccgttgtctagccgttctcttacactaatatgtactattccgtccaaaaaaaagataacttctagcaatgaaccaagacacacatgtgtccaggtggggggggggggggttaatcctgatcctgtccaacgttggatgtgtggtcgttttcagtggtcagaaacagttggaatgtgctactctctctgtcttttatccttgttacccgtactggaatcaataactcctcctgaataagtaaaacccctatgataatatcaacctctgttggatgcttgattccattgatatcaatatctgttggagcattgatttcgttgatttatttatgcccatgctgcacgtacgcttgagagcgatggataggtagtaagcgattttcattcgccattgagaggaaacggacatttatttttgctgagcctgtctatatatctacaatacacaagaagagaacatgaacaagaaaatggtcagaatttcgtggccacaagcaactaaagcttgcacgcaatcaagtgacaaactcactgaccatgtacacaccaatgctggccatggccagttgcctagttgctagctgggatatgcctcgaattaccatcggtttttgcctcttcttactgaaaccagagaactgcaaagttaagttcatcaagaaagtaaatactaataaaaggggcacatgattgcaacacttgccaaccacaaaatcaaagtcaggttgctactagcatcacaacctatgagcgacgacaagaatcaaaccgatatattccttgaccgagaacagctagtagccatcgacgactctatttgcattggttatttacaaattaaaattcagtgtgtatcccctgttatgtttatccacgatgacagtggatcataaactgaaataaacacagtgcgatctggcagaggaacacgcgtaattcttagccagtgtggcaaacgagtgcacgtaggatatatcgcttgttagatagaaagaccgcgtacgcacacgcctagctaacaccggctgtgacgtttgatcggagtccagctcgtgcaaaccggagtaccggacgccagacaaagccaaaaatgcatgatcagtttaattagtacgttaatttagtagtatcatgcacatgtatgtgtggttatgtacgacagagttaaactatatttgatcgaaatcatgcatatataagagtatatgtcctgcacagtgcatgcatgcacgcagttctgtgacaaaatcttatttgggcttatatacttcgttctcaagtaactaacagtaattattttcatcttagactacttaatataagtttttcctatatacacgttttaacaatatagcataatttctagcatttgcaaatattttgctgaacgatcaaaatgtgaaaatggaagtgtccaatatcaggtttttaagtaaatttcttagaggcatgtaaatgtatatagccatataagttactccctccatccctaaatatttgacgccattgacttttttaaacatgtttaactgttcgtcttattaaaaaaaattaagtaattattaattcttttcatatcatttgattcattgttaaatatacttttatgtatatatatagttttacatatttcacaaaagtttttgaatatatttaaaaaactcaacagcgtcaaatatttaagaacggagggagtaataagttatagtagttcaagttatataaggtatttcctccgtttcacaatgtaagactttctaacattgtccactttcatatagatgctaatgaatatctatataataatgtctagattcattagtatctatatgaatatagacaatgctagaaaatcttatatcgtgaaacggaggtagtatatctaaaaaaaaattataggaatacaaggccacgtcgatcagcatcgaccacatcgaaacgacctatataaatacacacgcgccaaagcagaaacgaacaaagcacaagatttagctatcctagcaagtcgccaaaaaaaaaaaaaccaacgtagctgcaagcaacaaaacaccagccgggccatgtcgtcgtcgccgatgcttggaggcatcgccgacaggtggcgcgagctccatgggcaggactcgtggaatggcctcctcgacccgctcgacctcgacctccgctcctccatcctctcctatggcgagctcgtgcaggccacctacgattccttcaaccgggagaggcgctcgccgcacgccggcgcgtgcgtgtatggccacggcgacctcctcgccgcggcgggcgcgtccgccgccggcagctacgcggtgaccaagttcgtctacgccacgtcggggctccccgtcccggaggcattcctgctgctgccgctgccgtcgctgctgccgccggcgtggtcgagggagtccaactggatggggtacgtcgccgtggcgacggacgagggcgtcgcggcgctcgggcggcgcgacatcgtcgtggcgtggcgcggcacggtggagagcctggagtgggtcaacgacttcgacttcacgccggtgcccgccgcgccggtgctgggcgccgccgccgccgcgaacccgcgcgccatcgtgcaccggggcttcctgtccgtgtacacgtccagcaacaaggactccaagtacaacaaggccagcgccagagaccaggtgaattccacttcacttttccagtgattatttgacctaagctattagcctattactaccacaagacgaaagtctcgagacaattaataacacctttaatttgcaaattaatcatccatgcatgtgtctcttttgacgttggaaaggtagagaattctatatgaccacggtaacaataaattataaatgttctttttgtgaatactgcagagaatcccactcgaatactgaatgcacctttcagtttgctccatgttaaccgatttttttatgagaaaatctaaaaaataccattaacaaacacccaaatccaataaatatcatcgacgagtgcaagttctataaaatgtcatcgtacaagcgattttgttccataaacattatcgttgttagggttctattgatcatgtgtcgttaaatgcactgttcatcttatatcacttaacggaagactagtaacgaattgaaaccttgacattggtggtatttctgaaacaaaattgtttgtacaatggcatttcatagaacctgtacttgtcgatgatatttcttgaaattaagtgattatcaatggtatttcttgaatttttgtttcttcttttttattatcattacttttgcatagttgcattaattcaagcaggaaattgggatattgatttatctttgcctggaaaattgacatattagttgaaagaagcacatttttaattatttgcgaagtattgcataggatgttaagggtggtcagctatgcaggtagatacatttaagttgtttcaaagataaggtaggtacattcaactctgaaaaatcctccataccaaaaatagggccaaaatataggttttataaaattaattaaagagaacggtatttttgttcagctattataattctacaaaggggtagaaagcaataatggaatagcgtgacagattacggatgatgtcaaattaagctcataatgagcagattacccaactatgaacaaaatattttaaaagatgctgatactcaaattttcataccttgaatattacaacacgccaatatattttgtcatgaccggaaggggtagtatgctagtttcttataataaagtgtggctagtaaattaaagctgttcaattagttaacttaattaatacaaatagcattcatttacagatgcatgtgcaaattattttttgttatctctggtagcgggcttcgtcattatatttttctaagtatcatcatctagctaattaagtaggtatacacacataacgtgttaaactatgttgctataaaaaaagtttaagttatataatatcgctcgtcaatctgagcgcgccttcttgctgattaatttcttcaattattcgatctctaataatgttcattattgtacctgtcacagcgacagtcagacttgcatatatagatatgttggattagatgcaccaaacttgtgttgttgcctttgactgaattaattgtagctatcctatatttgttatgctactcgtcagatttatctaaactgttctcaaacaatgtccttatcgttagcatttgactttgaaagatttgtttttttgatactgatatttcctatctaatcacatttttctaagataatgtctaatcacataagactagtgcatgaagtcgtgcattcacgtgactatcactatatttcgattagtgacgtaatatctatttctgatattatgtcactaaaatatttattgtgaaaaatatataaaatatatgtttgtttcaagaataaatggctttatcatttctctcaaccatgcaaacatttattttttttctatatttcttatgtgtgttttctttgctctatatctctctcccacatatcaaggagacaccggaaagctctagaacaccatcttttatccaatggctaagatttattctacctgttttgtttgcttattgatttaacggctattatccattagatgatgtggcacattcttgttctgttttgggattgtcttttcaagagttaaaatggcgtaatatctaatttcactaaaaatattattgtgaaaaatatataaaatatatgtttgtttcaagaagaaatggctttatcatttctctcaaccatgcaaacatttatttttttttctttagttcttatgtgtgtcttatttgctctatatctctctcccacatatcaaggagacaacggaaagctctagaacatcatcttttatccaatgactaagatttattttacctgttttgtttgtttattgatttaacggctattattcattagatgatgtggcacattcttgttctgttttgggattgtcttttcaagagttaaaataagactttgaaagatttatttatgtgacactgatattgcctatataatcacaatttaacataatgcccaaccaaataagataatcacatatttttacataatgtctgatcacataagctaccttcaagttactacttgggagccatcgtttcttttattcgtggaataagcggaatggcaaatttacaaacgaaaagtgatttataaataaaacttttatataagtgttcttaattaatgatctaaaagcaaacgctgaaaaataaacttcgatgagaaaacctcaaaatcagctctaaatttaatgttgaaaattcaaattttggttgataaatataagcataagcgaaaagatgaggccccatgattacaccgaaaaaaaaacctctcgattaaccatgcgtcatgtccaaaaagaaaaaaagattaattctgcaagaaaatgcttgcaggttcttgaggaagtgaggaggctgatggagttgtacaaggacgaggtgacgagcatcaccgtcgtcgggcacagcctgggcgcgtcgctggcgaccctgaacgccgtcgacatcgtggccaacggcgccaactgcccgccggcgagctcgtcgtcgtcgcagccgccgtgcccggtgacggcgatcgtgttcgcgagcccgcgcgtgggcgacggcttcttcaaggcagcgttcgcgtcgttccccgacctgagggcgctccacgtcaagaacgccggcgacgtggtgcccatgtacccgccgctgggctacgtggacgtggccgtgaagctgcgcatcagcaccagccggtcgccgtacctgcggtcgccggggaccatcgagacgctgcacaacctcgagtgctacctccacggcgtcgccggcgagcagggcagcgccggcgggttcaagctggaggtcgaccgcgacgtcgcgctggcgaacaagggcgtcgacgcgctcaaggacaagtaccccgtgccgccccggtggtgggtctccaagaacaggtgcatggtcaaggacgccgatgggcactgggcgctccacgatttcgagcaaatttaagctctcgatttcgaaaaatttgcaaaatggattacgtatagaagtgctcgttaatgggcttgacacgtcgaataaatgggatttccccctcatatcacataattcatttgtaaataaaactctgtccagtcaaatgcatgtgttgatttggacattgttacagatacaaaggtattgatttggacacgttgagatgtccagtaattatttcttgatgcatatgcgagttcatgctcatgcacattgatacactccatccaatcatttactctgcactatcctcatcttcctcgcggtccatcagagtccagcggccatcggcgcctctcaccatgcccctgttcgacgggatccaccacccggccggcacggcgtgctcgtcgcgcagcgcgccgtaggacttgttcgccagcgccacgtcgcgctccacggcgagcttgaaccgcccggcctcgccgccgcgcgcgccggccacgccgtgcaggtagcactcgaggttgtgccacaccagctcgttcccgggcctcctcaggtacggcgactcgcccgtgtcgatcgccagctctgtgcccacgccgtggtacggcggcgccggcgggtacctggggacgacgtcgcgcgcgttgcggacgcggaggaggcggaggccgaggccacgcgcgccgtcgaagcggcgcttgaagccgtgcccgccgacgcgcgggctggcgaacacgaacgcggtgaccgggcagcccgccgccgctgccgcggcgcggggtgccctgttgtacccgttctcgacgatgtcgaacgcgttcagcgtcgcgagtgcggcgccgaggctgtgtcccgtcaccgtgatgctcagttcctcgtcctggtacatgctcaccagcttcgccacctcgctcaacacctgcatggcaacatccatgtcgatcagtgacaatgtggtaggtgaccttgccgtgctactccggccattactacctgatctcgagcactgtccttgttgtggctggactcagagtccctggaggtgtacatggacagccaccctcgatgcaccatggcgtcggaagctttgtcccggaggaggcccttgggtggcaccatgacgaagtccatgtccttgatccactccagcgactgcaccgtgccgcgccacgcgacgacgatgtcgcggcgcccgagcgcagccttcccttcgtcggtggccaccgcgacgtacccgatccagttgctctccctgcacctgcgcgcgcgcgacgcggaccggaggatgagcggctccggcacggcgacgcacgacgtcgcgtacacgaacctggcgacgcggtacgccgcggagtggcccggcagctgcgcccgctcgaagaagcggcgcgcggcgaacctcgagaggcccgcgtgcggcgagagcttctcgtggttgaaggcgtcgtacgtcgcctgcgccatctcgccgtagcggatgacggtgcggcggaggtcgaggtcgaacgggtccaggaggccgtcccagtcgctctcaccatggagctccctccacctccgcgccgtgccgtcaccaagccattgctgcgacgacatgaccgatcgactagctaggtcacagccacacaattgacactggcacactgcaacctagcaaccatttatacagcagcggcaatggttgacatggtgccaatctttctcgagcgttcttgcgctcgtgggaataatgacgaacactcacagtgcatgccaatggcatgagcatgacatgtcgatgatgtagatgcatgatgacatgagcagatatgcttcgtgtgtaactgcatgccctaactgggaaagaagatcaaatggtagaagagatagcaagaagcacgccacagtaacgcgagggtggagtggaaagccatcgaaacggcatgaacgtttgacgtgttcgagctcagaaattcagttacggacatcatcgaacagaatccttgcttcgaggctcgcagagttgcagtgcagattcgcgtcggcggcgagagattcgcgccaatggaggagatgggtctcagtcggcaaagaaacggcacgtcaggaagtgggcccattaatgtgggccttactggtgggccataaatttagatccaaagtgttgtgggcctaattagcttggcggggaatttcgtgaaccataaacgggcctaggcctgaaaattcatttgggctttattggatcgcaactaccattccaaaatagggactctaatcggccatctacaaagccatctgctcaacatgaatttctgaatccaaactgatccatccaaaaacatttcagaactcttgaaagctgcagcaaactttgattagggccagctaaaataaccatgacatatgcagcattcatcctgtaagcacgcactgttgcaattcatgagcgatttggggttgcttaaagtgacgaacacgccaggattaactagttccaccaacctggggtccgatcaatcgaatctctcatcctcaactcgagcatgaagacaaacgctcaagatatcctcccatggcgatcgatagtgctcgatccacctagctatctagcaaatcctttgcgtcgatgcgaatacttcccttggcgactaatttggtggcgttcataccaagcgttccctaccccaaaacgtgagtgatcaaatcaattgcgttagccactgagcttagctctcgactttgcttcttctatcgatggcctttcttactgttcatccttgccgacacgttggtcacacgagaagcatctttctctttgatgatctgaaacttttctcgtgatctgtgactccctgcagatagacaggcatgtcatcagcgattgagatgctgtgaatccttggacacggtacgaattgtttgttcacacaggtttcttgagttcctgtttcaatatcactgtcactgagcttggctgtcatcaagagatcgacaagttttcatgtgtgagctgcagcctgcagaagtgcaagcattgcactgcagaaggctttgcattcgtgctcgtcttcacttgtttgtgtccgaggcgagagagatagcagcagcaggtgcgtgtgatgtggagtcagctttttttccgcaggagcatcaaaagaatacgacatatggtgaacgccatcattttttgtccaaaaacaccaggattttgcatcgatcgtgtgggggcaggatgtgctgctgctcatttggtcagaatgccggaggacaaatgcaggcaggacagatacagttgcccttgatttgggagttctaatcatctcattaactaccattgttaagatcactgacggcgtatttattatactagtacctgcattttttaatggaaccatatgcgagtgtcattaagaagttggagaatggatagcactagcagtagcagcagagcaagtcagggtttgtggacctgatgatagcatcttgctccagtggacacgattattgagatgtacatatgtacaactgagaatatgattagcgcacaagatcggcgatgcaaatgaaatgatgttttagcgaaattcgtttggcgttcagctgctgcaaagtgcaaactgcttttccatctgaaccatcaaaaaaaaattcagatattcagatagccaccgttgctattcaatctgctcacaacgttctaacaatgtttcaatatacaatcgacaataatcgaaaggatcacgtgaaatcggcaccgagagagcgtgtcgaccgaccgctcaaaatctcaaaatcccaaacacaaactagacggtgaatgaacgggaggagccaacggttttctccctcgcattcatggaagtcccatttattactcctacgctgtatcgacgctgaaaatgcttactactgctctactcccggtccctcggttaaaaaaaaaaaacttaacttgtacaccctctatttagatctgttccgtatttttacgacagagggagttctagatttttaaaacaaaaatctgtataaaccgtcagacatttactagtgcttggagcagtaacccaagctaagttgttcttcaaagctgacactggtgtagcaaaagccatggcacccttgtctcaaaaaaaaaagccatggcacctgggtgcagagctccttggcccacaggcactgacatgtgggtccccatggggtgaaaggctaccttgtcctctgctggttgtcttgtactacagtactattctggtgctacgagcaatatacgggcatgtaaggcagtaccaatgtactacgactactccgattagtacatgaaaatggcaaaaggtaattaagcatgacactctcgcttggatttgatcagatatggagtaatccctccgtcccacaatatatggaattatgagtttttggttataacgtttgaccactcgtcttattcaaattattttttaaaatataaaaaataaaaagttatgtttaaagtactgtaaataataaagtaagtcataaataaaataaataataatttcaatttttttttgaataaaataagtgatcaaacattgcaaacaaaaactcaaaatcccttatattatgggacggagggagtagtagacactgtgcatgcagcgtgcagccatgtgtgtgcatcgtttcgcatggcccagaaattgcaacggcaatgcggggttggatcgaaacagcatcgtttggtcaaattccaggcgaattatggcatcaggagcatctggattctggagtgtttgactgttgatgatgcatgtagcatgagtaataaccccggccgcaatggcgaggctccggcgtcttcttgtttaatggacaggggcaaggagatgcagacaaagcttacatacggatcagcggcaaacacggatcaaacgtggctggaagaatccaatccggaccgtccatttcaaatcatgatgcgtgggagaggctctatcattttttttcaccctgaatggtggcagtggcaccaaagcagtagtgccacgccctaatctgtttagatcagtgataaaattaatcttggctgcgctgctagatgaacagagcaaagcagcagcaaagcaaaaaaggtcaagaggggggggcttccagattcggatcgtgcaaagaagcagatgcagttttaatccatctcatctcctccaacgttcagattccacctcatatgagctcgagctgagctgacgaggagtacacctacagtatccaaccttcactgctcggaccaaacccaagaccgttcctcggaaaccgcgcccaactccccacctctctttaaacccaaaacgcctacccatgtccatgtccgccgcgcgatcctagtggtgttcttcagaggcaatggtggccgggcgtgtcaaggcggccatggggttccagcgtagccctgcgacgcccaagacgtcgtcctcgcgcaaggcgccgcctccgccgccgccgctggtgcaggcggcggcgcaccatgcggcggcggggcagccggagacgccgcggcggaggtcgtccggctcgcccgcgtcggcctcggcgtcggcgtcggggtccaagacgggcgtcttcgcgcggtcgttcggggcgtacttcccgcgttcgtcggcgcaggtgcagccggcgcgcggcgcggcgccggaggtcggggagctggtgcggctcgtcgaggagctgcaggagagggagtcgcgcctccggaccgagctgctggagcacaagatactcaaggagaccgtcgccatcgtgccgttcctcgagaacgagctcgccgccaagagcagcgagctcgggcggtgcagggacgcgctgacccgtctcgagtccgagaacgcccgcctgcgcgccgcgctcgacgccgccgcggcgagctccagggacaacgagcagaggattctcgagatggagaggcagatgaccgagctgaggaagaggcggcagagggatgtcgcgaccggtcccgacgattgctcgtcgtcggcgtcgtcggacaactccgagagctccaacgcggcgaccaactcggccaagtcggctaaggtcgcaggatgttcgtccgttcgtcctcctccccctcctcccccgccgccgctgccgccgccaatgccggcaacattcaagtccaagtcctatttctccggctcgtcccgcgcttcgccggcgaactcttcgtccagttcatcatcctcgtccgccccatcgacgccgtcctgctcttcagacaccgcagcatcaagaagccgcctacctgagctctcgaagctccctccaatacccccgccaccgccgccgccgccgccaccg

SEQ ID NO: 46687 - DNA, 8121 bp, Oryza sativa
aactggcctcaagtgcatcccacatgtccttccctgaaagcatgtgcatgtacatgtccactatattgtcagcgagtacactgatcaatgctccacggaacaggcaatccgaagcctcgaacttagcctcctcctcaggagagagaggcggttcacttcgtttgccccgtgaaacatagaagcattgcatccctgtcaaccacagtagtgcacgtgctttccatctcttataattagaaccatcaaaagcatgtggtttcagtgttgcagcaaagccaactaccgaaaatgacctagcaggtttttggattgttggaactttggtcataattcggcatattttaatccaaaataacaagataataaacatgatatttacaatgggatttgatccaatgatagtggtgaatgcaatcaacatgagcatgcttaatgtagaataagcatcaacaatcacataataacacaatgttgacattgcgatgaacattaacagtaaaacttctaattgaaataatgtaagaatgttataccccaagaatggtcatccgctggagtttgaagcagtattgcctccgttggtgttgacgggagcctccttctccttgtatccagtgttgccgttgtctccagtgttcgacatattggtgaaggtgaagtagatgttgacgaacagtgagtagtcacgcgttgcgctccccaaaaacccgatcgcccgcccatccgtgcaaatgtcgcagcagcgcgtggtttcggagacctactctcccaacgcgtgtgcacacactcgtcgggatgggattaccgtagcagcaacagcgttggaaaatggatgaaagtgtgtctcactattctcgcgggagatcaaatccattctcattttataagaggaatggaagatgaagagtaagagtcatagaataggaagaggaatagatcaactaattgtcatcaactagccatgaaccatcctccactacacaaccatcaaccaacaatcaattaagagtaattgatgtaagttaccaatggaataggaagagaaatagagcaactaattgtcatcaactagccatgaaccatactccactacacaaccatcaaccattcatcaattaggactaattaatataagttaccaattccctaatcaaatggattaattctcaaaactcttcatcccattgatatcccataaaaaaatgaatacacatgaattcctagcataatgagccttggaatttatttgatttaattgatttaaatggatcaattacccaattaaatctatcagacgagacccatatctaaagtcctgggatgggacgaatagtcctccgtcccgtattacttcgtcgctttaagattttgtttgcaatgtttgattattcgtcttattaaaaaaattggaattcttatttattttgtttgtaacttgttttattatcaaaattactttaagtatgacttatttttttatatatttacactaatttttcaaataaaatgaatggtcaaacgttgttgtaagatatttattatgggacggaggtagtataatttacttgtgttatgagttgttttatcacttatagtattttaagtataatttatatcttacacaattatataaaatttttaaataagacaatggttaaacatacgctcaaaattaacggtgtgatccgttaaaaaacttgcttctgtggaaggccggctcactggaaacgagatcgaggcgatgacgacatctgcattttgataatccacggatattaaggctccaacagtagaatgttcacatgatctcacgtcgtcacatgtttatcttctaggagtgagagtgcgtgcgtgctcgctcgctcgctcgatcgatcgaaatgaaaattcaagctgagcgtgtgcgtgtgttcacccatgccccattattgctagctagcagcttgtttacaacaacgcggagtggctccctcactgtgacgtgccccgcatcaaagcatgggtagaaaaaatggcagcgtcgtccatccctttcttcgcaacgccgggtcggtttccccgtggcggacgtacgccgctgcgaaacggccgaggaagcggaaagggaaacgggcgatcgtcgtcgtcgtggtggaccagtagctgtagctgtagcggcacaagctgagggggagaagtagaaatgagaatcggggggggcggcggctaatggccacaggaatacgcacgcgagtaggagatcaagatcgcggcgggtggcgggtcggggcgtatagtttaaaggcgtgggtcgtggcgaggagcgccccacgtcgcgccgcgccggagccccggagcgccagcgccgcaagggattttttttttgccctctcttcacattctcatttgtgtgcgggttcgccgagcccgcgtcgcggctgcagctaggggagggtggctacgacggctgttcatggagattaactgcagcttgattttactggtatggttaatttggcgtgaggcgttgagcagcctttatcatttcctcgcttgaaagatatcagctgcggagtattgtgaaaatcatttccttgcttaaaaaaattggtacagtacattgttgtgcagtaactttagcaaagctgtatcttgaattatggcacattgggcgttgaaaagggacacgtttgaggcccgtttgaactgattgttttatgaattatttccatattcaattatgattatgtactcaacaataagaataaattaatcattgtaagaagataattttaatgagtacagcttagaacaaagagtagatgtcagtatgtcacacaaccctatgtattttggtttaagttgcagaaagctttatgatatgtcatatataaccacagatattatgacctatagtctcataaacccacactgctaaccctttttatctactataaatatgatttctaaacttataaccaaaattaaatttataagttcgtttaatccgtcgtctaaatgttatcatcctcattatcactctgtgcattctaaaatataaacatttctgcacatatcctaaaatgcttatattttaaaatggagagaataaattaaaatagtcagtagtgcaattttatgaaacctgaagaccataatacctaggttatgcaccgcatatcaaaaccaccatggttttatgcaactcgaaaataaaataaccagggttctaaaatatactccttatggtagaagaagtttcttttgtcgagcaaatatatttttagagttgtggaatgaataatttgcgaaataattgcaaagtagctgaacgggctcgaatttaaacttttgtccttgctaaaaatttaactttgcctagtttgttttttgtttaagaaaaaacatttatcaacaaacacacggtaagtaacattctgcattctgccactgcgttaattcatcttgggtgaacatcatatttacccaacccacccgggttaggtttcttgtggtggaaccagtccacccgggttcaaattctagacttgacacgggtgctcgcatttatggctaattattctttcaatggtaggcgacgtacccgtcgacagcgaaacgcctgtggtgacttcgtcaatctcaagatatgccggcccagtcttccggaggtgctcataggggtagggtgtgcgtgtgtgcgttcataggggtgagtgtgcgcacgttgtgagcgtctgtttctaaaaaaaatattaggtaaacatcatattcaattaatattgttttcgatgtttagcagaagtactaccaattagaaaaagtagcatagtgggccatttgctgaagcgattggggtagcggggctcatctcatatttgcagcgactacaccattttttttgcttgtggactgtgctgtcaagacaagaagctggctggttggtcattggtgtcctggaaggcaacctatcttcatttcccaccacagttttatatgctccactttctctatccctttctttctcactctcccctcttttctctattgcccaaacacacctctaattataaatttataatatcctttagttcccataggccaagtttaaaaaatatatttgcatggtcaggaggattcatgctccatgtttttttcccttttggccggagaccacgcgttttgcaactgggcgattaatgaaaaccaatgtgattgttcggcacggtcacacgatattaaacacaccaactattttaatttcgtttctaaaagaaaaaaaactattttaactttagatgcgtacaaataaaatgtcaaagaaatataaaacaaccaaccatataaaattccttatgaactttccacctctccctcccaggcaatgcctatagcttaaattgcgaaaaccgttagttgtaaggtccaataataaaatgagcaaaaaaaatgcattttaaacatccagttttggcaggtgtttgaggggaaaaagaaaaggagaaagagcaacacaattctttccaattcttacagtagacgacatcgactattcagttcgggtaaattttaccaaacggccatgggctcaccagtatccccagttccccaccaccacgaaaccgcacaaaagccggtgaattttcccgtaatttgaccgaaaactagaggccaccgcgaaagcgtgattaggccggacgtaaaccgaaaccgggaaaaaggagataaaaaaaaagaagggaaaaaaaaaggtgaggaggaaagaataaagcaaaacgatcagaaaattcgatttgtttaatcctctcccccttcttcctcgtccctctgctgctgccgctgctgcttctcccccttccttctgtgccacacactcgcgaggagaggagagaagaggaggaggcgaagaaaaaaaaaacctaagcgcttttccctttcgggaaattccgcgcgctcgcctcccccgccgcggcgccaccgccgccgcccccgccgcggattcgccgccttcctcaggcggcgcagcgtgccgcgcaggcgtcgtcgtctcggtaacgtgtggctctaattcgtttttttttttgggtaggaatgtcgctgttaggggtcgacgagttctaatccgtggtctaaccctacaggtaatcgcgcgaggggtcgtggtcgctctgggatggggttgtggcgctgagatggtggtgggcggcgcgaggttgtgttcgccgtgaggtatggttcccaaccgctgaaatttgggggggcgcggaggatggtccggcgaggggtgatctcattgcgagcaggatggcggggacgcatggttttcgtagggtaggcgtggtcgagatggaagcggcgacggcggctgaggtggccggtgccggcagcggcacggatggcgatttgcagattaaaggcagcaaggagaatggtcagactgcggagcagccggcggccagcgaggcgcttgagatgccctccactccgctcccgctcccgagggacatagattggtcggagcatttctccttcttcaattcggtgggcgggtttgggggcagcatggatggcgcgaggggcttgactagtgttggcctatctaattctgagtcgaggccggatagtgtaacccagatccagagctgtttgaacaatgcagacgagagggttgaggagctcacattgaaaaattgcatcagctccgatgcgcaacatgaggtttcagctggtggaagcacgagcagcggggagaagcctacagttatgaggggtctgtggggtaattttacaaggatgtcatggagagctagcgacgtggctaacagggaaaaattagcagcgaatcgtggtgacgttgcaaacttgagggtcggtgacatgcccatcagggaaaatttggcggtgagcttcggcaacaatatgatctcacgaaatgatgcatccaacaaggaaatgggaatgagccatggggatcatgcgaataacgagttcaatttgccgtttggtaatcagcagccttttctgtctccacggcctaatcagaatgagcagcgagttgaaagggagaatgctctcatagtgagtagcttttcagctagaattctggatcagatgaggagtaagaatgtaacaccttcgtctggggttcagagcttcccatttaagagtgtgttgaagggtaaaggtgttgtatatcaaggtgcacgagaggagatccaagttcaaggtaatgcaaggaccagagcccctatggataagattcgcaagatccctaacataccacaggattccatggctagaatggatggtacaatctttggcagtggtggaaatgttttagaaccacagtgcgagggaaccagcctaagggaactaattaagcctgcacgccaaacaatgagcaagtttgagaaaatgcacttctttaagcagattcttgatctcgtagacaaatctcatgcccagggttttagtttacagcatttgcgcccatcatactttactatctcagcctcaaaccaagtaaaatatattggttcttatggtacccaagatttatcagccccaagcaaactggatattgcgacggatgatattttcaatacaaaaagataccttgatcccaaagttgagtcccaagattctaatggcgataatgcttcaatcacaaagtatcaaaaagttggtgaacaaggatccattgctgtaaggcgaccagtgcataccttttgggctaatcacagagggggcaaccaaagtgaaggtgttgatcctggtgctttgtggcagggcaattcgagctgcactgtccgagaacgttttaaggctgcagaacctttctatggtggcagtatgccctatgctcaacgaccatcaagttctggcaaccaacagtcagtatttgaattgaggatgctggaggaaagctggtacagaagtccagaagagatcagtcagttgaaaggcatacttccatcaaacatctacagccttggggttcttttgtttgaggtatgccaattgctttcatcacatatcctgaagtagtcctccaaacactttgtagtgttagaaaagtaaagtgacattgtgcaaatgctatttattttcttaccccatgaggttgtttgtggatgatttttactcttaagccatttgatgaggagttcatgctgtttttatggttccacttatgagtagctgaaaaattgggacatgtatagtgcagagtttcctacttatcctactcaataataagtatatgagtatgctgtctcccttatttgtttagcagcagttggattgctgaaatgatcggttactattatcataattgtatttctacgaatttgagatatacctgattgagatgtgcaattctgactgacacaatgcaacagtcttcttgtttgatgaaataatattgtttgcttatctaagctgcatgggcatattattattcttttttttaacatattcagtaaaatctaatctagccttaactagtacagaaggtctacaggatattccattaatagacttcgcatgtgcacgcacagacaatagattatgatggctactggaaatcacattgaattttatcatttctagtttccgtggaattctttggtgctatcttaagcctggcttgtagttgacaacattctctttcctaccagctcttttgctgctgtgaaacatgggaggtacattgtgctgcaatgtcagatctccgtcatcgcattttgccccaaattttctttcagaaagtcctaaagaagctggtttctgtctttggttactccatccagatccctgttctcggcctaaggcaaggtgagcatgcttgtctctctcagcggtcatcagaaagcaagatacttggtgattaattggataggatcaaatattcatagggttacattttggcaatttcgtaagttacacttcatactctaggcagttcatttggctggtggagtaaaggatgagatctcaagcataattaattaattattagtttgttgtacctggttacttaatgctcctggctcctgtattaacttagcttgcttctattttttttaatatagatacactgctagggctggtattttgttgaatgttgaactgttgagcttt

SEQ ID NO: 46688 - DNA, 1656 bp, Oryza sativa
tatctgttcacgatggatacataacttgtggttctgaaaataatgaagtgagtattatatacaatgcggttactttaattgttatactgtcaattgggtgttctgttgagttgaaaacttacctgagttcttgttaagaaaattatatgcccaggcctcccccaccctcaactagttcgattgacatttggtgttcttttttttttcaccatttcttcctttgtaacgattacccaagtcgtgccataaatttggccccaatcataacaccttggttctatgttacgtagtaggatggtgaagtttagattatgctcatttgaaggtttatacattaaacatctcatgtctttatgtgaagtcttatttgtgaacactttcatgatctgaaatcaatgtctcatcttatatttcttctgttaacctttttgtagaaaaagttctcatgtatttggtgttgacatgcaggtattttcttattacaaaacctttcccatgccaataacttctcacaagttcggttcaatcgacccaataactggacaagagacaaatgatgataaccaacaatttgtgtccagtgtttgctggcgagggaggtcgaacatggtagtggctgccaattctactggcagcattaaagtgcttgagcttgtgtgaataagttgatgggaactttagtgaatgggaagatctgaatcctaaggttgccatactgcatggttgatgcttagctgcccttgtatatttccgtgaacgtctgccttcgcagcaggcagctactcaagcatcaaccatccttcggttctgggcttcattccatcagagcatttgcaacactcagtttaccccattcaagcaacctacagcgccaaactattggtggtgaagagatcggcgaacaaagagaacaaagagatcttcgaaggtatgaaaggtactggcaattcttgaagatgattgccaccaccaaaatattttgtttgtatggcgttttgacatagtacaagtcagcattttaaggagggccttaggggtctgtacagattagggtcacaaagggtcgatgtaatataatatatcatgaaattggatatgcttttgggctaaaaagccttacatgatacatctactcgagaaatatcactgggaattaactcagttttgatgtgcagtggcaagccgtctagtacagttagaaaaaggtgattttgtatcttgaagaagattcggaagagtaatctagaaaaggtgtctgtagtttgaaatagaaagcttaatcaatttttgtgtatagagagaccttgcaacaagtgttttggctcgccgattctctgattgcgcgttggtgccggtgatagcgataattgactaattttctggttacgcatttcgatcaggtttcatatgattggattattgtgtaatcaacaattcaacattcccgtgcttgcaatttcttcattttgaaacagaataaaacgcatgcgcccattaatttggtctagtagattaagcctgatttggaagagcattgaatcagtttataatttgtatagttgttcttttgacaatacaagacatttcaggaactaaaagcccatcaatacaccagacagcatgcatcgatcggcagccacgtcacagttcacaggc

SEQ ID NO: 46689 - DNA, 8740 bp, Oryza sativa
  unsure (1)..(8740): unsure at all n locations
aaccttattggcaggcagccaaacatagcaagaacacaggttgtgcactgaaaatgtttgctgcaaacttgtgatcccctacacacttgccaatattagggaagagagacaagaaccaacagcaaaaataggcaagaagctaagctgccaatctgccatggattccaactccattacttcctttatgtcttcctccttgccaacttttccccctccctgcggctctcccccttacaccattacaatcttttcttccattggaggaagtaaaggttaggtttgtagcatagggagagtctagggcggagagagacagaggaagaagaggaagaagctatcggccacacggtcaataaagagagcggcgagaatggcgagcaggacgcagtacgccttcttgctcctctcggccttcatggcctccctcttcgccggctcggccgccggagtttaccacatcatcggcgccggcaaggggtggcggatggctcccaacaagacctactacgcggactgggctcgcaccaggaacatcagcgtcggcgacaagctcagtgagcatatgcattgagaattcgcaattttatctgatcttttggcgaaaaatttgaagtgtttgggtgaatcttggaacaatctttgcagtgttcctgtaccggagcggggtgtacaacatcgtggaggtgccgaccaaggagctgttcgacgcgtgcagcatgaggaacatcacaaaccggtggcagaacgggccgaccatcatcgagctcacccagcccgggccgcgctactacttctgcggcgtcggcaagcactgcgaggaaggcgagaaggtggccatcaacgtctccgtctccgcgcccacgttgcccgactccgacgccgacgccgacgacgacgacgcggacgacagcgacagctcggccgccacgccggccaccgccgccgaccttctcatctacctcgccggcctcgccgcgtgcttgctgccggcattgttgctaatatgatcggcatgcggagtcgcagctgtgtgcagtgtgtgtatgtgtgcgtattgtggcaggcaggttgggtgtgtcagtgtgtgcattgtgactgtttcttgcaactgtgtgcgtgatgagattagtacggagtaggaattaacctttggcttttggtaggaacaaagattttctacacctagatgccatggcacctatcatttccatgcgactcaaatagttatagaaaaatttgaaaatatttagtagcatcgtttgtgatgatacaagtctatacacaaacacgcaggactaaatttgatctacaactagagaaacaaaaataataaaatcagacagtcaatagtatccgtacagtgcatataaaatttgttatttttgtttcttcatatatcgatcaaatttagacttgcatgtttacatagtgtctataatgtcttatattatcattggactatcttatcaaattttatgaaatattttatataattgtttaaattacatgtatacatctaggtgtagaaaatactttttgcttttagtagcaagtgtacctgcaattttgcattcgatcgctcacccgctgctctcgtctagccccgttctttgattgctgcctcgtctcgtgccattctccaaatcgccaccaccatcgatctccgccgacatggacggagctctgtggcgacattatcgttagccgccagcccgccacgtcgtcggccatgggcggagctctcagccgacatcgtctgccaccacgtcctgtgcgaggtggaccgccgcgtggtggaactcgtctgccgctcctggcgcgcggcgctcgtagggctcgatccccctccgccgctcacgtggctcgtcgtccccgactccgaagccggcggccctgggttccactgcgtccccagcggctgccgcacccaccccttcttcaccccgcacgccgcacgcctctcgcgctgcttcggttcgtatgacggcgcctggctcttcctcgccgtcgacgacgacgacgaccaagctcaaggcaaagacgaccacgtcctcgtcaacctcaacagcttttacttcctcgacctccccccaacatgttcccagaaatgaagttcaacaacagcgagcttgtcatcgtcgccgccaccctctcgagcgagccgaccgaacaagctaggatgcatcatcgtcgccggcatcatcaacttctgcccctgctcccagggccggtgggacacatcgcgttctggcgcatgggcgatcaggcgatcttatgcgatccttcgaggcagacgagacgtgccttgaagtggaggacctcctatatacttcaatggagatttcctattcctcgctcgaggggaacacattcgtgtgtgtttagatggccaaatgggccgcccggcccggcatggcacggcaccgtgcctgggccgaggttagtcggaccggcacgacccgacctacacatcgggccgtgccgtgtcgtgccagcctatgacattctagtccagggcttaatagaattaatagaatgctcatatcaacaagttacaacttctattccggaagctaatctccaaagaactccgaggttaagcgtgcttgcgcacgagtgaggacaaagtgtgcagaaaagacatgtgttggtctgtgagggcagtctatgacctatgaaagctataaggtgtaagcgggctcggcctgggggaaggacgttacaaagtggtatcagagccgaccctcgcggggcctgggggaaggcgggacgttacaaagtagtatcagagccgaccctcggcgtcgatctagcctagggcttaataggattaatagaatactcatatcaacaagttgcaacttcttttccggaagccaatctccaaagaactccgaggttaagcgtactagagtggtcatgacacatgcgttggcactggacacatggatgtggccaagaggggacgttcctggcctggggttgatcgacaggggcgtcgatctagcctagggcttaataggattaatagaatactcatatcaacaagttgcaacttctttttcggaagccaatctccaaagaactccgaggttaagtgtgcttggcctggagcgattgcctggagcgatttggggatgggtgactgaccgggaaattcttcccgggtgagcacgagtgaggacaaagtgtgcagaaaaatatcaggtgtaagcgggcccggcctgggggaaggcgggacgttacacagcccacgggcagcacacacgctccaggcacgacccaataaaactcgggccgtgctggaccggccctaaggcacgacagtctatcgtgcttctccacaaaataagtctatttttgctccttcaactctttgggctgtgcctatatggctagaaaataagtctattttatattcctcttctctttgagccttaccttatactatgatttattaagtctattgggtccctctactttttttcttcgattgtgtcgggtcgtgctggcccaccgtgccgagggagcaacccaggcacggcacggctatcgggctgagttggcacgggcatgaccctagtcaggctgtgccgtgcttgggttgggccaaattgttgtgccttgggccgggctgtcaggtctcgggccatctggccatctttacgtgtgtgcagtgtgccaagaagaagaactggtctttgcataccaattgctaatcctatgcacaattgccatatatctcacacacgcgtacactttgccgtacgtttcacatgccacctcagcctatatagctcaaattactaggaggcgcctacatatcaagcactgtttcaccaagtagatcggaattgtttcactaagtagatcgaaaatgtctcagtattttaaaaagctgaaacacaaccaaatcaccttgtgaaacatttgctacaacgtatgaaaaacggtttccaaaaaactcgggcgctgtttctccttatataaaaacaatatttcagcaaatagcgaaaggatgttttaactcaatgcaacatttgatccatacataatgaaacatcatgagtacacttactgaaacattgttggtgaaactaaaaatgaagcggattcccttaatagagcgtttctgtaatatgcgggtgatttgttgcaacggcgtggaggcgcgggaggcgcccgatttttctgccgctgatcgggcgcatgatcgccgacgttttccaaataactagccacgtttcacacgttcaactacattttgatctacggcgcttctacgaattgctcgggttaaagtctatgcacaaactaactactgcgaactttgaatttttctttcgacgaaaacacactaactagtaatacttctgtcggtgacatgggaccgggggtatcttgactagaggtttggggcagctgcagtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccatgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccagtcacagaccggtcagatcgcgggttaggtggcaacaggcggcctttcgcacgcctcgccccgtcccgtcggaatgatgagagcctccaggcactcgtccctagccggagccgacgtgctaactcctggagttagcacgtcagtcccggctagattcataccaggcttcattgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtaacagggagatccccggtgtcaggcgagtgatgacgctgggcctcactcaaagacaagctgtgatttagctttcaggcgaaggcgcaagctagtttttttgaagatagggtgagtccccacccaaaagaagagtaggtagaagtggtgcatgtggtatccccttgagatataaaaggaggaccttgctcacttaagaggggaagaagggggagaagacctgagctcgtagagaagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgctgtcacgcccggaatttctatccaaaattccaaacgcttacatgtgtgtgaaccctcgtctaggaatcagccgaggcacacaataacaaattgataatagagtacaattattactctaattaataagcgaataaaatgtcattacagaggtagatagttcctctcaatcaataaagatctaagcagcggaaagaaagataaacggcgcagacgactccattccacaggcagcttgaccagggctacacctaatcctccacaccatcggcatcactgtagaactcttcctctgatgaatgattgcaaggtgagtatatgacatactcagcaagtcacgcagcaaatatgcaagtgcacaggataacaaaggatggcataatagggttccatttgcataaacagcctttaataaacatttcagaatttaataaaacagttaagtaataattaaacaaaattaatccaacgctatacaacataccctgttgtataggcccaaccattctgaacaaccatcccggctgcacagtcctatctccaaaccaggaatataccattccaaaccaggagctaatcaaattattaccaattatagcatcttttattatgatgagaggtgtgagactaatcacgaaagacattgttagacccgcccataaccgcgggcacggctattcgaatagttttactccgatcagaggtgtaccactgtacccacaagacacaaccccacatcatgtcaccatgtgcctcaataccaccacggtatctcggaaaggagttgtgacaataccccttgcacaacacaatccattacagcgcacctttcctggatcataatcacccccttataaacaaggcatggactccctagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatatgctcacaacccaccattatcaggttttagttggcacattaattaattaaccaatcacgattgaccaacgtgaactatcattaagccatcattaaataatagtaaatcttaagttatcccaatagtgtgctaatgtttctaagcagggctaagcaattatatctaatatctagctgaaccaatatataaagctcaactagtcaagttataataacccaaggtatcaaggaataaagtaatcaagaacaaaagggctttagcaaacaataggttaattccacccaatgacattcgaaaataaatgcaatagttgaatagaaacgatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaaatttagaaaaatttaaagacttgaaccaactaaatccgagctaagatgaattagttatgaatttttaaagatttaatcggattaaaacacttatatagattttaatggaattatgacgcaataatgaattatttttgaaaaggaaaaagggatttattgcgtcagcggctagggtttcgcggtggaccgggcgcacggcgacggttcacgggaacggacggccgagatcgatccatccaaaacggacgaccgagatcgatcggtccacgaccggctcacgggagagggcgacgatgacgtcagcggcgacgtcaccactggcggcggctcggcggctcggacggctcggacggcgcacgctcgccggtgaacggcggctcttcggcacgaacggagggcaccaacgggtagagggcgactcggcgaacttaccggtgaccaaaagagcggcggaagaccaacggacggcgacggcgacgaggaagaagcggcggcggccttcgggtcaacggtgacggcggtgctccggcggtcttcggcggcagtgaagcggtggacggggacggcgacgacttggcgatcccgacggtggccttcccgagtgacgacgacgaccgaaacgacggcggcacacggctggacgaacagcggcgacggcggcacaaggctacacggggctagggctttatcggcaacgagaggcgaaggcgagggtggcgacgggtagcggcgacaccggggtccttttaaaggggctaggaggcgacggcgaaggcccacggcgaccggcgacgcgatggaaggttcgggctcggagagagaaaagccgatccgattcgacttcgaatcaaacactttccaagccgatttagccgatatttccaaaggggaaaaggtagaggagatctcgggaaacatttcccctcaatcaatttcaccggatcgggaaaggagcggccggatttggaaggagacggcggcatggctcggctagggtttcgggcggcggcggcgcgacgaagacgacgactccgacaggcgggacccacctgtcagcgatagcgagggcgcgcgcgcggctgcggactgggccggcttgggccgaggagagagagagagaggatttgggccgactttcggcccaaagccaaaagaagactttttaaaacctttttcaatttaaattatttatgaaatacaattccatttattaaaaatacttccttagctcaaataaatcatagaaaaatctaggaattatagaattaagcaaagtatttaataaaattttatctggccccattttatattggaatttattaattaaaattagatcttctcttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46690 - DNA, 15056 bp, Oryza sativa
aagatgatctagatagattggtgctccttaccatatcaaatttattagtgccagactgctgctcatcaccaatatggagctcagatacactccgcaaagcattttcactgcatttctcaactttcctaaaacttggtttagctgcctcagtatgtgatggaacagcagagtccaacttagcagagtcaccataaccactgaattttcgcaaaaacaatccacataagaacataaacacgatgcaaaacatcaagtacataaaattatccagtcaaataattaccatgggagtgaaggtgatgcaaaatcagaagttgtcacagcatcagcagacttgggagccttctcattattctgcaaagcatcctagtttcaagatgtggcatttagcactgaacaatttaaggtccataaaagtgaatgatgtcacaatgtctgaccttgaagttttcctttccaaggtttctagatttttttactgggaacacctctgtaacacgagtactgatgtatttcgatatttttgattgctctgggttccgaaacccattgcttgccctacaccgcgataatagaattattaagtttttcatacaagcaaagtggaacatcactaaaacagattgcagattagctacctatcaaatgccgcagaatggagtgattggtcattagcaggcttgtcagaagcacgccgcttcaattgctctccctgcaataagtaattatcggaacattttcagcattcataagcagctgtactgttttatgcctaaagcagcactcaagagagcagcaataagtaatgtgtgtgcttacactggcctccattgaactaattgtcattaacaattcagccatggaaaggaaacatgcatatataacagaagttatcctaaatgcagtttgaagtgactatgttattactcttctctagcattagctaagtaaaacaaatatcacttgatgcagtaaaatgatatagtaattttttgagatgcgttgggaatggtcttcgtcagtcttttcatatggcataacatatcatgctcattgcatcagggctgcaccatggaaagttgcaaggatatgaattgtccttaaatattgcaggtttgcttatacaaagtatagttaatgtgcattcttggtatctggaacagaacagtattagagaatacttttttatcaaatggaaatctcttgaaaccgcacacacattttcaccaaatatctcatctaatatcacatcatggtgaaaataaagaaggcatagttgacacatataaaggttaaaggcaaattactctgagttcagagggggtcttcctcttcatcctcggaactcccgcggccctcccaatcaacaagtcaccattcagagaagattgaacagcggcttgagccattgtagcctccaatcttctagctccgcatcccttcctgtgactcaccaaaccataccttcctctccctcaacctgtacccctaaaggaagaaccatgtgaccaaaaaaaaaaaaccgtttaagttagagcaaatttgttactatccactagcagttgcactagcaggttgggtatggatctagttcataaaaatcccaagcaagtgagaggattggatctgagctgcgcaactcgcagcagtgcagtgccctcgaatcaaaccgcggcgcgccgccattgggcactagaccctaaccatggcccccgcatttggcatgaaaagaaaaatcaacagcaaagaccccgatccagcggctgggcggcccaggaggcgagcgagcagctgggatctcgacggcggcgagcgtcggtgggctcggcagcgaggggtcaaatctcgaccggatggagactggagaggaaggcaaaggggagagctcacctgaagcctctccgccgcggcctcccggaaccttctggaagcttcctgcggcggaggtaggtaggcggtggcggcgaggagagaggagaggagaggggatttgaaaagaaggggagacgaatgggggcggtcgcggattggggattggattttgggggaggagtttgaaccctcgcgagggagatgggaaaaaaatattttggtatttcacgcatcccgccataatggctggcatcggagtgaactggggatgggccggaacttgggccgggaattaggcctggctgtctgaacatgcgaccccgcacacgcatgtacattcacttttgaggtcagtttcaaactcagctttgtagtgtggtgaaaaataagtctacttcgcatccttggtggtgcgggaaacggtttttctgttgacatggtaggttgactcgataggtcaacaggtggaattcacatgtcagcgacttcctactcatctcatcttctttttcacctccactctctctctctatgttcctcctctatcaccttccaaaagaaatggagcccgggaagggtggcgatagtggtgaggcggagccgaggaagggtgagagaagacgaacagtggggaggggcatgtcatccctaacaaacggcgactgttgtcctctcgtcttgagcctaggagctccatctccgtgctgcttccttccgtctcgaacctgaggaagagtggggttgggattcgtgagggtgcccaccagcaccgtctttagttggcttcgaggacgcgtgcacttcgcactacagaccgatgggggagtggcaggagagggcggagctttggtacggtgtcaatgtcctctcccgttgggcttgcctaattgctccgggggggaccgccttccatgacttcggttcgtcaccactactgccctccccaggtccatctcgccaccactaccaccctcctagctacaaccacgtctaattgactactacagttgacggagcttggggctccttaccgggagaccgcgcaggcccccctttgccggttcggccgggggcgctaagtgaggttcttcgccctcgtcgatctgaggatgtcagcgagaagaatcgcgcaagacacgggcgacgtagacaggttcgggccgctgagaagcgtaataccctactcctgtgttttggtggatctgtgtatgaaggagttacagagagctcgagagcgagagagagttcaggctctggaaccaagtggccggagttcgaatcaaccaaacccccattcggtgggcaaggtcctccttttatatctcaaggggataccacatgcaccactcctacctactcttctttaggatggggacccaccctatcttgaccaaaacttggttcgcgccttcgcccggaaactaaatcacagcttgtccttcagtgaggctcagcgccgtcactcgcccgacacaggggacaaccctgttattccttcattaatgggcgaagatttgcgatggccgctgtccggatgaccctccgatgggatgggtcatacgtacctccactccgctgaaagcagatgcaacgtgggagcatggttgcctgccaatgacgtgaccggcgtcagaccaatcacaaaccggtcattcttgtccaccgcacgtcagtttagcatgctgcacgtctgcccttcttcatacaatgacttccttgcaatggttgcgatgaagcctggaatgtatctggccgggactgacataccaactccagggttagcacgccggctccggctagggacgagcgcctggaggctctcatcattccgacgggacggggcgaggcgtgtgacaggccgcctgttgccacctaacccgcgatctgatcggtctgtgaccggtcacacactgcgaccggtcacggaccggataagcgtgcgctgcgccgcattaaatgcggcgtggcgcgctcgtccaacccgcagtaaatgcggttaggtgagcgccgctgtgctcacctaacccacacacgtggtgccaatcccacagggggtcggggcgccccagccctcggggccgaaacgggagcggcccgacccctcggggagacagagggaggggtggccacgtcactctcgggcccgacccccccgagggggtcgggccacgtgggtgaccgcggctgcccaatcctctagtcatgatacccccggtcccatgtcaccgacagtagcccccggcgttacgccagggcgatcgcccccctggagggaaacgctcggtcgtgacgccactccttaggtctggtgacaggtggggccggtctcttcaggcgggcagaaacccagcggtcgcaaatcgcgcacatcggcaagggaaaaccgatcgacaataataagtggtctcttcaagaccgctacattactcgagcagcgcgcgaatcgggacgagccggttcgtttcgcctggagacatgatgatggcgatcttcgcgtttggcgagcgcgattaatgcgtgcacgatctgtcccatctcaactgctacggccgcacatctgcctcgtgcgccgcaaacggacgagttgggttagtggaggcgtgggcgcgagaaacgagggggcgaggtagtaggcgcgggaaacgaggagccgggaatagcgttggcaagggtataaagacgccgaggaagagattcgtttccttcctctcgccattcttccccttgcctccgccatttgagctctaactcttcgtttcctgtgccctacccttgccgcactcactcgctctcaagctcctcctccgccggcgtcatggcacggggctccgcactgcttgacggtagcgtgctgccgccttcctgcatcgtgagcgagaggcaggccgggctgccgcgccaattcatgccggaatctgccaccggccgggaggtggtcgagctgggcgagggacgcccggcgccacactacccggggcggtccgtcttcttcctctctttcgcaatggcggggctggtcccgccattctctaatttcttcatggatgttctggagttttatgatctccagatggcgcacctcacccccaacgcgataatgacgttggccatcttcgcgcacctgtgcgagatgttcatcggggtgcgcccatctctccagctgttccggtggttcttcaccgtacagccggtgtcgccgccgacggtagtcggtggctgctacttccaaccgcgggggcaggtgctgcaacgctacattccctgcgtcctccccaagaagtgggacgactggaagtgcgattggttctacacccccctcgccgacgaagcgcgcctccgacttccgagccagcccccggcgcaggcctccagctggcgggcgacggtagatctgggagacggctacgacgccgttttcgaccgcctggcgggtctgcgatcccaggggctcacgggggccatggtgttcggcgactaccttcgtcgccggatcgcgccgctccagcggcgcgcccggggcgcctgggagtacaccgggcccgaggacatcatgaggacccaccaggggcgccaatgggactgggactccgaggacttcaggatagtggtccaacgggtgctgaatctcagctccgtggaggcatcccttatcccccaaggtatcctccccctctacagcgatccagatcgcgccagcatcctgaccatcatgcagacggtcggggcgtcgggggagcgggccctccgaggccacgatggcgcgggcgggagccgtaggggggaacaatctaccccgggaaggggtcgtgcttctgggcctcgcgacgggggcccggggggcagccgccctgccgacgcccgggggaagaggaagctggagggcacgcccccccatctcctccccgagggggcggggcggtgcgtgccagcagcaggcgcccggagggtgccgcgccgtcgccgcagcccgagggggagcgaaagaagaagcggctccgcaagatgggggggaccgagccatgccgggggggacctcatctcgcccccaaggtggtcgtttagctgacctcctcgcaggttcgttcccgcgcccatcgcggccatattcgttcttccatctcccaaggcgagttttcactcacccgtttctttttgccttctggtttttcttctgcctcagcgagatcccatcgcccccccccccccccgccattccaagtccggccggtccgaggccgaggagacggcgaccgcggaggcccggaggcgcgaagctgaccggcgagaagccgcagaccacctccgggaagccgaggaggcagcccaggaggccgtccgggttcgtcaggctaaggaggccgctcgggaggaggccagactccgccgggccggggagtccgcccgggaggaggaggcggcgcgcgcacgccaggcggcctgccaaacccccgacccgactccgcccgaggcgacgacgacttccgaggccacccacgacgaggccgcgagcgcgccgctcgggcctgacccctcgggcgatgctcgggaggagccagcttcgggggacgcccccgagtccggcacgtcgatcggcgggccgagccgcgcggcacccacaccgaggcggctctcccctctaccttccgctgccccactgagcgcggagcccctcctgcaggccttggccgccgtgaacaccacggtgctggacgggctaagtgcccagatggaggtcctgcaggcagagcgggcggagctcgacgcggcgtgggcgtgcgtcgaggaggggcggcgctcggtcgaggccatggtggaggcgggccgcaaggcacaccgccggcacgcctcagagcttgaggcccgtcgtaggggcctggcggagatcgccagggaggtggaggaggagcgggagaccgctctcatcgccgccgccgtgctcgacgaggcgcgggacgacctccgcctccaatacgtgagccggacggcggagctagagaagaagcgcgacgccgcccggggagtcctcgacgccgccgctgcctgggagcggcgggcggcggagaacgaggcggcgtcccgccagcgcgaagaggcccttgaggctcgcgccacggcgctggaggagcgcgcccgcgccctggacgcgaaggagaaagaccttgcggaccgcgaggccgccgtcgccacccgggaggcaacactggcggcgcacgaggccgcctgcgccgaagaggagtccgcactccgcttccgcgaggacgcgctcaccgagcgggagcgagctctcgaggaggccgaggccgcggcgcggcggctagcggacagcctgtccctccgcgaggcagcgcgggtggagcaggcgcgccgcgatctggaaggcgcccgcgccgagagggccgcactggatcagcgggccgctgagctcgaggcgcgagcgaaggagctgaacgcgagagcgcacagcggcggggctgccgcgggcgacagcgacctagccgcccgcctcgcagccgccgaacacaccatcgccgggctgcaaggcgcactggactcgtccaccggggaggttgaggccctccgtttggcgaacgaggtagggcccggcatgcttcgggacgccgtctctcgtctagaccgcgccgggcggcaggcgggcctctggggcgggcggtgcgcgaagtacgccgccaaccaggggggcctcgcccagcgcctctcagagatggccggggtcctctggcggctccccgaggagctcgaggagatgatcaagtcatcctcgagggacctcgcccggggggcggtggagctcgtattggcgagctaccaggccagggaccctgacttctctccgtgggcagcgctggaggagttccctcccggaaccgaggaggcgcgcgcgcgcaggtccgggacgccgccaaccacatcgtccacagcttcgagggtacggcccctcgactcgcgttcgcgcccgactccgacgaggagggcggtgatgacggcgcggacgacggcgacgacgaggccggcgacccgggtgcgtcggagtgagcccccaggcccccgcgaatcttaacgacttttccttcttcttccgaggccttagggcccccttcttgtatagactgacttaatctgtaattaaatctgtaatcaaataaagaggaaatttctacgttagttatgtttgttgtgtgtatgatacgaggatggtctgtgccacggtccttctgtgtcttggcttgaacgagggctcgtgcccaggtcccaaccccaagcggcgcgggtcggggctagtgcctggggagatccacgtgtcgagactggccaggccgggagcgtggtgaccgagggttatggatgacccgattgtgggcctttgccgattcccccccggagttcaccacgccccggggcacggctcggttctgggccccttttggcgattttagccggcccgggccaccgagagcaggatcgagcacgagcgtgctaattcaagccaagattcttcaaaaggaaacaatagcacagacacagtccttaggaaatcgaaaatgcttttattgaaatacggaagagaaaaaagataagtatatgcatgtggtagcccccggccagccctgtacgcccgaggggggggtgcggggttggcccgagcccgagacatgacacccgacccccactaggggtagaagcgatgaaggtgctcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcgaagggccacgcgccgccttcgctcttccaggtagtcgaggtcatctcggcgaagctgaccttgatcagcctcgcaatacatggtgacccgaggggacctcagggtgagctcagatgggaggaccgccttcgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcattggcgcgctccacttggccattgcttctggggtgggcgggggaggcgaagtagagcttgatgcccatgtcttcgcagtagtcaccaaagagctcactagtgaactgggtgccgttatccgtaatgatacggttaggcaccccgaaccgaacagtgatgcccctgatgaatttgagcgcggagtgcctatcgatcttgatgaccggataagcctcgggccacttagtgaacttgtcgacagcgacatacagatactcgaacccgcccggggcccgcctgaatggacccaggatatcgagcccccagacagcaaacggccatgaaagaggtatggtctgcagggcctgggccggctgatgggtttgcttggcgtggaactagcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcaacgccttgttcccgaggaatgcacttcaggaggactccgttagccgtgcgccgatagagggtccccttcaccagcacgtagcgcttggagatgcgccggacgcgttcactcccttcgcggtcctcgggtagagtcttatctgcgaggtatgcctggatctcagtgatccaagcaatcaatctaggggagctggaagcgctcccctcgggtcccgaggcctggactccgacgggcctcgggggccattcaggcgcgtccgtctcccctagggggtcgggtcgcaccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggtgctccatacgctgcacctggcgcacgtaagcgtccatctgcgggtcagagcactggtactccttggagacctggttaacgaccaactgggagtcgcctaataccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcaccctgaagagacaacgagccgtcgaactgcatcacccagtaggcggtgtgaggcagctacgaggggcccgagctggccttggggacggagacgggctcgggagctggggtccactctgccacaaagtcggcgagggcctggctcttgatcgcgtggcgtggttcaaagtgcaaatcgaactcagagagttcgattgcccatttcaccacccgtccagtaccctctcgattatgcaagatttggccgagggggtaagacgtaaccactgtgacccgatgcgcctggaaataatggcgcaacttcctcgaagccatcagaatagcgtaaagcatcttctgggcctgagggtatcgggtcttggcgtcccggagggcctcgctaacaaagtagacgggccgctgcacctttcggcggggccgatcctcttcgccaggggccgcatctccggggcgctcctcgtccgagaggccacgcggggcgcactcggcttctgtgccgacgacctcggggtcggaggtgacaggcgcggccttcccgcagtggccccgaggccatcctggaggtcggggcgcctagcaccgtcggacaagcgggcggagggccagctccggccgtcgggggcctcgggccgccgttcggctcaggggcctctccttcctgctctctcccgggtcgagtcgacacagggtggggatgcgcggagtgagggttgtcctcgtcacgctccacgaccaacgccgcgctgaccacctgcggggttgccgctaggtagagtagcaacggctcatctggctccggggcgaccaggactgggggagaactgaggtacgccttcaactgagtgagggcccgctcagcctcctccgtctaggtaaacggcccggaacgtttgaggagcttaaataggggtagcgccttctctcccagcctcgatatgaaccgacttagggcggccatgcagccggtgacgcattgcacatctctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtctttacaaccaagtcatcaacataggcctcaacattgcgtcctagctggctacccaaagaaattcgagtagtacgttgaaaagtaggacccgcattctttaacccgaaaggcattgtcgtataacaataagtccctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcacgccacctcctcgcggatgaaggcttgacgttccggggcctgccgccgcactttctgccggaccggccttgcgcctggccgcacggcgagacggtgctcaatcacctccctggggaccccgggcatgtccgccggtctccaggcgaagacgtcggcgtttgcccgcaggaaggagacgagcgcgtcttcctatttgtcatccagaagaccaccgattcgtgtggtcttggacgggccatcgcccagggcaacctccttgaccgggacctcgtcgcacgtgatcatccgctgcctcggggcggctgggacggaggtgctgagcctctcgtcgccgcccgcgggcttggacaccgcggcgaggtggtccgcgcgctgctccatacaagcaagcgtgactttgaggtcgccatggacggtgatggggccaccggggcccggcatcttcatctggagataggcgtagtggaccgccgccatgaacttcaccaacgcgggccttcccagaaccgcgttgtagggcagactgaggtccgccacatcgaagtccacccgctccgtgcggaagttggcgggaccaccgaaggtgaccgggaggtcgatgtgacccagcggccaggtgtgccccggcatcacaccgatgatcggctgggacggccggagcaccatccccggggccttgatggcatcgaaggctgcgggggaaagaatgttgagagctgcacccccgtctacgaggacacgccccaacttcacattgcagacggtgggggataccaccatcgcgatctgtcctccccgagcaacgcacggcgggtggtcggtctggtcgaaggtgagggcaacctccgaccaccacgcccgccgcgtcgcctcatgggtaggggccgcggccagaagctctcgtttcatggccttgaggctccggcgagaagcgtgagcgcacgctcccccatcgacggtggcgacggtggcctcgggctcctggaaccccaggtcatcgtcgccatcgtcgatgtcctcggcgggggccttctgtttggcctcacctcgccgattgccggcgggagtcgccggggccttgccctcacggcgctcctgcctcttctcctcctcccacttcctcgtccgctcggccaaacttttgaccgcgcggcagtccgcgaggtcgtggagggaggtgttgtgcacggtgcaccacttgccagtcgggcgctccctgctgggagcgccggcctccttctttttgtcgctcgcaggcctcccctttcggggggcccgcgaagcgccctcgacggcgaggacatgaccctcgtcgtcggaacaggccgacctgttcttcctcctcctgtcccgccgccctgatcgagcggcggactcggggacggccggagctgccacgccagagccggaggagttccaggtccaggcctcctccttgcgagccacacagtccgcgagctcaaaaagctgcgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaacgtacgagcgaagagactcatcgtcccttcgctgtaccgcgtgcaagtccgcatcttcgcctgggcgcggatatgtgccctgaaagttcgtggtgaactgctggcacaaatcctcccaagagtggaccgacgcgggtggcaagttcattagccaaccccgcgcctgacccttcagggccatggggaagaaattcgccatgaccctgtcgtcgcccccggcggcctcgatcccagtcgtgtagatctggagaaactcggcggggttgaagcttccgtcgtatttttcggtgatggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccgttgcgtgggcggcgcgacgatcgtcgcgccggcgctcgatatcgagccaggcatctgaccccccacgcacatcttgggtcggaggcgttgacgagggaatggcggacgaacggtgggcgacggccgccgctcgccgcgccctccgcctcgacgacgtggagccagcggcggcagcgccagaggtcccggtggcggaggaccgcccgccggcacctaggcgctgctgcgccatcatgaccaagtcggccacgtcatccagccaacgtcgggctggagtctctggatcggggacgacgggcgggtgacgcaggagtgcgcccgcagcctggagcgcgccctggggcgtgccgccattgccgtagacgaggcgacgacgcgccccgtctcgccgtcctcccccgtcgtccgtgggcagcgaagtcgcggatcctccgacctctccgagcacctcccctcgcccaagatttcggcgagagggggacggtggggtgcgagcccgacggcgcgggttctgctccccgtcgtcaccactagcgttcggagagaggctgtgcgccactgcccgttcggccattgggctgagcgggagaagcttggcgcacacgaaagaggacgagggcttcgaatgacacgcgcgccctctacctggcgcgcttgatgacggagcttggggctcctcaccgggagaccgcgcatgcccccctttgccggttcgaccggggcgctaagtgaggttcttcgccctcgtcgatctgaggatgtcagcgagaagaatcgcgcaagacacgggcgacgtagacaggttcaggccgctgagaagcgtaatgccctactcctgtgttttggtggatctgtgtatgaaggagttacagagagctcgagagcgagagagagttcaggctctggaaccaagtggccggagttcgaatcaaccaaccccccattcggtgggcaaggtcctccttttatatctcaaggggataccacatgcaccactcctacctactcttctttaggatggggacccaccctatcttgaccaaaacttggttcgcgccttcgcccggaaactaaatcacagcttgtccttcagtgaggctcagcgccgtca

SEQ ID NO: 46691 - DNA, 16306 bp, Oryza sativa
  unsure (1)..(16306): unsure at all n locations
gccacctaacccgcgatctgaccggtctgtgaccggtcacacactgcgaccggtcacggaccggataagcgtgcgctgcgccgcattaaatgcggcgtggcgcgctcgtccaacccgcagtaaatgcggttaggtgagcgccgctgtgctcacctaacccacacacgtggtgccaatcccacagggggtcggggcgccccagccctcggggccgaaacgggagcggcccgacccctcggggagacagagggaggggtggccacgtcaccctcgggcccgacccccccgaggggttcgggccacgtgggtgaccgcggctgcccaatccgctagtcatgataccccggttccatgtcaccgacaacagtagctagctctttcgaataacccttatgattacatacttatctttccttcctctcagatatagcttgaatcactattcaagtatatgtgtaatatacaaaatcacaaataaaacattgaaatagagtaaacacatctaatattgctattgctagtgttaggattattaggagagggcagtggaaaaataactttgcaaaactactccgatactttttagtttggtcttacctattcttgcagaaaagatatattctagacgatgttgcttcaaactccttcaagttttgctaaattctatgtgttcaaagcatttgtttacatatcctgaggtatcaaactagtcatccaccacagtttgatgcataatccattttacttaagttacgatttgggtcttacaccttatccctcacacatgattttcctttccttttttgcaagacctatgggcatggtttacccatatgtgtgatgcacgcaatgtatattaattatagccctttaatgtaatttcaatgctaatttgtctgtttatgttcttagtctcttaatttttacatagtttatcgagttttcaggtgacctttactatttattgttttattattttgttcgtaccctcaattttattaagattggtaacgaatctattgcctaggataatggtgttggtcctggagaggatctggaacaatttatcctaaaaattccccatgacaaattccatatgcatagcttaagtttattatcgaggaaaaaaacttgtaagttcatatttttccaaatgtattataccgttagtgttacccctgtatatctgttatatttttgttctgagaaggttgtttttgttgatttaatgcgtgcattttttttctgagctgatttgggaactaaactatgtaatttgtgcctcaagaaaaaagataacctatcaaataaacgccatcctccactgggtaaacaagtaaacaactggataagcatataaagcatatgggttcagtatgtcaccacaaccggtaagttttctcccttgctacaatactactattgcctgttacgtaattatgcatctctatcttatctgatgactacatacccattggttatcacatttcgtaagcaaattaactcaagaaaactttaaaagggttgttgtaaaagatcacgaggtctcaaatccacatcgataaaacaaagataccggcacaagttagagctggcatatgtatcccttacacatcatcacccagtgttctgcgcgctcgtcgacacaccaccagtaagcctcacgcttcaccaaaactgcctcgtgtcggcatcaataacaccaagatgacacaaaatgcacaccatgtccaccatatctccttacacgtcgtccagccggtgcgatacaccgaaaaaccatcacgtacgcttcgtccgatcccgggctcgtcgtgtgtatattggtaaaaacttggacgacaccatagaaggcatagctaagcggccacgatgggcttgtttggtagagctccaactcctaaatttagcttcaggagttggatctagagtggagttgtggagctgcctaaatccagctccacctctatagttcattttatgagagaggtccactcccattttagatagaactgaaactgtttggttgagctccaggtggagctggagctggggttgtgccaatcaagcccactgatacattgttgttccatgccagcatgccttttatctctttttttctaaaagagaatgtttttatgctgcattccccatgtgtgtttccttctaaaaacggcttttccctcctcgtcttcttcctcttcgcctcctcctcttatacccatctccattcctcccccatcggccatgctcaagcagcagcagcagcagccatcgcccacactcgtcggagggcggcgttgcatggaccgcggcggcggcagtggcggctcgatggggctcatcgccttggctctcgcgtccaccggcatcatcatcatctcctactccctccaccgccgcttcctcgccgacctcaagctctccatcggtgagatcgatcgatcgaactacaaccaaaatcaccatagaccaatcgaaatcgatactagcattcaacttctttttcattcttagcgcgagcgcagcagcagcaggagcagcaggagcaggagaagccgcagcggccgcgggagaggacgaggagggtgcggttcgccgccgacgtggtggagccgtcgtctgacggcgacgagtaccgccgccggtacgtcgccggccgcccctcaccggcgatgggcaactcctcctcctcctcaccaccggctaggcctttcgctaggcctcgacgcgtcatgcaatcacacccagctagctagctagcctcggatttgcaggaagaagacgaagcttgcagagtttgcagtggcagtggcagctagatgtgatcactactactagctgtttgtatcttagctttcgttctagctagcagtaagagtttagaatactgcgataataatcaataaaccaataagcaactcccagcttcgaatttgatcggttttggttttagttaatttattattacctgtaaggattatgtttcgattcagtttacattagttaattaattacttcgattgatctgcgatgtctctgatcctggagaggttggattcttggggactctctgtgtgtctgagcttgtggtatttgcgacatgtgcgtatagagattaattcttgtggtgtgtggtgatttcctggctcgtttggattctcttcttttgtggttgatcatggatggtgtaggtgaaagactggtaattagctgtaaagtattttcctattctgaattcatccttgagagtaagatctgcaacttccatttgccaatcacagcaagcatttttggcatatatattggactaaaccagggcattgatcattcagctagtaatgggtctcaacagcaataaaataaatatgagaataaatacaatagggtaaaatatgctataaacttttttttctactattgatgcaaaaaaacactgcaccaaagtaccaaacaacttaatcttgcaccactcacaagttttgagaaaggtatacctattttgccaaaacagtgggtgccattctttcctatgattcctgtgctacctatccattcttcttcaatgattacagattgcatttgccatgaagaaatgcacctctttgctcactggagagaaactgaagagaaaaaaaattacttgaaccagtcttgccgaggaaattcctattatcaatttgtcatcgaccaaaccattgtagcaaaactgtgggagttcactgttgaggaagctccttcctgcagcctgcctgacaagacccaagatggtaagtttagtagcttgatttgcaggccctgtacacaggatcaaggtatcaaggacgatacaccagttcaacaatgagacattaccatgtcgagggagtgcatactctcaagattttgaagactgtaggggatcctcgttatgctttgtgatcagatcatagttcatggatgctaactgagaaatgttctgtttacaaaggaaaagaaaaaaaaaacttactaaccgagaaaaagattcaaatatcgtgggaacttcaggtgagggttaccttgaatgagaaattgctgaaagaatatttcactgacagtgatggagctccgaattcttccatgctaccaaattcatccgcctgttaatgttttttagaaaaggttagaggtatgaggtgtgggctacataatgatttggatgtctaaatcagaagggggattttagagggattgatctagcatacatcttcctcataatcacaactgtgtggactactgccacaactcatgctactagtttcacttctatcgtcgtagtcgttagaggctacattcacttggtcgtcccatgtgtgacgacaggcaaaataacttgtatcatattcatcatctgtagaaggaataaatgcagcctacaaaaattgaatccagttcagaaacttctttggaggcagttttttgaggttcctgtttttcagactgcccattagtttagcttctaacctgttgtctggcaatcatatcccaatttatatctttgaagaaaggatgagcctttacctgctctaatagcatatgtcagttagtggtgtgtacataagaggtataactggaatacgaaaaaggaaaacgagtacctctccagcaccagttgctcctaatctttgtacagggttttcaattagcaacctgacatgaaagttaactgagttaaaatagcatctgtagaatgcagatttgttggacatttaacactacagattcaccaagaaataccgatgaacagaaataaacggttgatagcaattatttccaaaataataattttctgacttacttgtcaatcaagtcatatgcttcgaaactcagttcctctggtacttgtggccaaggtatttcccgattcattatattatcaaatattatctgtaaataaacaacattgttatgttactgctggaagacctttgatagaccataagcanntcgagacatnnntggagtannattaaatgaacaaactggctctaactaatattcgtcttcttcataaataaattctctctcttagaatggttccaacagacaaccaacatgttagtagtaccaacaaattagttagagccagcttgtcactatattatcaaacatgccccgttcgttccctgacttgggagagatatttttggcgcactcaaaacaagaaagctcattagcacctaattaattaagtattaattattgtaaaaaattaaaaaatggatttatttgctttttaaaacaacttctatatagaaactttttgtcaaaaatacatcatttaacgaggaagttgaagttggaattgaagaaatagaacagagccttagagaggatagaagactacctgcggatgctcagcgttgaatggaggaattcccacaagaagctcaaagagaatgacgccaactgaccaccaatctgcagttggacctgcatgtaagagtgccatatattttaatagaagatgcattttcacttttcgatgaaggtaaacataagttatatgtaataaattcaacaccctaaagtactgacttaaacattttaaagtaaatgtaagttctacgaaaaagatgcaaacagaccatgggtcatccctagcagtatctcaggggccaaatagtctggagtacccacagctgcctgtttttgcctttgctctcgcttttgtgcacgttgttctgcatctgcaggttgatgatcaccaacaagaacattgctgacatctggaccagacaaatcatcggtgctattgataagaccaacttttgatagcccaaaatcagtcaactgcacggaaatagacaaccgccttcattctattgcatgaaaaaaatacttataagacttgaaagtacagcaacaattttcctcagacaatctaatcatcagtcaccgataacaacactaaacacataagaacctaataggtaataggtattgaaagaaaagaaataagaaggtagtattacctttatatggccatcacgggagatcaaaaggttatcgggcttcaaatcacgatgaatcacattcatagaatgcagatactccaaagcaagaacctacagatagaaataaaaatgcctacgattaaaacttttaaaataaaggaatggctaaggatggacctttctgatttagttgtttgtaaaatactttcaggaaataaaagacactcataacttacaagttcagccatatacgtccttgccatatcttcatctaaacaacctaggtttctcaagagggaatacagatctcctccattcaagtactccataacaagataaaggttttccctacatgtgaaggagtagaaaaatcgaacctgtccattacagattgaagttaaatgaaatccaatatttcattttacttaacattcgaagtacttaccacaaatgggttgcgagctgatattaagatatcacgttctgccaagatgctttccactgcattcttgcggatcatatcagcctttttgagcacctggattcaagatgaaaccatcaggataaaagccaccactgaagctagcaattcaattatgtaagtgctatattttttttatcctagtctattctttttcgccgggccggcgaattatcctagtctattcatttgaagagttctctaataatcttgaagcaaagcatccatttagtttcatcaaaattcaaaattcacactaaaaggatctcaaacactttccttttctcaacagaaggagaattaaaaagccaaaattgattatttttaagtttatactcttattgcacttgatccagaaggacactactacattggcacaaataagaatctgaaggcccagtgtaatgaccattaccttgatggcaaaaaggtctcctgttacccttttctttgcaagaaacacacgcccaaatgcaccacggctgattggctttataatttcaaagtcctcaattgaggtacgatctttgaatttaccattcatctggcttgttctcgagcttacactactctccataggaccatcttcgtctattgaacctaatgaatcagtgtttgagtcctctatttgtccgcatagttgaataaatttctccctgagaagccataatgttaacgagacactcagggctatattttcaggtagtgtaatttgagtaatgaaacagcaatgcgtatatcgctgctaaggacaaataaatctgaagatgctaaggggcacaaacacatgtaaaacaattaaactggcattgcacttactgtagtaatttagctatccttcttccaaatgtctccacaacaagggcatccacttttcttgtgtcaatgacagcatttagatcttctagataagagctcaagtcctcaagcgagttgtactcagagttttttattctctcgatgcctctagcaatagtcattaagctttcaacctgccagtatggtaaactaccagtctagatcactgaagaagcaaaatttaacataacctcaaaagaataatgttccaactaacattctgacaagaacagaatttaatgaaacaaggatcagtattaagttgatatgcacaaacctgctgaaagttctctagttccacgaatgccttgtgtttagtcagctgtgactctgcgtggctagttcttggtgtcagcaatggtgactgtggcatgctgcctgacgctggtgtgagtgctccctgccaatttcaccagcaaaatgtccacaatccatatgatcaaaacagagcagttataattgtttcttcgaaggatactattgtttgaggaagaagaggcaactacctctgaaaacaactctgtcgatggcactgtcaacagatgagacagaatatcatgatccatggatccatcggattccgttaaactcgacgtgctacctcttgcagtctcattatgattacattctgcagtttgcgggctcttcgattcaaagcaacccaaaaccctcccgagcacctcggcaaccctctgcagccgctggtccgtattcaggcccttggaatcacaccgatcagctaatgtgcacactatgaagtgcccttctgcgcataccatggggatctcaaagtcacagatcctgcatatcatcctcggcttcccgtcgacgatgatctgctgagcctctgggaacccagatggaacctcgagcttcacagcagagtccccaagatatgacaatccgtcggggtgaatgctagccgcgtcaatcctctcgacgatctcatccacggcgaccttgttcctcgtaatggccttcttctttgtaggggtggtcttctcctccgttgtcggttccgtaaccttgtgcagggtcttctcggcaggggatggaagcttcttccaggatgagatcttgccgccgctgcccggggaatcgccgccggtgtctgacgaaatgacacggcccgccgagaagtcgagggtgagttgcttgtgctccagcatcctccgcctgatgagcctctccttgagctcggtcaagctggaggtgctcttgcggccgagctcgctggagccgccggcgaccttgaaggggtagaggccgaggtcgctgagctggtgcaggctgaggacgtgctgcttgtcgtcggcggcgacgtatccgccgccttccttgcggaactggaggaggcgggtgcagcgcgtgaggatgaagaggacgcgggtgtgcgcctgcttgaggacgccggcggtgagctcctggcggcggtcgtcgaggccctggacgatgcactcgcacttgacccagagctcctcggggctcatctcggcgcaccgctgcgcgacgacgagcaggtcctcgagcgcgacgcgctcctcgtccccgtcggccttgtcgagcgcgccgacgaggtccccggcgaacaccccgagctcggcgtcgacctcctccttgagcctgatgaactttgtcctgatggcgccgatgaactcctccgggctgttcacgcacccgcgcggcttccgctgctgcagcgggtggaggagcggcccgcgaatgttgagctcgtgcgagaagctcttcacgtcgggcgcccgcttccgccgcccgctcgtcgcccgcaggatcgccctgaaccgcggcgagtccatctccctcccgctcgcatccagcatcaaccgccgcgccaacccaccgccgccgccgccgctgtccttctgctgcaccaaacaaaaccacccggcgttacatcgaacacctcatctgcatccaccaccaaccccgcgatcgcaaacacccaacacccatctcgtcaccttacctccatgatcgatcgcgatgcgacgcctccgagacgcccaagaagaagcaaatcaaaatcaaaatcaaatcaaatcaaacccgcggggggcttcgtctcgcgcacgtcgccgccgtgttcttcgcactaaaatagcaaacgccccatgcaaaaatgtggcgcactagtggcgatccgatcaaaaacaaaaaaaaaaaacgaaaaagaaaaataatttaacgaatttacagtctccccctccgcttcccgggtaattgcgactggcacgtgggccccacaaaccggtaaacggtcgagcggtttaacgtgttcctcgccgaggaatccgggtgggcccgcgaacccgtcatggtatatatggggttcggtcgcgcaaccgctttcccacctctctctctcgcatcctatctcggccgtcggttttccgccgcacgaatctcgaggagggagggagggagggcaacggcaacccagcccccgccgcccgccatggccgcagtggcaccgatcgccatgcccgcgcgggtgcaccaccaccaccaccaccaccgccgcgcgttggcggcgtctccggcggcgttagcggcggcggggaacgggttgtcggcgacgaggagggtgaggaggtcgccggccgtggagatgaggcgggagcgggagcggcggcgggcgcgggagcagcagccgcggtgcggggaggtggcgggcgggacggcggcggagtgcgccgcggtgttctgctgcttccccttcgccgtcgtcgagctcgtcgtcctcgcggccgtccgcgctcccgccgcgctctgccgccgcgccgtccgcggtgggcgccgacgccgcgtccgctccacgaagccgaaggagacgggcgccatggacatcgcctccccgaggtcgctggccgccgcggccgccaaggccaggaaggtggacgccgatttcccggccacgcccaaggccgaacacctcgttgacatggagaaggaggtgtgggcgagcttctacggcggcggcttctggaggagcccctcacaacgagaggacaggaggtgatcgccgccggcgacggcgccgccgccgccgccctcttcttcttctccttcaccacggttgttggtttcttggcttttctcctcccttttcttgggaaaagagaagacagataactcgatcttgtgattaatttagccgcaattgaccaattttttttggcaattggctgtgttcttctctctttccaaaaattttgtcgattgggaggaaagaaaagaaattgatagggaaaaaacaaaattgtggagtcagattgatgcctgctcgatcgttgatgtgtcctcttctttgccgtgccgatgatctccattccattgtgcttttgttattttggttttgattatacaggtgaaagaattcatttatcatcgttatgtcgattattcgttgattcacacgcagttaatttcatgttaagataaaggaaaagaacagttaatttaatttgtgaaagtttatggggattctggtagattttgtgcgatggtaagagatggtaaaccattattcggattctacatagttactccattcgtccaagaaaaaaaaatcctagctatgaagcacatgttcagaatttgatttttttttaagaacggccggagggtgtaatcaagaaaaagattgcatacttgcactgcgtgtttggggtttcaatttgatataggattgcatagcatcgcggttcctattgaagtttgatcattgccaattgaaatttttgatcgccgcatcgttatatatgtggatagcaatttatagttgaaatctgatatatcttcatacttgtatatttgattcatgcttgttgactctttaaaccatggaatttttactttatataaaaaaagtttaaaacaatttagtcttcttgtttatcttgcgccacaaaaattatcacttgattgtcagttcattcatagattattcacttgatgttctttcggagattgtcacatgatgattatgtgggatgaccaatcctcaagtgcattccgagtgtattgtgtatatactctgcattttcagtgtgctgaatacttgcattgctaatattcttttgtgtacaaactaaataattcattgtcagataaaaaaacaattatttgttaagtgcactgcatgctttttcatcaactagaaaaagaaaagaatgcatgggttcatctttcgatcatcttctggagctattttgaagcaaacatcaaacacagcagccaccgcgctcacatcagatgatggatgatcgagctgaactaagagtctaagacctttctgtactttgcactttgtttttgaagtctgtacttcttatgtttgtctgaagctttgtaaaactgtcccaccattaatatatactacctccttacacaaatgtatgacgttggtttgagctaaccaacgtcaaacaaaaaaaatatggtaatggttataaggtagagtctctccacctttttaccttaaaaactatttttgaagcgaactgtggtttttagctagcttttaaactctgtttgtgtaattttctagcgggcacttttttagccaaaggtataataatcattgttgcctctcttctgatctcaagaatacttgctgaaactatcaaaaacgaaaaaggaaaacgagccgaagaaaccgcagcaattttacgtgggcttggacgggaatgcagcctcagtgcggcccatgtatgctggcccggaaaggaattgcggcctcggtgtatcccatattaattgggccggaaataaaggaacaattgctgttttgccactcctgggcgccctatttggcagtatgacactgaaaaggagctaattgctccaatgccactagaatgaacaaaaattcatttgagatgccactgtcgtttcgttccgtcaatgaccgttaactgctctataaaacttctattgaccgttaaatttcccctcatttcggtaaaccctagatcgatccctccatgggcgtcggcggcatcccgatgggtgtcggcggcgggttccggtgagcagggagctgcagctgtgtcctggagggcggagcgcagtgggtccagctagctgagcggagcgcggcgggtcttggcgggcggagcggctacggcagcgtcccggtgggcgtccggctgcggcggggtctcggcgagcaggtcctagcggacggagcggctgcgtttgcgtcctgaagtcgaagcgtggcaggtcctggaggacggaggacgaggggcccaaccggctacagcgatgtctcgacgagcaagttgctacggcaaagcttagcgaacagggctgacatcgagctgtgaattcatcgagcagaatggaaacgagtgaagttgtagccccgaataggtactaatcttgtaaatttgctttctttccgtccagtgggttggttgattaggttttcttccatgctatgtaggggcaatttaatgaaaattttggttagcgtccgcgctttctttagcatgccagatggtaagccgaagagatacatagatcgcagagaaattccaatttatattaatccagatcggtattccttaatggatttgagtgctgacttagcaaagtcaatagactggggttctaggcagttgatttctttttggtatcctgatccagattgtaatgatgaggagtacattgaggttcgaacagataagcatttgtggagattgttggtacgacataaaccacaaaatttgcttcgattgcattgtcaagtaaatgatttagagggtcctattgctgtttcaccttcaaaaaacacattggaaaatcagaaatcacaagatcggacaccatgtactcctcctcaatgcattcctttgctagctgagcagacccaaccaacacaggagtgtacaccaaatgagtgtgcaaaaaatgagtgtgcactaaataagtgcccactacttgagagtccaaagtgtgcaagcaagaaaaagactgcagctaatgtcaaagatgggttggttgatgtagacttgggcactaaaaattcagggttagatgctgaatccttagggtctagcgatgattcattagctgtggatagtaacagtagctacacaagtgccgatgattcttcttcatctgactcagattgtgaatatgaaccagagagttgttctgaggactctgaagtaaatgatgatgttgactctgatactgatgatgaggtagtttacacacatgatattgacaaaccatgtgttgatgagggtacatttttccaaattgtcaatcaatgcaaaaaagcttttacacaccatgcagttctgaaagcttatggcttttttactaagaagaaggacaaaacaaggttgattcttgtttgcaagagggcaaaagaagagaattgcaagtggaggattcatgcttcatgcaagagaggcaccaagatttgccaggtaattgaatttgtgtaatctaattttgctatgttctgaacctttcaatcatctttaatcttgccattttgatttgcagataaaaagaaacaaaattgaacatatatgttcatctgttaataggtcaggagaagacatggcttcaagcagttgggtatgtgacagagttatcgacatgcttagagagaaaccaagcttggggccaaaggagttgcaggaaaggctagagcggaaatatcacattacagttggatatgacaaggtttttaaagggaaagaaaaggcactagagaaattgtttggcaaatgggatgatagctatgctttgctgtttactttcaaggaagagctattgaagtcagcgccaggaagtaaagttcagattgatatcgaagagcataatggtcagatgtgcttcaaaaggttatttatagctctcaaaccttgtattgatgggttcctactgggctgcaggccctatattgccatggacagtacacatttagttggaaaaaataaaggtcagcttgctgcagctgtagccattgatggaaataattggatgttcccggttgctttcggtgtcatagagacagaatccatagaaagttggacttggtttgttcaaaaccttcaatcagccattgtgtcacatcctgattttttttgttttaggatttataaattatttaataaattattattagaattcattttaaaagccttgaaaagatctaattttaaataataaatcccaatataaaatagggccagataaaatttcattaaatactttgcttaattctataattcctagatttttctgggatttatttgagctaaggaagtatttttaataaatggaattgcatttcatgaataatttaaatggaaaaggttttaaaagttctcttttggctttgggccgaaagtcggcccaaaaccgctctctctctctctccctggccaaagtcggcccgcagccgagccgccgcccgcgcgcgcgctcccgctcgctgacaggtggggcccacctgtcagtcttcgtcttcctccggccggccgccacccgaaccctagcgccgcgtcgtcgtcgtctccttccaaattcagccgcgcctttccgtttccggtgaaatcaatagaggggaattgatccccgggaccccttctaccctttctcttttggaatcgtcggctaaaatcgtttggaaatccgtggattcgatctcgaatcggattcgtctctctccccgaaccctagaccttccttcgccgtcgccggtcgccgtgggccttcgccgccgcctcctagcccctataaaaggacccccaagcccgccgctacccgccgccaccctcgccttcgcctctcgtcgccggtagagccctagctccgtgtagcctagcgccgccgctccagccgtgcgtcgccgtcgctccagtcgtcgccgtcgctcgggaaggccgccgtcgtggtcgccgtcgcgtcgccgtcctcgtccgccccttcattgttgctgtagaccgccggagcctcgccgtcgtcgtcaagccgaaggtcgccgccgtttcttcctcgacgctgtcgccgtccgttgatcttccgccgttgctttggtcaccggtgagttcgccgtgccatccgctacccgtaggtgctctccgttcgcgccgccgcgccgtcgttcgccggcgagcatgcgcgcccgagccgccgccggtggtgacgtcatcgctggcgtcatcgtcgtcgtctcccgtgagccgccgtagacccgatcaatctcggccgtccgttttggatggatcgatctcggccgtccaaacccgtgaaccgccgccgtgcacccggtccaccgcaaaccctagccgctgacgcaataattcccttttccttttcaaaaataattcattattgcatcataattcaattaaaatctaaataaatgatttaatccgatttaatctttgaaaattcataactaattcatcttagctcggatttagttggttcaagtctctaaatttttctaaaattgagatctacatgttaaaaatatccacctgtactgttcatgcttgtttatgtgctgttttggtgtttttgctcttttctgtttagattccgacgtttccggagagtccgttttcgcaggagaagaatttgaagagttccaaggccagcaaggcaagtcacacagatcccaaacaaccctttgagcatgttgatcccatttaaagctattgtttctattcaactattgcatttattttcgaatgtcattgggtggaaataacctattgtttgttatagcccttttgttcttgattactttattccttgataccttgggtgattataattggactagttgagctttatatatattggttcaactagatattagatataattgcttagccatgcttagaaacattagcacactattgggataacttatgactcactattatttaatgatggcttaatgatagttcacgatggtcaatcgtgattggtt

SEQ ID NO: 46692 - DNA, 2997 bp, Oryza sativa
ccaaccataagccagcgtgggcaacggctttaccttttgtatagcatggttcattgcggagcaccagactgagaagtggcggagataagcccacgggggtcgctggggagtccataccttgtttataagggggtgattatgatccgggaacggtgcactgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctcttataataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatttttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacacattggccatccttcaggtttagtcattagctcagatgcatgcaagggcttggaaaatgcagtgagaagtgtctaccccatagctgagcatagggagtgttttaggcacctttggaagaacttcaaaaagaagttccatggagcagtatatgcggagaacatgtagccagctgctaagagttatacaatggctggattcaacaagcattatgatgccatcaagatgcaatcaccacaggcaatccaattcctcaatgacaaccaccctatgttgtggagtagagcgaaattctcagaattgtccaaggtggactatatcaacaataacttgtcagaatccttcaataattggataaaggacttgaaagatgtgcagattgtagacatgatcgataagattaggcaaaagatagtgtccaagttctgtcatagagcagaaattgcaagtaagatggaaggagtcatactgccaagtgtgactaaagatctcaataaacagagcatagggctaaagaaacataaagttagtagggtcacactaactacagctgaagtgactatccctgataaccaaggtatggaactaaggtatgcagtagacttagatagccaaacatgtagctgcagagtatggcaaatgtgtggcaaaccttgtacacatgctattgctttcattacttcaatcagaggtgcatcaatgcacacatatgtggataagtacttctctgtagagaagttgcagctagcatactctgtagtgtttaggcccataatagggaaacaccaatgggaatttgtggatcctggctttaagttacaaaaacctagactaaggaggaagcgtggaaggccaaggaaaaacagaatcaaagcttcagatgaatctggacaaaatacaaagcacaaatgcaaagaatgtggaggatttggtcatagagataaaaactgccagggaggagaggttgcaacaaagaagaaaaggaatacaatgtatgccactttcatttctttgtacatcataagtgtattcatttcagtctaatgatttattacatgcaggactaagagcaactcaacccctgaaatggattcagggcagggaagcaatgacccttccatcactgtccaaatgccaccaaaaaaggcaggaagggctaaaaaggacagttgcactacatcttctaggttagtttaaatttattcaaactaaaaatactaactacatcttatgtgctaattactctagtgctaattagtcttttgtttgcaaaccttgaacagtgctatgccaactccaaacattcccaggccaagaaaggttggaaggaacaaaccaactccagattccatctagtgttgtcttccaatctgatggaactcaaaagtggcagtagatgatgatgctctatgatagtctatgaaactaatctgtgttttgttcttggagccctttgttcttaagtactggaacaaaatgtgcttttgttatttaatgtctcagtcgcttgaaccatggtatgttctttaagtactggaacaaaaatgtgcttttgttatgtaatgtctaagtcacttgaaccatggtggctatgttctgatgaaaccagttgtgtgcctatgtgcaagttgatgatgtttgattcatgtatgtttatggattgctcgcttacatttgagctagtgctaatagaatcatatttgttgaaaaatcttattcattaattaaatataaacaaaatgacccatcctgttaaaaaatacaaaataaatctaacgtaaggaccatggtacaattatgcatataaaaaaataaaataaatgtcctgcaacctcaaaaatataataggaaaaaaatatcgaaataataccattcttcacaaaagcttgcgtcatttatatccaactaccatcggttggcaaagaaacacaaaaatccgtaataagggcagactggtaattgctccaatctaacgtgtagactaaccgtcttaacgacagagtgtcattttggcgtgcccaactgtgaaaccagtggcattctaccaattgatgaaaaaccagtggcagaatg

SEQ ID NO: 46693 - DNA, 7924 bp, Oryza sativa
ccagcatgctaatctggttgttgtgaaatataatgaacagttaataaataatacatagaatggtggaccgggaacgtccggcccgagtccgagtaactcggggaaccgaacccaccaccggttcaactatgtattggagttgtattagctttggtaacatccacaacgtactatttgaagtgtcaagccaaaccaaaactagccctaaaactcaagggtaccccaaattccccatcgccgccgcccccgatccggcgatgccgctgcgcccgccgcccccgcctcagggattcctcaccgcgtatccatccgcagctttccctccggtgaagcggccgcatgaggacgacctcggcgccggtgacgtgctgaccttcaggttccactccctcgccgtcttgaaattattcgaccgcatccgcgagtaccgtctgcacgattaccggtaccaggcaacgcgaggctggtacagctccgggacggcgccggaggatgctcttcttccctgtgcggttgctcgaccaccgaggatgtatgggtgcgtgatcggggtgcagcgcggtcggacggtggaggtcgtcgacacctccgacatcttgctcgacaccgaccccggaaccctcgaccgcgacttgttgaagaagaagctcgagacctgtaagttgttaaaccctagctaggactttgccggtgcttaattgtttgtgttgtgatgtacattgtttggttatgcagacaagaaggcgttccctggcttggccattcttgggtggtactccattgacactcatgtgacgaacaccgatatggaaaccaaccaggctgtgagtatttacagccattcatttaattcaactatatttgttcaactgcttaatctgtcagactgtcatttggcttagtgtttggtcatattatgaagaaatgttgctgttggtatgtgagacgttggtcatattatgaagaaatgcaaacaatttttttcccctaaggttgcattcaaagtttaacattggggataaaatgttcactgactgctgtacgaatgaaaactcaaaaatgttgatgaggttacaggacattgggatatagttttagcatttgcttgagctcttatagaatctgagtaatatttggttttaaacttgtacacggaatgattatggctggtgtaacagccagcaataatagacaattagatatgctatgctgggatgtgcactgttcttaaactttatgtaaagctctagcttgtttgtgtggatggatggaatggttgaaatttggttttagcttgagaatgtattggaaatatttatcaaatgtatgtctgtgtgatctgtgctatacattttgattttactccttgcatgacatttcttcccttgtactatttttatccagttgatggatgctagtggaacaaccttttatcttctattcaatcctgcaatgaacctttccctgaaggatctcccagtgactatttatgaaaaaggtaagtgaagtttgaaatcgttgaatatttcctaccgtgtaaaccaccaagtttagcactcagcttcttatttaattgctatgttcattaacttaactgtttagagcaataaatggttgttgtttagtgatatgaagattaacttttttgtctctgcaatttttcaagtgcactctaccaataggagtcccactccgttaatctttgtccaaggcaaatataaaactgaggttggttttctcccttttgtttgttttgttacaaatgttatgtacttatgtactaaattacaaccttctttgacagactgtagaggcagagaggatatctttagaccatacgtgtcctgtagtttctgatgttagtgtgccacctcttgttggaaaagggtaagtaaaaaaatctttttcctttttctgagatgacttgaatcacttagagataaatgtggggtatacaaaatcacaaacaaaaaaaataaatgctgtaactttggttttgcacttgcaggcaacatgcaaatattatgcagacttctggatttaagctgatgctgtttgaaattccttctggtttcgcgatgtttgaagtttcacaggaactgattgcacgccctaaggtactaaacttgtcctccaccaccctaatttgatgtaaccttaacttgtcctccaccaccctaatttgatgtaaccttatttctcataatcaatttttttttttgcaggacatatgggcacgatttgcttatcaggatgacattacaaatgtacattttacttttttcaatgctaatgtgtttatttctgttctcgatctcttagtttttaggccatattttgatgtgtttcttgccatcctatttgcaggttattgttaccctgggttctattcagatccataacaaatctgttgctagggatattattgttggtcctggtgacgaactgaaagaatttatcctaagcttttgcactcacaactacttaattgttcaagatgtagagcttaaagatgttatcgagaagaaacttgtgagtttatttctatcgattttgctaaatctttgtcgacaaaattctcctttgaaatcacttgatttttccacctccaactggtgttgagattcgtgctaataatgctccaaaaaattaaaggtagcttacccaccaacatcggggcagtaggattcgattcgatataattacaatgtaacttctatagatatgttgataagttactagttcagcgttcttttagtagtgtcatggtttcgagtttttggctgtccacgtagggtgcctgttaatctgaacctggacgttgcttggtagcgtcaagtagtttgtagatatataattcatctattttagtctgaacagtacgctgcttgttgcatgtttggtggttacaaaaatccgggtgatttgattggaaaaaattgtcgagtgctatatagctagtcccatttctataactagttgatacccttgtgctttgctgcgggatatgggatatgtggatgaatgcatattatatattataaaaatggtagataatgaattgacattgcttcatattgagttctgaaaatacaataaaattgtaaatgatatgtcatgtttgcatgatatttataataattgctagtaggtcataatgtggcatacttacatatgatttaaatactttaaataatgattgctaatgggtgatgatgtggcatacatgtttagctttaggagttagtaagcatcaactttataatcagatacttatgggtggatgtgatgatgttttgggatggagggagtaggattcttttgttttttgtggaataatcattgtttacctaatatatcatattcttataatttttcagaatatctattgttactgtaatccaactgttgtcggtgaattgacatggggactgaactatgtcctacataagttgttacctcaagagcaaagtttaactcatgagccttatcttccactaagcaaggcaatgtctaagcagataaaagaatatggattcaaaatctcgccacgagaggtaattctcttttctacgatagtttcattttgattggtgtgacttgaggtctagcaaatatctaaatatctaaatatttcagtggcggatccacaggtgggtggggcttggtgcgcaagccagctccatccctttcctctaattagcgactaacgactctaattaattagccattagatgtataccagtacggcaaagaaactagctgaagcgctcattgtctaaattacgttgcaagtgtgaaatatgctcaccatacaaattgttcataggtatgtgtgaatataatgtatagctgcaaattaaaacgaagaaattataagcaataggttgtcttttgatctaatgtgttttgggtttcatctaataatatttgtttggtatatgttagtttgtttcaatcacataactatttctatacacgagctcctcaatcacacaactattatatatattaattgatgtctcattatttcagattgacagagagttcctaagagctatgagttttttaaattatttggggtatatgtcagagcgttattcactgctgctagatcatttgtttggacaatatcgtaagaataatatgtccgacattgaatttgctaaatcaattgcatctcatcttcattcctctgaggtcagtgggcaataaactgatagttaactgaagatttaatttggttattggctaatatgatttattttctttgatttaatacagggaattgtaccaagagatgagagatacactagagcagagattatggagttcattgacttcataattgcagctcctgaaaacagaagccggacgctatcgttcctgcggcgcatcgaggcagcttctattgatgattctcctccaccgccttcactgccaggagggatgggtgtttcgttgttgaagcgtcttcgtttggattggataactgtttgttgtctaggatgtgcagttgctctttaccctttctaccgcagagtatgaatgactttgttataaaattcactatgttttgaggacaaatacatattctctgacctgcttgattagtaccaaattaatccttaatcaaagaccattttatgtagattgcattttttttattctggccctagtattaattaatttggtgctccaaagcatgatcaccgtttgcattcaggctatatgaacttctaatctgtttttccttgagacggaagatccataaaaagcaaatttgtctcctagtcaatctccacaaatgacaaacaaacagggcaaacgacgtatataaaggagcagcatacatactgtacacaagggacgaatcatcaattaattaaattaaagaaataataattaatcaattgctaatgacgctaattaattaattaattgcgcgagtttgtgaggtcccgaggacttgccgtattgcaccgttgccctccggtggtaaacaatggtatatttatgtcatttctttctaaatgtgtatatacctataaaatcattaaaaaaaggtgtttttttttgaaaagtaggagagatgaacaccaaacaatttgtggctcgtcaaaatcaatgggagcatgtagtttaatataatgtgccatgtaattgtgtgatacttatatgtatgcctggacccaaatgcctgcacatgttcgttgctgtacatgaccatacgagtagatttagtgccataaatatcgatttgaagtttaaagagttgtatgaaaaaaatcgatttttgcatgtgaagcttaagtggtccgcatgtaagaatgctcggacctcttaagagagctgcatgcgaaaatcgatttttacatacggatcttttaaggatcggccttgaagtttgattggcctcccccttccctctccacccgttcaaaatttcaccccaaccttatcttctcctcatctcctctcagtcctctctctctctcacttattaatatggggcaattataaaatttaccactgctttaaattgttattgcaagactgctactagaaaattgcaaaaatgccactataactgtcattcgagtggcatctttgtaaaattgaaaaaaccggtggcaaatttgcaaatacccctaataatattatcccctctcacacacttgctttctctttctctctctctcactcactcacctagaacggcatggctagagatggcaacggggaattcaccatcgagggtcacatccgcgtccccatccccgtggtgttaaaatttcaccgtccccgtccccgcgaatcaccacggggctacatttcacccacccccgtcaccacgcggtgaattaatccccgtggttacccccgtagagagaatcagagaagggacgacagacggtggacggcggatggttggaggtggccggcgaagcgatgacgactagaggcggcgggcggcacgacgaggctggaggcgatggcgccgcgacgagggctggaggcggccggcggcgcgacgaggactggatgcagtcgacggcacgaggatggctggaggcggcgtgctcgtcgggacctcgcacgtgcgagaggatgcggcggcgtgcgcttctggagtggcggtggcgcgcgcgcatcttgagcggcagcgacggctatgtaggcgtcgtggagctttggaggggagagggagatggttgactagggttggaatctctactattataaaaattgaagatgtttttgtctgtactttggtacgtcatccgtgtttgagtcgatttttttaattttgttgttctctactaaaatttacgttgtctattaaaaagaaaaaacagtccgactcaaagaggtaaaaaaagaaaaaaatgtgtccgactcaaaagcgattaaaaaaaaccttctgtcgtcactcgtcagtaaaaatagaaaaaaaaatctagagtccgacttccgtaaaaagtctcgccacgggtattttttccgactttttttttttgcatgcgaaagagtttttttcgcacgcacttacgctcttggtttttttgtccctttttttaatccgatcgcgcctcccgggcgcttttattttttttcttttgtcaatttttttgtcaccggttttttctcccgtgcgattctgttttttctcatctgtttttttaatccgatcattcgccgcacgcctcccgagttgaacctgggcgccgtgccgccaccatatcgattgtgcgttttctcctccaatttgattgcaaaaatcgattcctcattcctccctcatcattttctccattattttccctttcgattcggttttaatttgtcggatttaatctcctttaacaattgcgattcctccctcatcattttttccattattttcccttccgattcggttttaatttgtcggatttaatctcctttaacaattgctgatgatgacggcaatcttcctcgatcatttttatcccaagttttacactatgattttagaaaaaaaaatgaaaagaggagatcgtggatcaaaaaacctcaaccaattttgggtgatcgaaaaagatttggccggatttccggatttgatggggaaacaaagagttttacactctgattttggaaaaagcgggaagagaagatcgagtggattaaaaaccctcaaccaattttaggtgatcgagaaagattcgaccagatttgatggggagatttgctccggcaaccgtacggccacgggactagcaaccgtactgccacggatctatcttcgggagactggcctaaggctaaaatggaaggaaggctattgaccctaaacccaggaaaaattttcattaactttttcaattataatgtatatagcgatcccaatatttcaatttattactcagctcttaatatatcagtaaaaaaacgtctttacccgttacaacgcacggacattttttctagtatatatatatatatatatacatgtggttattgggcttcaatttgttgcgccaaaatgactataaagtctaaaacatgtccctagctactgtgaaatcgggtcactgcggtggacggggacagggagtggtgcaccgtccccacctccgccatccccgatggtgatgggttttagacctttagattccccatggatggtagatatcagccatgccatcccttaatgtgtgaattcaccgcggggaatcagtgatcgggtccccattgccatctctaggcatggcgcggcgggcggcagcggcggcgtggtgggcgacagcgggcgggagcggtagtgggctcgatggcagaggggagctcgacctagagcgatgggcgacgtgcgtggatcggccgcccccacctccctccgtcgtcgccggcgccagatcccccgcgagaaggccggcgg

SEQ ID NO: 46694 - DNA, 9824 bp, Oryza sativa
tccccggtgacgatgacgacctcgctgacaacaacgaccttggcgacaatgacgacctccggcaacgcggactccagcggcggcggtgggcgagggccaaggtgggggtggacgtgggcgacggcggcggccctcccccacccggatccaccgacggaggcggcgactaaagggcgacgacaacggtgggcggtggatctgccgcggcagccgtggcagcggtggatctgggtggtgcggttgtaccagcagctggcgacggcgatgtcgatgacaggagtagtggcggcggcagcagcgctagtttttttttctttttttctttttggaattttttttcgtgattttttctcttttgcatgcggttgtgatggccgcatgcaaagacggcgattttcgcagacctttttgtgcttgtcgcccgtatgcaaaaacctattttgtagtcgtgtcttaaaacaaatcagataactccatttttcaagtttaaaataattattttttattaattatgcgctaataacttgtcttgttttgtgtgccgttgaaaatcaaaagcaaaacgctggaacgaatgggcccttgtacatgaggtattcttcatttggaatttggtttactagacattttggcgcacaagatgcgccctatcgatattaaaacccaaatgtatcaattcatttagacgaatcgtgtatcaaaacaaaaatgtataaaaaaatattacaaaattctccagtagtgaatgaaattacttatcacatcactgtaacagcaagttgtgcatagacacaatgtcggcggcttaaaatcaaacctgtagttaataaaaattgatcatcacattattgtaacagcaagcaccatgaacatgatctagttgttattacaaataacactgattctcaatgtcacttaggacaactgcttcattataatagtaagcaataacaggatacaaattttggtgcaaaatatataaaatgaattgattctcagcaatgctttgctaattacactaattttgatgctcatgtcaatccaatgaatcttgagtagcaggttgaatttgaagtcaaaagcatagaaataagtctgattggtcgcatcgatgaaatacttccctcattgaattgttgaaatacgaatttgatgtcatgaaagtggatcttattcttgaccatatactgcaagaggcctagtttgtaacttgatgtagcttcagttctaatctagaatctttaaaacaaaggcatcattgttgacctggcaactacctgttaaacaggtatgtttttccaacgtaatcataatgttaattaataagagatgaaagttagaaatggtaggagctagttggaccaaaatttcaaaataagaaaatactccaaaaacatgttaacttaccaaaatttgggaacagaaaaaaattccaggttatgttctaaaagtaaaccaaatcaaagtatcaacagttgcaaatatacgttatgggttgtaatatgcattctaagcctgcagggaaatatgtttcaggccaagactacagtccagactaattgtcactttgtcagcataatgttcctgagacatcaaagtaagcagagcgcacaagtcaggacatcggcgaaatgattctatggagcaggttagatgcagcaaggcaaaaatgagacataagttaggtccacaaaatgtttaccaaatcagttgttatgaacaatgaaatgcaattttctacttggctgttgtataagtacatgcttatcaggtcattacatcgttactgcgtcatctggagaaagaaccaaatttctcctagccatcctaatcagttcatgtgtaacatatcattcgaaatctgggaacacattatgatatatgaaggctgaacggttgcccagatttatattgcaggagttgcaatgccagcttcatttttttttctcattggagaagaaaatgatcagatagcattagaacatcaaccaacacatcctcccatctttgacagttccaattgtgcaacccaaaaaacagtaggatagataataggagttcctgtcatttaacataagataaatcagtagattattagtacttgtttggtgattaaatgtcgcagcacacaacacagcagtggtaggcagccaacctctgctccagcagcacaaggccaagtcttgtagcttgcactgagtgacattttttaccaaatcgattgctccattccagccacaaaccataagagaatcatttgaggtaagggaaagggaagaaagtagacctgacattttttaaccaaataccatcagaccggagtcaaagcacaagcggatccaagcaaaatccactgcctagatgcagtgctcttgagaatgacatcaagaacgaacaagttccaggcagattcactccgccgcagtgaccgccagctatctcctccttgatctgcaacaaagcatcaagacctaatagctcagtcccaagcccatcccaccaacacacacgcaccaaaaagagaaaaagaaaatcatcacctctcttggccagcatcctcgcacgaaccggtgctcttcgcgggcgcggccgccgcttgcttcatatcggttgaaccagaggtcaaatcgggacgaggagaaatcatttccgatccgcaggagaggggcgatggaggaggaaggggactggtcgtcgacggcggagaaaagcgagcgatggccggccgccgccgccgtgagggcaagggagagagcaagaggggaacagcagtcgagtggcagctaggttttgggggaggtggagcctggagggatgttcggtttcgcaaaaagacccctcactttacgcttttcagagcgcactcctgttttctgaattttctcttcttagcataagatatttcatatttaagagggccggagcgtaagaatacatggctgaggaatgtacgtctagggatctataacaaattatgggtaaaatagaggttttttttgaaaaatgaccagatcccacagcccggcgctcgctcgcgaaatctggctaccagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggaacgcccgcggcccacgggccgttcggggcacggcggcccgtgaagcacagtgtttttttttttaaaaaaaaggaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacggacaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcattgatgtggtcacctaccctcttcatgccagtcttaacaatcaaattaattatatgacatgcacaacgctgatggagtagaaaagattgagcatacacacaaaataaaggttgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctgttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccactgccacgtgtcgccttcccgttggaccgccgcccgccctgtcacgcgccgccggcgctttcggcctgacgggccgtgccgggccgtgccgtgcgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctctactggctacttgggcattcaggggcgacgtggatagcgcggcgatcgaacacgcgactccaaatcgctgtgggagcttcaatcggggggaggtattaatataaccgattgccctgcatctcgtttcatactcaagtcttttttttttcctaggtagaggtaacgaagacgaggagaagggagatggaggagaagaggtggctggaggtgatgaacaagatgatcaggcattcaggccggtctggaggcacaagtcgccggagatgaacatgtactttcagtttctgaatcttactggtttctgaacttagtgcatgttgacgctgaactctccgcacactgcatgatgctcaacttagtactccagggaattgtcacaacttacagtttctgcatgatgctaaaccctgaacttgctcttgcagtatttgtatttactggtttgtcaatttattctgaactttgtagatttgtttgttggccatgaaacttagtactccctccgttttacaatgtaagtcactgtagcatttcccacattcatattgatgttatatatatatatatctaggttcattaacatcaatatgaatgtggaaaatgctagaatgactttttacattgtgaaacggagaaagtagatatgtttcagttacagattctagtgactttacggtttcaccttcagattctagttgacttcacagatgttgaacttgtagatttggccatggaacctagtagatcagtttcacttcagtaaattgttctgcctgctgaatgctttgtgtgagcctcttgttactcagtaaaaggtgttatttttagagatgcacattggggaatagcagagatcttatctgtaacatctgagaaatttgttcatcgtcaattcatattatttactagtttcatcatgactagccacataagtcgtgcgttgcacgactcttaatacctgtttcaaaagtgtgtatatgtgggctgtcacatgtgtaaaagagggaaaggaaagcccatataacagctactatacatggtgggaattatctcaaaatactgcttgattatgaattgttaggatcaatactgacagcaaattcaacatgttgtttgtcagtgttccacaagataaaaaactattctggagaactaaagaatggtagtcaaaatgtatctattgcttttcagcattatacagtgctatattcaaggtgattatgctttaacatactgcttatccagagtcagagctcagtgcaatcattatctacctctttaaatctaatgaatagaagtttacaccatagtaaaagaacatatcgcaagctgttaagcaacagaagtctgaaacatatttcaaggaacatatgtgcagtctccattgcaataaggaactttctttcttacaataaggatgccaaaataatcgtctccattgcaatgtttatattgatccaagaaaacgatcataagcatagcgttttaccgttttcttggatcatcttcgagttttatctggtttctttcttttactgagtgacaagaggctcacacaaagcatatcagcaggcagaacaatttactgaagtaaatagaagtccacataaaaggttaaataacaattgatgatcatgatctctctcagctcttctcgcttgcttgttcggctattggattttccggagtgttcagttcgaggcctcctgaagaatcatgaattttcttaaccatatttgaaccgctgctcaaagatcagaaggctagttttgtatgttagtttgatccaacggctgtaatattttaagtgatgtggctcattgtggtgatgagaaagattagttctctcactactttagacgagcttgggctgcgacggcgctagttttttttttctttttttctttttggaatttttttcgctattttttctctttcgcatgcggttgcgctggccgcatgcaaagaccgtgattttcgcagatctttttgtccatgcggctggcccaaccgcatgcgaaaatgcttgtcgcccgtatgcaaaaacctattttgtagtcgtgccttaaaaaaaatcagataactccatttttcaagtttaaaataattatttttttattaattatgcgctaatagcttgtcttgttttgtgtgccgctgaaaatcaaaatcaaaacgctggaacgaatgggcccttgtactatgagaagatattcttcatagaagatatttcctatatcttaaaataagatgaagaaaaaaattcaaagcaaatatttaacctcttgctagaagaaacttcatggatattttctggttgtggttggttttggatgccacatggcagtaatcgagttgataagtaatactagtaataagagttataagagagaaaatattaagaacattcctagctcgttctcgtcgatagcgttgataggaaataaatagtctcggtgaaaaaggaagagaagatggaaggcgaaggttcggaggacaataagaacagaaaggaaaagctgaccggtaggttgctttcatggtcacttcgagttttatctggtttctttcttatcttcttcctttatttcagaatctcaaaagcgagaacgcgatgtcaaaaattcagtggagacgtatttagaacgttttcaaaagaggcaccccgagatggatgaagaaacggcaaggagggagctaacaaagcttctacaatcaagcttgaagccactctaagataatgacttagagtgacttagcgagagagttgtgtgataagtcttagaaaagcactcgtggattagaaaacatttgttttaaagaatgtgcaatttgaccatcaaagctcaatctatctctactgatgtttatgcggctttgcataatagaaatagctaccaatctatcaagtgtgaatgtgtgatttcctgcacatcttaatttgcaataactaattagacggagtaaacttgtctggaggacatatacctctctgcaacacttgcagattgctatgaaattcaacagtagtaaatactactcctatacttagccagtaataacatagaagacttcaaactgattagaatttctagtagccatctgcgacctgcattatgagaaaaaaaaacctctaagggttgaaattggagcatgcagctcgttcaaattaaaagatggcaaaccatagagggaaggaaaaggtacgaattactccctccaccccccctccccgcgaactatcacggtcgtccaaattacccccctaaaccacaaaaccagacatcgctcaccctcaactttcaataccggacaaattacacccctcgacccaacccagagctgttttggtctacgtgacatacgcgtggcagtctagtcagcattctatcttaaaaaaattgtgcgacccacatgtcatacacttcttcccatcttcctctctctcttctctctctctattccactctctctctctcggcagtcggcatgacagcggcggacggcgcgcacggcggtgcgggcgacggcggtgggcgcgcacggcggtgcgggcgacggtgcgggcgacggtgggcggacggtgcgaacaggcgggcggtggcgaacgaggcggagaggcaggcggctggcggcggacaggcggacgaggcggacgaggtgagcggtggcggagaggcgggaggcggtggataggcggaaaaggtaggcgaggcgagcggcggtagagaggcggacgaggcgggcgaggcgagcgg

SEQ ID NO: 46695 - DNA, 2065 bp, Oryza sativa
cgtttatttcatgatgtttttgagttatatgtgcaatatatatatatatatatatatatatatatatatatatatatatatatatatatatatatatatatatatatatatatatatatatatatactacttcagacaatatacactgttcaaaaacactatttattcggctgaatactattcagtttactgtttattcggctgattactattcaaaaacactattcagtttactgtttaaattactgttcaatactgttcactttcagagatattttaactttaggatctttgcagggtggcgaatcctatttagacagcctcagaagcttgcttcagatgatgtaaagtcctactcggtactcaccgtatgcctcacctatctgtctttttagaagcaacttaaaaagatattccaagtcacacttgttctagctaagagtttatcgtctccccaggcagttccacccgaagggaacacttctctacggataccgattctccagacgcctatgcaagatgcaggctaaaaacgagaacaaaccgaagaggtttctcctatagggtccttagcataaacacttgtctagaacaaacgtgcaggaatacttaaggaaaattacttcatattaaacagataagcttacatacggttttccctttcgggaaacccgaaggtaggtacaagcaagctgttcttaccttacacagcgttataacacaactccttgcttcaatatactatgcaaggtaggctaaagtcactactactaagaacggtggaatggagggtgagagcgcgcttggaagctttgctctgaatggtgtcttcgttgttgtcttcctcagctgggcaggcccctccttttatagaggtcaggggtggcgtcgcctgtgcctcctgcttatctcttcgctactgtggattcacgagagcaggctaaagttgaggcctttcctgccgaaagttttattcttcacagggatatgtcattcaccgcaccctatattgttcctttatgcttatagggtgtccttctggattccttcttctggattccttcttgagtagtcttctgaaatcttcgtttattcttcttccacgcccaaattattgatattctattatcaatatatattgagaaacatatttagcttaaagaattctattcatctggctgcccatgaccaccaagatctatagtgtccagatcagaaaaagaaacttctaatttctcatctactgccttttttatttgttcaaatttctgatccatctcttgttttaattctttaagtatttcctcctttaattccttctttaattgtggggaggcttcttcaaatttttctattattttccaatcaatatattccccatctaatggatccactccttttgttaggcattccttgtatgtgggttttttagaatacccttcttcttttatagtcgttttaatgggtatttctggagtcttctttcctttagcttttttgcatttttgaatatattcttttgcagcaggctctagataataatttattcctagtatttttctagcctggcttaatgcttcatcaatgtctttatatttcttccaagatattcctcccattaatttagcatctatcttttgggccacaatttcttcaaaagatatatagacccctgggagctttccatcaaatacgacatatataggcttctgttggattatttcatgatcttcattagctggcattaataacccgtttattaagtgaaaatattcagagaggctattcaatattgataacatatatcctttttcttcccttttattattgtattggtaccaaaaattatccaagatgcattctttcacttcatctaagattatatggtcttttggcttaaatttatatgaatttggtgggaatattctgagcttgttgtcatctccaaatgtgaagcattcaattccgctgtaattcattgatcttttcatacctgcattcaggtaaacgagaaagcatgtcaggcaaattattatctttccccttaatatgttcaaatataact

SEQ ID NO: 46696 - DNA, 1667 bp, Oryza sativa
catcctcagacatgataaagttgaatttgtctgagaccaactactcacgtttgtctcgcgaggacaaaactatgttgaagaacctttggcaggacgatttgtccgatgtatggaaacgcagaatcgaagaaatgataagttttgacaagaaggcctcttttgaagctattcatagtttggggtttgattattttgcaaccaatttgcttccggatatgattaacaaagtacgagaaggctatgttcaggtatatttctcactcctatagcaacttgtattttttttatattactttgaaattcgtgatccatgagcacactttttcttatatatcagtgtatacattctttgctaggttcaagagaaaaaagagcctcaagacactgaagccagtgaggactgatttggaggactctaatgcagctagagattcagatccataagtttctacaagtaaaagttggagcagcagattggaactgcatgttgatttttgtggatgctcaagcttcactcgtatgtttggcttctgataagtctgtaatagcttagcagcacaattattatagttgtcttctaggtgatcgatctcctaaatacttgcaccactattattgtagttgtcttttatgtgatcgatctcctaagtacctttctgtctgtaatagtttagcaacaccattattatagtactagttatcgtctaggtgatcgatctctcctaagtgcttgcactattgttactgaagttgtcttctagcactattggtactgcagttgttttttcgctgatcgaacttctaagtgcggtattattgttaagagtaaattgcaacttgtgccaccttttcttaccactagtaatcatgcacgtgcaatgcacgttttccatgtcacatctaacatcaaccttacattttatggtctccatacgtatacaggatattcattttcatttagtggtgaattaaagttatccagcttcattttatttccattctagctcgaaatgaaaaagaaaaatacaacatattattgcattcaactaataatacaactaacaataaataaatcactaaaacaaagaagaaattaaacctcattttatttccatacaaaatgaagattaaaaagaaattcactcattacaaccaaaacacaagtgcacatggaattctaatgcggcgatgaaattaaaaaaaaaacaaataccctccaaggcatattacttttttcagcgaaaccaaggacaaatcaattcattctgtgtagagacaaaaaaaaattgtatggatacatgcaaccaataagtaataatatggttgcccaggttctaggacatttaagtcttagatgtatgaagaatgcaaatatgcccatcctagttgaaaaaaaaaatcagaaaatgaaatatggatggagggagtacgaccttacaaccgagtgaaatttgaatgagactaatgagtttcggaactaatgagaatataaaattataaatcagtgattatttcttatgactccaaacaaaagttcatcaagatcactttaaattgatcaaatgctttgaattcttcagtttgaactgaatgcttcctgaacttgaacgccaattcatataaatgggacccatgtgaaacatcaatttgcaaaatccataattaag

SEQ ID NO: 46697 - DNA, 1633 bp, Oryza sativa
catggattcaaaggttaaagctatgatcaaacttctcaatgaagatgctgattcttttgcacgaagagcagagatgtactacaagaaacgcccagagctaatgaaactggtggaggagttctaccgagcttaccgtgcattggcagaaaggtatgatcaggccaccggtgcacttcgacaggcccataaatcaatttctgaagcatttcccaatcagatgccaccaatgtctgatgagtcacccgcttcttcgggccaagaagtggaaccacatactccagacctgtttactttcacccgtctcccttttgatttggatgacctgcagaaggatggagtaggtgtgtcaccacaacaattcacctccaagaggaatggtacacaccctgaggaagccagtgcactgccaaatcgaaaaggttttgatgtgaaagtgcgtaaaggcctaagctttggaagcccagaagttaaaggcagtgatgccatcagcaatgagatggtaaatttgcaacaagagatttcaagattattagctgagagcaacagcatgaaacaacagatattatcagaatctgagagggcaaacaaagctgaaaatgaaatccaggttctaaaggataccatcttgaaattgaattctgacaaagacacgttctgctgcaatataatcagtccactgagcggttatctactctggagtctgagctctctaaggcccaggatgacctcaagaagctaactgatgaaatggctacagaagttcagaagctgagtagcgctgaagcacgcaatagtgaaatacagtctgagcttgaggctttggatcaaaaggtgaagagcagcaagaagaacttgaacaaaagcagaaagaactgaaaagcttcaacttaaccttccaggaagaacaagataagcgcatgcaggctgaaagtgctctgctttcagaggggaaagaacttgctcaatgtcaagaagaagtacaaaggttgactaaggaaatccagatggcaaatgaaaagttgaatgagctcaagcagaccaaagtaaatcttgagaatgctgtttctgagttgaagaaagaagtcgagaatcttactgaacaaaaccgctcctccgagctgcttatacaagaacttcgcgatgaaattaattctctgaaggattcaaagaacgaacttcaaaatgaaatccaaagccttcggagcaccatttcacagttaaacaccgagaaggatgcaaccctatttcaacaccagcagtctgttgaaagagtatctgatctggaatctcaactcttgaagctacagcctgagctggaagaaattgaacagaaggttcagatgctgatgcaagatcttgaacagaagagacaggaagcagatagtgcccatgcccagctgcaagatgaatgcaataggcacacacaaactgaagcagatcttcacaggtttaagaatctgcattctcagttggaagaggaagtgataaagctgacagaaaatcttgacagatcaacaaaggaactggaagagttggaaaatgcaaagttagacctggaaaacacatcaagagagttaaaaagcacaatcttagatttaaactctgagaaggatgcagtacttctgcaacaaca

SEQ ID NO: 46698 - DNA, 1397 bp, Oryza sativa
aacaactgtggcagtaaaccaaacgcatatctaacaaactgtggtagccaaaagtgtggccaaccaaacacccctttagtacgtactaagttgctatgtttgggacggatgaagtactatttaaaggaatagggatagattatttcagcaaagattaagaatagggataattattttctccagtcatattgttagtcaaattgtaaattttgaattgcttggagtccccacaaatcatttgattacctgaaaatgctatactcagtgctatagaattagtgtcacagaaatgcttatgttacatacagaaatgattataattgtgaacggagagagtatatacatgttcttggaaaacctcctccgtcgttgcttggtgtaagtgtaatttgtattttttttcttaggtttaccttttgtttgtcaagatttgtcacttgatcgagaagtggggtttaagccctcgactgcgaacatattcctagaatacaatgaaaatgataatcattaaaattttataatcgggtaatagtgttacttatctcttcccaaaactagcaaggtcgaattttatcttcggagatacaccaaaacaaaaattccaattgcagattggactgcacttttttttggcctaatttgttatttgagttattttggttaatttcttcatgtcaacttacacggttactcctatatatgtaagatttttaaagaaacatttgtaattatttgggtcgcatgcaaaagaaaatgatggcttaaaacactttccagttttattggcactccatgtatgcgtacattttgtttattaataatttatgatgttcccctgcatagtgaatatatcaggcaaattctggacaactggagtaaaaaaaagaacatattatattgtcttggcaattgtgacttttaaaatttaaatagtgtcgcaaaacgttattcatcaccagataaaaccgatcggtccgtaggatcttgcaaaaaaaaaaaaaaaggtgttgctgctgtttgcagcaggtcagactttaaagacttcttgaggagcagacaccacatgggttttgtttctaacagaaccaataatatgggtggttcatatgtgcaaaacggagatggttcaggatacattcacttataaaatcctaagctaggagtagtaagtagtaaccacttcctccgtttcacaatatattctatttaattcattaacatcaatataaatatgggaaatgctagaatgacttatattgtgaaacggagggagtacttatttattatatactccctcctttcctaaatgtttgacgccgttgatttttttaaatatgtttgaccattcgtcttattcaaaaacttttgtgaaatatgtaaaactatgggctgcagga

SEQ ID NO: 46699 - DNA, 4306 bp, Oryza sativa
ctgaatattcaagtgatagacttagcatctatactgcaagtagaaccttacagtgaaaaaacagtgcgtgtttactctgctgttgacactcgtgactatggtacacttatctagcttgtagagagagcttccagagctagttaatcaaaatttgggtttaggacactagcctagcacacaaatttgtagttgcagcattgccaaatgttttggacaaaacaatctcagttacttggaccaagaggcccatgcattaaaagaatcggactgggcctagcagttgggcatttggatgccatctcggcccttttcagcaaaatctatggcccagtcatgtactacctccgttccatattacttatcttttttagtttttgtttgtcaatgtttgatcattcgtcttattcaaaaaaatttagaattattatttattttgtttgtcatttgctttattatcaaaagtaatttacatatgacttatctttttttatatttgcactaatttttcaaataaaacgaatggtcaaacgttgcaaataaaaagtcaaaaacgtcatctattatgggacgaagggagtacaattgtatgcttaagattggtcttttttcttcggataagttcactctgggtccctctatttgtcacgctgtctgattttcatccctccgacacaaaaccgggtacgacgggtccccgaacttacagacccagttcaaagtaggtcctaaggcagtattgtgagcagtattgctgacgtggcgtccgacgtggagcgttgactcggttcacatgccgactcggacggccaccacgccaccatgagcaaggaagaggagcaagaggagatgggactcacgacggcggcgagggagatggagagcgtctgagcgtgcaggagatgcacggggaggcagaggcggagacggtggaggaggagaggacgccgcggacgagggcagagtaggtgccatggagctccacgggagccgggaggggtgcgccgacaccaaggccctggaagaagcgctgcgtccaatcgcgggactccaccaatgaaggcttccacggcaggaagggcgacggcggagagggagcggaatcaggccgagcaggcggagtggagcggctgcaacgtgggagaggatgaagacagagcaaccgcgccggggtcggatgtctggggcgaagacagtgccccggtggccggaggatcaccctctcctctagtcctcttaaggagcacgaccggcaaggaaggactactggcgcggcggccgcgccggcggttggcgaggaggagggtcggtgcagcgggacacggcggagaggaggggccgtagcacacggcaggcggaagactcctcgcgcccttctcttgccccgcacgcgctccatggactctcctccaagacaccgttcgccggcgacgtgtttgtcggatcgtcggcgggcggagcgaaccgacgacggcgaccccggttggaatcgacgaccgagggaggtggaggcagacgaattattgtaacagaaataacggaagcggttgagacttgagagttgagaccgtttggcggctgcggttggttgacgacgaagtgcagccggccgttgtcatggcgctgccatgtgcggcacgactcgcagccacagtccgaccaccttgggctctgccccttgcgccactccgtctccggcgacccgctcctaccctgaggagccccatctgcgcgtgtcggcaagcgctccgccagtggtaccttgtcgtcctccagtgccgcgcgttgtggctcccgtggcagtagcagctggctgggttgtcctcgaagacggagtagaggaagccatacacgaagcagaggagcacgtcaacaacgtccaggaaggcgaagacgaccatgtcttgtgcgggttgttcacctgcgcacgcgcctctcatcgcgcagtgttcgtcgcctccgccgccagcgtgtgaggggaggcagagggtaggggaagggttacggcgctccctttcgcgtacggatcgccccgccgccgagcttacgcgccgatccctcgccgcgcggtggtcgtcgtcggctgctttggttggcggtggcggccttgctagaagtgggcgcaaacaaagaaggccgttgcgcgtccgcggtggctggctagtcgatggcggccacgagcgttgtcggagaggggagagagatgaagagagggcgatagggagagaggaggaagaagagaagggggtgagaatgacatgtggggcccacgtgggcccaccatttttttaatttgtgaatgaaactcacatgtgggtcccacggggtttattatttttggatggaattgccacgtaagcgccacgtcaacgccacataggcactacgtcaaccaaaaccgctgtcaatactgccgagtgaccttgtttgcatggttttgtaagttgggggatgcgttgtacctggttttgtgctcaagggacgaatttcgaactcggtgacaaattgagggacctcaagtgaacttaatcctttttcttcttccccttccaagtaggcaaaaactagaaaggagtaaattcctgatgttaccatgtaaaattcagcttcagcattgctgttttttcatatacaagtacattgctcttactagttttatttctttactaggaaccaaaactgtagcccaacacaggccaggagttactccatggcacaaaagtaggaaggaagctatgtgatttagagtagttgacatgcaggacaaatgcatgtggtgttcatgtggagcatcaatcagtgtaagctagaacctcctgggctagcttcttgtaagaacactctcagtggtggtagggaatggaataataattgaggtggttgcccttgcccatggtctcaagacaaattcataatgagaagggaataaaccaggcattgttaatcattcagtaggggctttcagggggaaaccagccttggattggggtcacctttctcactcttctgtttcttggtttctttgggtcacctctttgctttgctcctttgttcttcagttgcaggtgtagtggctttcacttcaacctgatctccaacttattgctagtacatgtgtacagctactgtagaatcataaagtttcagaattagatgaaaaaaaatgcacaagagtggatggatctctgaaattgtcagtagcaacaaatgcaattacagttttgtagagtcagttctcttgctatagatgaaggtttagcaataggcgttataggtggtattctaagtagttttcttgagctgtgatttcgtagtttgcagatattcgtccagtaacctctgtaataattggttgtaactttttaaagcaaatgttggaatgaattccatattaaaaaaaaggcaaattatcttgctgtaacttgtaaggtctacattctaatatggatacagttgctcatcatactagaaactgacaacctaaacctacgaaaaaaaaactaaaaaacatgatcggttgatcatcttttgtcgctttctactacttcgtcgcggtgcaaccataaattcataccaaaataccctaatatgattaaggtattaagcaggaatcattggacagccaatccattgttctaatctatccagccagtacagttaatctgatcaaactagctgtacagtttgacaatacaaaaatggcccatccgacgtggaacaatcgagtagtgcagctgctagcagctatagcaagcggcaacaactttttggggccaataaataagtataggaatccatttgtcacatacacaatttaaaaatgcaattgcaattgcaattgcttttggttaattagtgttcatgcagttaggtcacacggccggagcaactgcccccaaaatttatgtattgcagcacttggcacggatggtagggtccaaacattaatattaatttttgggatctatgttaatgaagcactgacaagctggtcctctatgacctgttaataacaagatcattaggatgctggagatgttgctacagttggagcacataatcaagggtttatgcctaactgaaagcgtcgaaaatcacgccgcgggcttggcttagttcttttcaaattatttactgaattgttaaaatagattattcaatccacgcttcgaaaaattcattttgctcgaaattttttattctgttgtattgcttagactatctgttttaaattatttattaagtttatttatcaaaatatttactctgttcatacaaccaagtagatattcgcagcaacaatcagctc

SEQ ID NO: 46700 - DNA, 881 bp, Oryza sativa
tcataattattcatgggtcaacacagccatgatcagacaatccaagggggtttagtagctgtgcgatgtaatttgtaatgaacaatgaccaagatctagcaagtgttgtcttcagaaaaggattcaggcagccgaaagggggtgaaaagtgcactgaaagaacatctttttctatgaaatctggaagaacttttgtctgtccgtggtccaaggtgatgaaccagaaattcttctaataagattcttgctgacgctttatgcggcaaatggagagagcaataactgtaaaagatgcaggtcttgcactttgatgacgatgtcttagtgctaattcgagttggatttccaacagagctcaaaatttcgaatttgaaccggctgccctgccataaaacattcacttcaattccgggctgacatcaggtacacaaatttggtgaacataactctaacattgcagtaactcctgtttcgcatcacgcacagtaaattaatatcaatcctgcagccatttgcagccaataagatgtagatctgtttggggagcgagccccatcgtttgacatattagagaaaaaagcgaaacaacaatgtatatttgtaaataaaaaataatttataaataaaatttttacatacctgttcttaacgatctaagagcaaagactgaaaaataaactacgataaaaaaaaacttcaaaatcatttccaaatttaaggttgaaaattcaaatcttaacggataagtataagcataaaaaaaaatgaggctgttgattctgagaaacggatggtgggaataccagtgggtgagaagaaaccctcagcttatagcttctaatttattttttttagattttacaactagattttcttaaaat

SEQ ID NO: 46701 - DNA, 3279 bp, Oryza sativa
catctgagcttcagatttgaatggccagtactatcttgctcatcatatgagcaatgcttctcttgatgttagtcttgtagttgttttcctttttcttttgtggagtcagtggaaaatctcttctactaattagttaatggatggtacctgtaaaaagtccatatatttgatcatcaggttccttgttcaccacatgcaaatgatgtacatggaccaggtatgtaccttgtctggataggaaaaaggatcttggcatctatctgaacattcagagaacttctgaagatgactgaatatgaacatcatatggtatttttctgaactcatgtgagctgtctacacaaaaaaactttcataactacgatgtgcaaatgcagctcaccagttcatcggaaggagaaccttagttcggttcaggtcttcaggtctatcaacactgtccgttgttgacagagaattgacaaagctaactataggtgtttcagagcaggactggaaataaatttcctgatgcttctaagactcagagaactcatgatgaagctaaaccttttgagcccatttcaatagaagttgaggtcggtgtatccatatgggttgatatcggtgtaaccatatgagtagggcagcaattcttcgatgtccaattgcgagcttgaacaactcattttctgaattcggctgtgattgatcgattctacttctgcactaaacatgctgtagacaggcctatgatctgagaagcgggactctcctcgaacatatgagagttggctaagaccccttccataccataaaatgcggtcgcacctgtaaaacaagatcactgaaattgctgaactgtacgaaatatggcaaaaatctggcaatgtgctttacttaccatgctggagttctcctcttttctttctggttcatgtcatcccctgcatatctgtcggaattatttgagtatttgtaagtaggaggaaaatatatcctcccctcattccaaccaggaaatacgcggccgcctctttgctcgctcctcagctgaaagtataagcaattcatgccttctcatcacaattattcttggccttctgttttgccaaactaatgaagtcttgtaacgtcaccaaagcaaaagaatgacaggatataaagcaatgattgcctctgtcacaagcaaactactattggaagaattttaccactattggagatctgcattgtgtctttcaaagtgtgttgctaagctcatacctgatctttctcaagcaatgctttccaattgcgcatctccacaagagccttcaccgatcggtaggaaagcgctatccgataatttaggtccccaagccaaatgatccgactaagaaaatggcgaaggtgaaggatatattacacaatatttgtgattgcaagtttttaatttacaagagttgagggatgctaaggtgttttgcttactcatgctccaaaatagtctctggtgatctctcatactgtccataaaccattgggaacctggtttttctcaaaatttccatcacatcggagtttctgcggtgctcatcaccatccttctgccccgatgtgaggtgactacagacgaagcagaagcttgtttggtgcaacaacatgctaaccgaaatcgaaccctgggaaaaaaaacttctcattggtttacaaagcttctgaaacacaatttcttactcttttttcttcaaattcaataatggcaataagataggaatataacaccaaaaatcacaacagattattttaacataagttaccttatttccaagatagcccatcaatcctctccctacacaagacaccttgagatttcttatgtcactttttatttctctcctagcccaaaccatcaggaacaatccaaccatttgcttgctcgcaaccaagcagtacctaaatcacctcaaattttatttagaaaataaaaatcctaattaaatctcatcaaaactactgtaaattcgggataattccatgaaatcaagcttaattatcctgatgaaaggctgaaatttcaagatccaaagccaagaaatggtggtcacctagaatgggcggcgccgccattgctctcttccatgtacggcggcgcgccgtatccgtacgacatcggcgagaacaccgcgcttggcgactcgccgccgccgtcgtcgatctcgccgtcgtccgacgggtggccccaccggcagttggcctcgtagtcgctcggccggctgccgtacatgacgcggtcgttgacgctgtaccggcgctccagcctcggctgcgcgccgccgccgccgccgaggatgtcgccgtccatccggaggctccggctgagcccggcgttgaacgagcggcggtggaagaacgccgccgggttgttctgcctcgacgacgacccctcgaagtcgtcgtccatctccaccaccgggtccggcgccggcgacggcgtcctcatgcccccgccacctccgcctccgccgccaccgcccgtgcccgcgaggctgttcagcgtccgccgcaccagcgacacccacttcctcgccgggccattgtcctccgcgccgagcacgttgccggcgttcaacggcacgatctcctggaacctacacgtattgagttgcatttatcgaccagttcaatccaagctctgaccatattaaggaggccatcgtttaacttattgacagattaagcgaaatgatatatttattaacgtaaaataatttgtaaataaaatttttatatacgtgttattagcgatctaaaagcgaaggataaaaaataaactacgataaaaaaaacttcaaaatcagcataagctaaaagatgagactgtaagttgtatacactcactagttcaattcaaaaacttaaactgatgagaaaaaaacgagcaattcagtttatattccaacgctacgtttcaacggcaatggcgagaggcggcggcgtgtacgtacccgaggacgtagatgtcggccggcggcgaggtgcggagccagtcgtcgaggctcagcgaccccggcggcgcgcggccgcccacgttccacgtggcaacgaagatcctacataacgcaagaaacaacgaggacgacgacgacattgttacggatcaatggagatcggtgcagcagcaatggcggcgatcgccggagatatgcacacacgcgcacctgtagtccaacgtgacggtggcctccgcagcgtcgaggtcgatcttgctccggcgagaccgctcgtggctccgccgcgacgccctctctgcaacaa

SEQ ID NO: 46702 - DNA, 2342 bp, Oryza sativa
ctcatgcatgcatggccagcttgcccatatatatacacttgtccttccggtgagagagataatctattcctagagagaaacgcctagaggttttccggttagctccacaagttgatgggctaggtgacctagattcgaagtctcaccccttctaattatttgatatcaggtctttccctaatattcgcgcctttttgataatctcttcccaacaaacacacacatgcacagatcgagagggagagatcgtctcaccgctgcgttgagataaattccaacaggttttatatattatataagttattttaggtttgtcctgaggcaaacaactctgagtttgaccaaatctatagaaaatgtagcaacattcctaacataaaataaatatatcgtaaaaatgtattcaatgctagatttaattaaatttatttggtgttataaatattgctatcctttctacaaacatagttaaatttgatgaagtttagacaccaattcaggaataggaagaatgggggaattgaaatggtatacttctccaatcttacgtgaacaaaaaaaaaacacacatgaaagaaaatatatgaggcctttgatagtgccacacaaaaaacaaagaaaagtttacaaagagctcatacatcttggtgtttttcctacgaaagtgaagcatgggaatacaatcatatggaaagtcctatgaatcacaaggatatatcggaaaagtttaataaggaatgtaaatcctatgaaaatctcctttgccaaatctcataaatcaaaggagtttttaacttaagataaaacctagaatagcttataataattaatataaaacaggggggggtatatatatataggcttcagcgtgttcggtttggaggatcagaggagcttgtcttactaggaccatcagcaggtccaaacccgagccagatggtgttgtccaaggcggcaatatatggggcgtatcacgtatggtccagacgtctttttttcgaaaatataatataaatgcacactctcatatacacgtaagtacgtacactcatatggcaaaccaaacacattacatcagtcgcaggggaatggggtcataggtccagtaccaaatcagtccatgtaaatgcaagttctgcagttagtgtccctgaaaaaagaaaaggttcccgtaatttgtgatattgtaagcttgaacccccaaaatgctgcatgtttccacgccaaatttgatgcaaaaatgtcacaaaagagagcgcccctaaatcttcccaaaaaaaattttactcaacataaatgctgaggctatgtcgaatcatcgcgaattttttttatttataatttttttattaaaagttttacaaaaataattttccattttgaaaattgacggaagtagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgagggggcatggaattttgcaggcggcccccttgccgccctgggggagggcgatttttgcctccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatatcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcaatgtcagttgtagtgagtcgtgcaacagaaggttatttttgggaactaatgccgaggg

SEQ ID NO: 46703 - DNA, 3082 bp, Oryza sativa
tgttgtatcagagggtgatcatgtaccctgggagtataaggagaacgaggtaattgagggtgcaaggtatgctcataaggatgagatgaaggaggaggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaaaaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacctgaaaactggtactggttcctagagagagtgcacattgcagtggtgcgtatgaggcccaacgtttgccttatacatgatcatcatgcgggtatgttgcgggctattgactacttgaagaacggttgggatgagaagggacttccagctaagtggcctgatgttcggagtcggtggtgcatgcgtcacatgggtgcaaatttctacaagcaattcaagaataagcatcttatggagctttttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttactcacacgttcttgctgctgccggtgattgtggcatatctcccaatgtgtacgtctcaaattatttcaggaaagaagcaatctttcatacatgaagtgaggagatatatgggttcgggatctcaggatcttacacaacgctgagtgcccaagttttttatattccagatccatctaagttaagggtgaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgactgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacatgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagtgttttgtactaacatttcattcttaattg

SEQ ID NO: 46704 - DNA, 2223 bp, Oryza sativa
ggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgctgtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggttttttaagttttgtttctgtttttctacgaaaacatcaccccgtcgtaacttgatgttccatcctcgcaggacctcgtttgccttcgagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgatgacgacttgcacggtgcacaccaccacgacgtactaggctcctctcagcttggaggagctccagaggcgcacactcaggagcagccagaggtcatacctgtacaggcaggacgggttggccgtgccgtacccccggaccgactcacgtactcccaggggcacattagggcgctaggtatgagggacaggggtaagaggcctcgtcagtagtgttctacctcttcagtccttatgtgaccgtttcttttggcttacaaacttgtaaagcagtactacttttgctattactactgcagtactacttgtgttcgtctcgtctacatagttcttttcattcatatggtactagaacaacttatgctcacgacaacacactttcggcgcttcacggtagtgtcagatccagtagcgcgcacagtccacaacagcacacatgaaaagcggattttcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcccccagggcggcaagggggccgcctgcaaaattccatgccccctcgccgcccatttgcaggcggcccccccacagtacaaaatcgccctagcggagggcggcaagggggccgcctgcaaaattccatgc

SEQ ID NO: 46705 - DNA, 9458 bp, Oryza sativa
atccacacttgtcaaaagatttctctaaacaataatctcctttaagccattatgaagtcaataaaccaatcagatagtcataggacatggaatacagatacagcagatccccaaatctcagaacgactaaacgaaatagatgtactttctacacaagtgtccacccaaaacatgattccaccaatagcatgtgaaagcgtaaaaaatggttaagcccaacaaggatggtcataaattttctgtagggtgagtttaactccatattccataatgcaattaagtaataatcaaggagtgaagtaaacaaactaaagtagttatcatttgggactatcatttatgcaattccttaccacatcaccacatgatgaatgcatagaaatcaatgctctctcaagcacatataagtccactgctttgtcctcaggaatagttgatatgaaactcagaccaaaatcaataagaacctggaatatgaacacattgagtggcacattaatagctcggatgtaagtcttgaattaaatgactcaagaaaatgcatgaactgacagaaaggaagttctacacacgagttgatttgtgttgttcttgattatcatatttgaagtggtcaaatcaccgtgaacaaggcctccatcatgtagtttgccaactgcatttcctatttgtgtggcgatgtcaatgagttgttcttcattgatcccgtttgacccaaatccaaggagtatatctttcacagataagccatccacatactcaaaggttaatgtatgcagaagtgggtccacggcataaagaactggagtgggaacaccaagctttcttgcttttgtcatgcatcgagcttcctacatattgaagagagaatcaagccaacacgaatttcagtcaacataagtagttgtgtgcaaccttttttagctaaatattgcagtttaccatattactacaactcaatcaatatttgaacacttttagcctttgatttatctaatacaaagaaaatcagagaaatgctctacacagaaaacaggaatatctaaaaataaagcatgttagttatggaaactgacagcatttaagcgtttaagagtcaactttgagtccaacaatgggtgtcggtacttctttgaaaaccgctctttgattacacacttccgtcccacaaatgttgaaacaaataccctctgcaacaaacaaaacaaactatgaacaaacaagtaaaagtaagaaactgcaactaaatatattgactcctgactcactccctccgccccctgcttcagtagcacaccaaaatcctgttgttgttcctgagttgagtccataagtataacgtgccctactgcccttcaatcgaaaactgcattggagaaagaaaaacgagcgaaataagatgtcagtcaaacaataaaaatcaaccatattgttgtgctttgtgaacaactttaacattaggagtagctgctcaagaagattataagttcatttccaaatcaataagtggggtggcttttctatttggcaataagaatagctgctttactgatataaaaacaagtttacattgaattaacaaatgcacatagtaatgtgaatggtttgcagtgcctttacagtaacagctctaacgaaactaaaccttaggtgattatgctcatgttcagaaaaaagatcgatgcctgagtgactggtaacacgttaacaagggttatcacaaaagaatttcagaatcaaatagtaacaagcaaatctactcaaacatggtagtacctagaccctctatttcctcgtggctgctctagcagctcccttctttcttgtctcaactgaaccaatcttcttcttttggaccaagcgcttattgctctgcgaactcagtttttgtgctgcacaaactggtctgaatacctctgttttcaggggatccaaaagatcctctgaacatcctaacataaagccattctttttagcatcatcccacaactcctttccattctcaaatctcccattcctacaaagcttttctataagaagatcataggtatgtgtgtccactaactgacacctcttcataagtctgaacatatcaagcccatggtcaactttctcagtcccgcatagaacgcctatgagaccatggaaaaactttgcagtcggaagcaccccactttcaagcatgtcatctacaagccttttccctctaataattctccctgttaaatacaggaccctgaccacaagatagtaactaacccagtcaggggagcaccctgcctttccttctctcatcaagtagaggattctgtatgattctttcactcttcttgctcgtcccaaacaagaaagcaagatgttgaggctagatgcatccggggtgacaccataggacctcatctccgataagacgtccatagcctcagtgacaagcgcagaagggttaaacttgaggttcctatggcacaggcagtgcagataatcattgaatgatggcaaacccagtggggtacacgaagacttgatatcatcaaggactctccgagcttccttcgcattcccatggacgcaccacccgtggagcatgctacgctgaacgatgctaaccatgggttctaccgagagctcgctcttgtggtgccacacgacgccctgcgcctcgcgagcatggcccttcatgcacaatgcctgcaccattgcaaggctgctcgaccacacgccttcccctccatcacccgcgtcgcgccgaggcagcaacctctgcctctccaagcctctaaacaaccgaacagcctcatcctccttccccaatttcacgagtgcctcgacgacaacggtgaacgtctccggggacatcctccggccatccttctccgcgtcggcgacggcgatcctcatcgcggtgaggtcccccatccgggcgagcgccgcgatcgcgctatccaacgcctcgtccccaattccaccggcgtccttggaccggcaccaggacaggaaccgcagcagcctcctccctgaacccatcctctcgctacacgcatcgatcaccctcgccaccatggccggcgacacggccacgcccaggcggtccagcgcgccgcccacctcgtcgaggctccccgccccggagcacacgacttcgcgcgccgccgcctccaggtcgctgcccgagcacagagcgcgacggcccaaggccaccatcgatctcctcgcgagcgtggccatcatggtcgtggctaggtcgggaggagagaagagggagggggggaatgggggaatggatgggttggtcgaggcgggagggagtggggactgaccttgacggctcacgaggatggtgatggttgtggtggttgcggttgctaccgtggctcgctccggtgatggcggcgacggcggctcttcgccggagaggagggggacgacggcggcgctggggcggaggcggaaggggaggaggaaaccctacctaaacctgattaactgcgaaggcaaatttgcacattgaaccttcacaatccttgattttggtgattaatcctcctaaccctttttggcttttgtgcttagaacctactagtaagtgtgaaattcgagcgaaatttatgtagttccaaacataacttccacaagaactgtacatagtttgtgtgtttctcgtttcaaatatgaatgaagtttcatgagaaaattgtagccatatactaccatcatgaaaatcatgatcagtgttagaaagtctgagttacccagtaactccaatttgcctcctttgctctatagatgaacgggaatatgtgtaacaatcatgtactaataaaatactccctccgaccctaaatatttgacgtcattgactttttaaaacatgtttgaccgttcatcttattaaaaaaaatttaagtaattcttaattcttttcctatcatttgattcattcttaaatatatttttatgtatacatataactttacatatttcacaaaagtttttaaataagatgaacggtcaaacatgttttaaaaaatcaacggcgtcaaatatttagggacggagggagtattagtctagtttctttagattttttgccacaaaatttgtcatggtatatgcactaataacagcaaagcgattgttctcctgcgcgcatcttgaagttgaacgctggaggataaatgaggggaatcaatcaggaagtaaagaattaagaagagtagcaactccttctaggccaacatttggcatcatttcctcatcaataaaggtgctggtacaagctaatgaaagaacaacacagcattagttttttttttttcctaaatcattgtcctcaatagctattcaaattccataagaaatctgactacctgaccaataagacctgtgtcacatcgggcaaacagagtgagttagcgactctgtccaaaaactggctatcaactctactcaatctccatcaactaaactccatgcagagccttcgatattcctcttatcgtatctggacttgttctgcagcaaccccctatcagtgaggccccagcctcatgccattttttgacatatgaaacaaaatcctcatttgaaatccctgagcattcctgcatggagtttcaaagagctgtattaatcgtatacacattaacataatgttagcttcagatatttgaatagaagatactatcattttgccatctcattctcatatatgggtataaagaaaaccaaattttatcctaatgacagtagaggttcctctgttttttttctttgaaatagttttttttcctaatatttgcaagtcaacacgaacacaataatgagtagctatattgtcaactttatcatgattcatttaactggtacttaccacccattcctttcttataggatcatagctctcaccactatttgggtatattaatattggtttacttgtcacctgcgcaacggaaagtataaatttattatgtggtcaatgatgtttagggatcaatacaaccgtaataggagttaccttccggatggataaaactaattcatggataaatcttgggggagtgcaattaataccaactgcagcaacttccttgcatgaatcggcaatagaggcacactctatcagggaatcaccacttactacattgactccatcctttgaagtgaaaccaaaccatgccggaatacgtaatttacactcctctagtagttcaacatatgcctgcaaaagatcatattatttcactgattgcaactacattgatcaggccaacaacgcttatttggttagtttgaaacagacgaactcctagttgaaatgtacactaaaagaaagttttcttgccagatttttttttacgtaactgccaaatccttttctataagtagaatcagcaaagaatgtggaagaaatgctgagcttcaacaaatcaaacataatttgtgcaacaaaaatactttttacagtatcccactgaccacggatcatggtttgaaatatatgtccagtattaaacaggtaatggactatgctatgttgactgaaatactccagtacaaaaagatgagtgttaactcagtatcaattgcattgccacttctatgtctatttatgttccttactactttaatctgcattacaatatacagttccactttccaaacatacctgagtctcaattttgtttggaatagtttcaaaaacaataacatcaggaccagcttcagcaaggacttgaagccttctcagatgaaagtttttgaggaactccaaagtgccctcattaccgtagtcaccactgcagaaaaatttagtcagatgtaaaatatctgaaagctctcaacggaatcagaaattcagaactgattcaggcaaaaagtttcctgaaccattaagcaaatactgatacagattgctcattaatttcattattgttaaccaacctatactcagagccatctgctaggtatgctccataagaaccaactgatgccgcaattagtattgggcgcttcctgtattttgttacgtctttggcttcgtccgaaccgttagaacatttttccaggtaaatagcccgtgcttcacatgctagttcaacactcctcctcaggaatgattcactttcctcctgagaaaatccctttgaaaggaagccctgaattgtggcctgtaatagcaatgttgcatgctaattagctgcttatcatcaactttacttgaaggatgtttgagaaaccaatgaatatatacctgatatgatcctgttatcagaacacttgccccagcttcaagatagtccaaatgaacctgttcaaacaaaggcaacgcgattactattcactcatgagttatgacatgcaatgttggaatcaacaaaaagaaaaaaagaacacccactataatatgtttcttatcagtatggcttcaagcttactccctccatcccaaaaaaaaccacactgattgtgtcacatcccgcacgtggttggtttattttggaacagagggagtacaccttgattcaggttaaaaaaaagaaatatttttctttttttttgttttttgctaaaccattgaactgaagttcttgcttcctgatttccttacacctagaaggctagctgagcacatatgacacagcaaccacactgtaaagtacaacaagtctacagagaaatcggatattgctggaaaggcgacagtgctctccttttccgcagcaaaaatcaggcattccacatccctgcagcatctaggcttctcagaacggcgagatagctcaagccacactgagacaaagctccaacacgggccaaaaaccatttcccccaataggccaatataatagattcggcattgcatcccccattgcacatccagcgaaccaaatacacacgagacacgacaagacgcgagacgaagcaagcaggtgtacgaatggatcaaccgagagcgcaaagggggagaggggcagatgaggaggaggcggaggcggaccttccggatgaggtcggggcaggtgaagaggcaccgggcgctccagagggcgtccttgaggtcggcgccgttagcctccagctccgtcgccagcccgccgtcaatcacggccgcgccgccgctcccccgcaggaactccgccatcatgtcggcgtggtactccccttgttgactcattttctccggcgatgtcggcggcgcgaggagcgggggagagagagaggaggagaggaaggcgttgggtcgtgtttgtgtggggtttaagacaggggagaggggggatcgtgtgggcccgcgttgtcagcggctgtggcccgcgttagcatgcgcattgtacatggacagctttgcagttgcaggtgggggcatatgaggttcattgtacgtggacgcggcagggaaggtcttttttttttttttttgcagccatatctatggcgtcatattttttatcaaaaaatagtcggtatatacttacattgtaagtccctaaattacatatataattttagtgtatttacaatgtaagtctcaaaattacatatgtaagtactaaaattacatatgtaaatttgaaaattacatatactaattacatatgtaagtggggtgtaaatgaggtgtaactactgtgtaagtggctaaaaaaaaatcgactgtagcatatggcgccatatttctagcaactccgttttttttaggttttcggacattggttccttgggtttaggctgtgggtaggactgtaggagtggcaaagagaagagggaagatacgtagaacaagttagtctatcgttaattgagtagagtattaattattttaggtttaagaaatggattaatatgttctcttaaataacttttttattgaaatattttgtaaaaaaaattaccgtttaaccgtttgaaaaacgtacacgcattaatcgataattttctttttattgtgtcgttcaaacgaacacatccttacactgtgttctccctaatttttaggagtgattggattttttttagtttatacttcttccgttcttaaatttgcattcaaattgtataccataacgtaggtattcttgcactaaatcctattattttcatcatttctatttctatggttccaaagacaatgagatgcttaaaaatcaatttaaaacttaaaattgacataaaatgataaaaagaatcgttttgacctaattttcgtacgtgctaaataacctaaaaatccttatgttttagaactgagaaagtatgagcttaattaaaatttttgaaacatagtaaaaacacagttaaaaacaaaccatcacattattaaaaggggcaattttattcgtatttttaatgtttactattgattttattcttcttttttaggttttcaattttgcccttattttttttctgaaacgaaccttagttttaaccctaatttgtatggacatattgacagtgttaaatcgttggcaaaaagacatccatacccttacttgctattgcaagtttgacaaaaaatttgatagaatataaacaaaatttgacataattgtgccacaaattgataaaatttggacacattttgacaaagaaaatgatagggcacaattttgacacatattttacacaagcagaactgtagcaagcatcacttagtcaagaaaatccaaatcacaagtcaagcaaatccactcccacagcactcccacagcatgttgctcctcccctgccacttcctcaaaatcaagcaatatccagtcccgaagtcgagtcgacaccaattgccatcgcattcacctcccccccctcccccggccaacttgttgtaggaccgcacctcccttgcactctgctcacggtgtggcaccgcagcctccggctcctcacgttgagccatggcctcctactcccagcactgagccgccattttcgtcgtctccttccctccgcttggcggccgagatgtcgctatcgcttcctctccatattgaaccctcgccgcttagctgagccatcacctcctgctcgtaccaagcccccgccgcgctcgcttcctccccgcgtggagccatcgccgccctcgcttccttcctatgcggtgtcgttgccgtggttgcatgctcctcacgccgagccatcggcactttctccacgcatggagctgccatcgctgtcacattctccccacgcggacctgcagccgctgcttccttcacacgctcaacaatagattggagaaggattgagaaaggattggagaagtagtttgcgacagattggctaaggggctatttggttcctagcgacactttgccattacttgccaatagaaattgccacaccttgcctaaggtgaggtgatcaaattgttagtcacaacttattaagcctaaaggaatcttgccacatttttttgaaccaaatgacacgtgggacccatttgttggaaaggaatc

SEQ ID NO: 46706 - DNA, 8239 bp, Oryza sativa
tgttttcctacttctttaacccaacaagcacattctactaacttgtgccaaaacaggggcaaatgtctggttaacttagaaaatacagggacaaaaataaaagcaaaaaaaattatgggtttacaaattgcgatgtacgtagagaaagccatgtatgtgggaaacgcaaattatgggtggatatagaaaataaaatcttgtgtattattttatactccatattgctacttgattatttttcttatattttctttcctctcctgccctttttttttttctgttctaaattagtatcattttggcctcttggcctgtttggcccgcttcctgatgcaaggaccagccgagctagttggccacttgtggcacttggcctggctcagcccaattggcttgcctagagctgattgagtatagctcagtcatctggctctttttgcggaaaagctaatatgtgcgcgctggtggtgcgtgtttcgggctcgcgccggcacgcgtgcgcctcctccaccttatttttttctttttttacagtttttttttttgcttttttcccccacttttttcgattttttttatctctagcatgttttgagttgaaaattttaatttttgagttaaaattttttaaatatgaacttgaaagtttttaaatcttgacttaaaaattttaaaaacttggacttgaaagttttcgaatcttgattctcaagttgaaagttttcaaatatcaagttgaaagttttcaaatctaagttaaaagtttttaaaatttgactttaaaatttaaaacttaaatcgaaagttttcaaatctaacttaaaaaattttcaatatgttagtaatgaaatctcccaaaaaaatctccagaatcttttctaattaatatcattagtgttaactatattaactaatatagttacttaagactagggggaggagtgctcgctgcacgcgccagctagcaggccttctctgttggctatctcccgaatcttgacaggtccaaatttgttataccaagatatgtatcagccatatttaagtttttttagatggagggtgtataagtcacttcttataaatgaaggtagccaaagagaaaaaaaaaccattgttttcttatccaacggtcgttataaactgcaatgggctttaggcagcccactgcagggatctaaattgcttcacaaatcgattttaagcccactggcggtggaacccatttgggccttgggacagcgcttgaccattcgtcttattcaaaatatttatatcatgcttaaaaacatttggtgataaatccattaacaatagaataaatgataattatataaattttttgaataaaacaaatggtcaaacgttggtaatcaatgacgtcatacgataaaatacggaggaagtaattgcagtgtaactacgtataacttgtatattaataatagaatactttcatagctcagttggtatcctgcgcgtggtgtgaacaagatgtgttgggtttgattcccatcaactgagaggtttgctaatttttttctcagctcagcacgaatcttcaagtacatcaaacggttaaaaaatcccagcacggcttcaaacgttgaaaaatcgaaagtttcaaccaaaaaaaaaagtatcaccagtcttttagcaaaaccgtaaaaatattaggaaatgcgcccacaataatccgtcatccgttggcttaagaagaactgaggacctcacctcgccatgatgcgactacacctctagaaaaaatggccatacacacaactggactgagatcctctgacgttacttccctatgacttggtggctgacatgtgggcccgagagtgatgggcccacatgtcagtcatggtaaacagtaacgtcagaggatctcaatcccacgcaactatacagggatcatacgaacacaccatgtgcgcacgcgagaaggcgatcgaatccaaagctctctctcgtcgcgtgccgaaaggcattttgttctcgatgcccaaattccctgtgcaattatctctacctttttatcatgtaaagctttgtcaagtatttgggcgtctcctagcttaagcttagtcgtctccatcatggtgggacccaatcagatgcacatctttgtctggccatgatcggacccaacctttctggcattaatggagatgatggtacttgcaacgccgtgggtcggtcgagttgggcttggatcttctgctcggaattcttttatcgattgagattccatttttcccagcttgggagaaaagagatgataaattattggaaggatttcttgtgaaaacctctcttgtagtaatatataggtgggatgcgtatcacgattcgtgatgttgtcgctgggcctgtttgtcggtgactgtttgtgtttatgttctataaggaattttgattgtgagtaagcgggtgtttttttttcttttttttttaacatatggggcctgtggataaaggaggcaacttttagatgctaatgattgtgtttaagcctgagctattttttactgtgcactaagactgtactggttgagctgctttttttgtggccaattctttaattctggaaactgatggggtaacaaagtctttctctgaagacttgctgccaaagcaatgggaagttactgatgacgttttctgaccggcaaatgagagatttcaggcctggaaaagccgcaaccccagctatctggggccatgccatgtgaattgtgatgaaccgttatatgccgttggatcgaaatcagacggcggtcggccgctccagatgtgcaggggaggatgatgactaggtactatgatggaccgcttccatgatttcagagacagtttgggggagacatggtgcaatggtagaggcagtggaccattgcaaactgatcattctgattcaggtttggggtgacagaagtaatatcattgtctgatttgtgtgcggctttcttgatcctgataaaattaacttctgttctgatttcagaagttacaatgatgttctgtcagtcattgcatgcttgtggttcttgaacagatcactgtatcaaattctactactccatcagttaggagtaacagctgttggaatctcggccaactggcttcttgtcttgctctgcttccttgatcacatctttttgaggaacttttgatcagatttgattagatggcctggtctctctctgaagaaaacaaatgcccaattcagctttgcagtgccaattgccaagctgctattattgttcttaaaaaaaaagcttttagaaatctatttcttgctgctggcaaatcatcaagaacccccaaaaagacaaatttccacaagcaattcttgcacagagacctcaaacacccacaaagcagtttgatccttggaagaactgtagtagactccaagttgcatttggattctgaagtctggtgatttttaagtctgaaacaaaggcctgttcactttgatgccaaaaaaaaacttatcaaattttggtattgccaaaattttgatagaatttcttatacagttactaaaatttgacagcaaactaaatgtagctattttttttagcaattttatcaaaatttggtaagattaaaaatagcatcaaagtgaataggcccatggctccatcaagcctatagcctagcgtggcaatccatctatccacgctgtcagattagctagaccggcgcctaatcagcctctccaagctagtaagaaattgcagccacttgtttggaaggaaccaaaatgtcagaatctttgctgatggtggctaacgactgacggcagcttatcatctgaccaaccaaaccaaccactcttctgctcatcatcagtttctttttattgatttccctttacaaaattgcgggcagagaaaagtttacttgtcatcaagtataataaaaaaaaaccagttggtacagtacaacatctatcttggatttctaccattgctgaaaaatgactcgaaaagaaaaaaaaatattgctacacgtactaaatttttcttactaaatttgttcgaacaatcgtctcaactgtttgattcaagcagatggaagttataaaaaatctagatacactcatagcatgacatgtcagtgttagtaagaatttagtaaaaaaaagttagtacgtatagacttttccaaaaaaaaaatcatttcatccgaagaactgctactcggaaacatgacactgacactgtgacacagccaagaatagttcatctacatctctcgactacaaatttgcgagcagatgatgttgagttgtgatgaaaatttatttgcacataataaaggccagcttctgtcggagcgaatcggaggcccgtcattgccggaggcttgggccggaaaaatgaatcaaaaaggaaattctcatttcttggattttcaacattgctggaaaaatgaatcaaaaaggaaattctcatttcttcttctgaagaagaactgctaatctgaaacatgatactgtcacagccaagaacagtgttcatctacaaaggagaaaaaaaatattaattttctcttgctgcaatgctggcatcacaaggatgctgtggctgcactcgctgagggtggggcccacatggccgccgcctggcggcgcccaccggccaggctttaaaattccaccgcgggattaaaaatgggtttgatttagtgtgagagataattaaaaccgtcgttatcctggggtatccaagagaagaataaattggttcaaggtcggaaacggcggcacgcagccactggagaaaattttccagcgatttgtttttgcacacccgatcgattttcgcctaccatttcatgtagcaaagttaatcatccgctctattatgtataagagtcttccaataaaacaatgtgatgcacattgacaatgatagcatcatgattagaagatactagtacttctctactattgttgaccctcgtagcaccgttaattttatctatagaatttacttaaaaaaatctatatatactaaaaaaagagtaattatgactgctcggatggcctgtatattggcgttgtttttaccttgcgagtacgagttacagacaaatttcatccaaattctatcagaaacgcaattttgccataatttctacattaggaacagaaaaaggtatgcctttctatacattgcagcatactactgaacggaagcaaaagctccaagcaacgtgaaatttgtcacggacaactctgcagccacaaggagctcacatggggatcattactctgccgcgtgtcttgatctccggattagactaatcaatcggataaaccagcggcctacaatgatccaatcgaagcaaatcccttggtaaacggcttaattaattattaggagtagacaatactaccagctctggtctggaatggactctggcaacttgtcctgatggagaacccaagaaagaacattgttgagtgacacaatcacagtggggaggcttggaggttggatcacatggacatgacaaaaattaatcatattggttactcaaggagtgatactgcattttagtagtgattaaaaaaataaaaaacatggcacaaccaaatgtcattttaaaggctgagatgaaatgtaagcagtagaaaaatgaacgaaacttatttttaagataaaactctatatctgtattattactggtttaaaaactcgcaatgaaaaataaacaattaaaagtcccaaaatcaattctaatattaaaatttaagaaaataaattttaggtgcatataattttaaaaccaataagacaatggaaaccatttgataagctcatggattaaatccacaccttcattgtactctaaaaatttctacatacgtctttattgtactctataaatcttgctggaaccaccattaatgtagtgcttaactgcttactaatgagctacatatatactttgcttacacacaaaatcatagttaacatactaaccgggtaatatgcacatgatgggttacgcattaaaaaatagtatgaaacgaaggatgcggactaagcatgaaaatgcttagtgtgagagcaaagttacggtgcactttatcatgtagtatcatacaaagttcagcatgctttttaagttttctttacttatctaaaagattcctgtacaataggaaaatgccacaaagggttgtccataacatgaaaaattctgttcaattaaatgccaaaaaattcaagacaaaaattcaaacacccccctataaaacccatcatttcgattcgaatcaacaaaaaaaagctaacctttttcagtagtcaaacaaaagagaaatgccaacaacccaatacagagtttgcttaaccaaaaaccatcaattccaaatattaaaaccgttgcaccagcatttagttttagatttcacccaaataaatactccaatcccagtaatgacgcagttattcccaaaaaaaaaaaaatcacagctcatcgcattagtattaggcagcaaatcaaatcactggaatcactcactgctcctgaagaaaagtttccccttttttattcttcttgctcaattttttttttctctcttgttgggacctaccaccaccttcagtggtaaggcagcctttcttcttggtggcatcgaagcaagcactgcacagcgcagagcaagaagccagactccagactgtgagagaaggggaggcaggatgggttgaggaggaggaggaggaggaagaaaggaggcgacttggtggatccaaggaggccactgcttttgctttgctgctgctgggattccacttggtatgcttctcttctctccctttctatatcccctcgatttgcaggattggatctttggtttttcttttctgctccggttactggtttattgatctttgtttgttggtgcttgaaagatccgattttttttgtggttcttggtggtgtttatgtgatttgtttctgctggggaggaattgtttggtgttgacggggtggtggtggtttggtttggttggtgggacaaaagaagagcagtcggtgccaagcctaaggaatgtttgtgtggaatttgatcatgtgatgaatttccttccccccggtttcttgcccttttcttcttgatgatttggttggattgcttggttcgtggttcgtacgatctcgtttcttcctggtgttcttcttccgtaacatcgctgttcgcgatttcctcgaggagcttatggaattttgactctgggctattcttctgttttggaatcctgcccggttttaccggtcatcgttgagagaattctgtgtttgtttgcatcggaggatgggaattctgtgttattagaggataaggtggctactctggtggtgtgtttgcttttttgtgcatgcaacaattattttttcttatttttcctcatcttattgttgcttgatacatttttatgattcagtttcagggagttgcgacctgccagtgtatcttcctgccctttcaattaattggagaattagaacctgtaagtactactctagactactgttgctcatagctgtgtatacaacttgtttagttgatattatctgtaccatttctgtttctgatattgtaggtacaatcattgccaaattgcagtggctgttctctgtgcctttcattctcttaatttcggtttcgctcctgttctgaagagtgggggaaaaaaattaaggcagttcttagctttgggagctgcagaatattgcattgttgcataattcaagtgctgaggaagtgaggtcttaattattgtttggagttttgcttttgtggcaccaatggcggccttggtcggtcatgacgcgaggcagtattcatggtggtgggttagtcatatcagccccaagaactccaaatggctccaagaaaatctcaatggtgggtcttcttctgtgtttagctcatttagtcatgtttatgcatttctttgatccatatcatgaaattgtaattagcactgcactttatatttgctcaccaaaccgtcagtagtatgctattctttaattgtttctatttagcaatacatttccaaggcacatggtgtgcatgcaaaacactttttcttttttttatccccgtcctgattagccttgatgccaggttcaacacagtctgtatctaatttagcatttgagtatgcatatgattttttaaataggattaggtaaataa

SEQ ID NO: 46707 - DNA, 2712 bp, Oryza sativa
tgcagctactggagctagaaatcacacagaagagtgaaagtatggacagcctgacgttgagcctgaaagacgaaactgagaaagggttcaagctgaaacatcactcatgtcaatggagagtatgtatcctcagtctcaagaggaagtgaatagattgcatctagagattgatattcttaatttcaaattgaatgaattggaaaacttgccatctgaacttaatagcaccatcttacttctaaatgccgagcaaagatgctaccgatcttaagaaccagcagtccctggtgagaatatctgatctggagtctgaactctcaaagttgcaggctcaactggagaaaattgaagggaaagtacagatgctggagcaggaactcaaacataagaaagaagaagtggatagtctccaaatcagcatacaagatgaagcccataagcgcagtgaaggtgaagcagctctccttgcaatgacgaatcttaactctgagtctcaggaggaagtgaataggttgaccctggaaactaagaagctgaaagtgaagttaagtgaggtggagaacagtaatacagatcttgagaatatcgtagccaagcacacacaggatatccatgtccttcgtgaaaagaatgtttccactgaacttatgataaaagaacttcatcatgagttggatgccctgaaggaattgaatgtgaaacttgagagtgaaatggggttacatataggcgaaaaggaagcacttcagagagactttgcttgtcaaaaagaagagaagcaaaatctagaggggatacaccattctctcgctgaggaaatgagtactttaaaaagcagatcagcagcaaaccagaagttgattgaggacttgcagatcatgaacttaaaactgaaggaagtgtgtgcgaagaatgaggtagaaaaggcacttctctcagaaaaggttcaagaggtggagaagctttctgaagaattttcactcatggagaactcactttcagatgcaaatgctgaaatggattcactgagggagaagattaaagtgttagaaacttcagaaggctctctgaaggatgtaatttcctctcacgtttctgaaaaggctatccttacatcagatctagaaactcttggtaaaagttatgctgatatttcagagaaaaattctaacttggatatcttaatatctgatatgaaagctgagattgaaaatttgagaacaaagctgacagattctgaagaaacctgccaggctcaccttgcaaataactcagctctttctgatgaaaagaacaatgtgttctctcaggtaactactgaagttccttctgtaatagagataaattcttgctatgtttcttttaaaacttaaatccttgtatgtaattaacattattttgtcacttttgtttttcagctggagagcgttacagtggttatgaaagccctggaaagtaaacatgctgatttggaagacaagagctcctctttatcaagagagatgaatcttgcatatgatcaagtaagagaattgcaggatcagttaagagtaaaggatgaagaatatgaagcatttgttaagtcacatcaaacacaagtcaatgactttgaggagcagatctcttctctgcaaaagaaaagctattacatgaatgagttgcttgaacaggaacaggagaaccacatgagtgcatctattaatgtagtgatcttggagaactgtttggctgatttgaaagacaagaacgttgatcttttcaatgaatgccaaaagtttgcagaggcaaatcatgccgcagagatgttaatttcacagatgaaggatgaagccagatatcatcaagatgagaggaaatttttgctaattcatactgagaaactaagagaagggatttcacagcacatgaagatcctaaatatatgcaaggatctaggtcctgctaatatagcggaggacaaaattattttgcagactgtctcagatgaagcctccaacatcatgaaacttaaagagcaaagtgaagatgcaaacaggctcatgtacactgagctgacagttctcgcaacagttatgttgcaagtaggattggaactcagagatctgaatttgcagaagcgtgcccttgagaaagaattggaaactagggcagcagagttcattacattgcaaaataacaatgtccagatgttggagtggaacgaacagctgaagcaagagttacagcaaggctgtgaaagggaagaggttctgaaagctgaaatacttgttttacaagagaagctatcttgctcaagagagtcctaccagacttcacaaaatgaaattgtgagcttgactgagaaaaatgagaccttgtgtaaagaataccagtctttgattgagaactacaatgctttggaggatgagaatggaacccttctttcagaatgcatgaggctcgagcacttgtctttgttccttaggggccataacaatgaggtagcaactgcattgggatctcttactgatgagatggctttgttgagtgtaggtaaggatgaacttgattgcgaagtccaagagcttagcagaagaggtatgatgcttgaatcggaaaacaataacctaaaggagtattttatctacctgatagagattctcagcgctcagttagccctctcagagtttgatttgaatatcaacaaaagcatttgccaggagttggccagtg

SEQ ID NO: 46708 - DNA, 4506 bp, Oryza sativa
aactagcgttgtctacttctcacctccctatttaacagctatcttctttttttcataggaagatgcagaggtaccttttatgcaagagcgcaaccatgggccagaatctcaccccttgccggaaggaactccagagctacagcggttaattgcaagaatgggagcacttcaagttgctattttaaatgccaaagatcttcatgatcaggagtcaaccaagtctgctgctacgttggcagcagcacacagagatattcaagagcttaaagcaagaggcgggtcgcagatggaggcaagggaaatatactccgacaatgagaagctgaacaacgtcgagggctccaaagggaagcaggtacagatgatgaaggatatcgaacttgatcaaatatccacatgtccaccatatggcactggagctgcgctctacccacttaagaatggcgcgaatgctgggatggatgacgagatgctgcagctgtgggaagctgccgagaggagctgcaaaaaccaaacatccaaatcatcatcagctgagcacgacatagaagcggttgaggaggtgaagagtgagtacccttcctctgagctagcaaggggaagagaccttggaatcaataagcttgaggtgtcgacatcatctgtagagcctcatgagcaatggagcaacaatgtactggagaagctctcttctgatgctcagaggttgcagagcatccaagtgagcatcaaggagctgaagcggaaaatggggagcccatcaaacgggaaatcgcccatgaactccgaatacaacaccgtcagcactcagctactcgataccgagggatgtgtcttggaacagatcaattacaacaacaaattgacaaagcgggttgagaactatcctgcgctatcagatagcatgaacgcggagcaagaagggtaccccagtaggaggaaaatatccggacaggtccagaaaggatcggaaaacgtggggagattggaactggaacttcagaagatacagtatgtcctgctaaagcttgaagaggagcatgagtacaggaggctcaaggtctccgataagcgcactcgggttcttctgagggattatctgtatggaaggaaggagaagcgcggcggtgcgcagaagaaaaagaagagggcacctttctgtggctgtgtgcaatcaagaactgagacttgaaccattttgttctggcgggaaactagctataaaatgaaaagggaagatgagagatgtcagctccaagaggctgtagcactgctttgagcaggccatgttcttgggttcatccccattgtaattgagttagtattttagtgctcaaaacaaagcatatgtatctaaaattttggctttcctgtctaaatgaggccatctaagcttagttcaatatgttatagttttctttccatagcaaatatgatataggtataatatagcaaggcattttatttcaaactatgctgcatttgggtggcttctgcaattcatttttttccatcaaggtctcaggctacaaaaacaggtagttcgtctgagaattgctactctcattggattttgattctctttctgatagagtttcacatttcctgtggctcgctactgtcatgctctgaatgccaatgattctgctgcgtcttctgtgctttcaacgactgaacataacaatgtctatcttgtttgctggggtatcagatgacggcaggacatcaggctgtaaaaaaacatttaatttaaatttaaggacttaacgtttcctgtcaggcagtatgtgttcatgtcaataatcacaggaaagacatcgatagaccaatcttcatgtagaagttatgcaaatggattataattctttcaggttgaacgtttcagacgaatggtcacattcaaattacagtattcatgaattatttcagatgcaactaagcaatttaaacacaaatccactatgaatttagagtcgatgaatttactcacgaatgcagttctccatgaagagtgctccagggggagaaaagaaacacccaaaccttatcatttcatcaacttcgttacttgcaaactcatatcgcctaagcttcatgtcagtatctcctgtaagcaacatcttccggcttcaagattcagaaaggttatctctgtattcctttaggttaaagaattcagaaatgtagtaggtcgcccacgcgtgggcgactcggggggaaacctagcaccgccgctgccactctctcctcctctccctcccctcgcagctaccggagaaccgagcggccagctgggacggcggcggcaaggccaaacgtcgacggcgctatgtgcatggaaggcgggccggcgcgcggagcagaggttgaagacacggcgtggaggcggcagattcagcgccgccgcggctggatccggcctccccatgggtggatctggatctggccggagcaagccgctctcgggcagcgacgacgggaggcgaaggcggcggcgtctggtggctggcggcagctggtgaaggaggctagcgcgtgcgaagctgcgaccggcggcggtggagactggcacgcgcggaggacgcaatggccgccggcggcggaggcagtagaggcgtggctggcgacggcaaaaaccggcgtgtgcaaaggcgcggccggtggcagcggaggccggcgctcgtggaggccacggtggcagccgcagctgaagctggcgcgcgtggccggcaacaggagatgactaaacggcgcgatggagcggctgagggcggtgtaaagcctgtcggcggtggcgacgctcccggtggttggcagtggacggtgaggaggacggaggctgccgcagtgagagaatggaggcgacgacgatgcgaccaggcacccgttggaacacgagcgccctggtcgaggcggcgacgacggtcatgttgtgaggggggtgttgaagcctacggccttttgcggggaagaggggatccattcttttctcaccctctccctctccaacccaatcacgtgggtagcggaagctggtgcgcgtggccggcgacaggagacgactgaacggcgcgatggagcggctgagggcggtgtaaagcccgtcggcggtggcgacgctcccggtggtcggcagtggacggtgaggaggacggaggctgtcgcagtgagagaacggaggcgacgacgatgcgactaggcacccgttggaacacgcgcgccccggtcgaggcggcgacgacggtcatgttgtgaggggggtgttgaagcctacggccttttgtgggggaagaggggatccattcttctctcaccctctccctctccaacccaatcacgtgggtggacttgaagcacgacaagggttgagactcttctttgatggccggccggcggcgaggcgtcgacgtggtggttgcgcatcgaaggggattagatggtggttttgctgaactggcatgcactctttagcgcgggagagtagaacaatgggtgagccggcaatggcaacgcctgcgggcgtcgttttccccttggggcattgttgtgttttctatcgtttcccaatgggttcttcaggtgaaaacaacgtcctggttctcaaggacaggcggcggtggcgcttttggcgtcgttttcctccttggggcattgctgtgttttctatcgtttcccaatgggttcttcaggtgaaaacaacgtcctggttctctaggacaggcggcggtggcgcttttggcgtcgttttcctccttggggcattgctgtgttttctatcgtttcccaatgggtccttcaggtgaaaaccacgtcctggttctctaggacaggcggcagtggcgcttttggcatcgttttcctccttggaagcgtcgtttagaagacatattccttgggggtgttgtgtgcatattttgttttgttttagcagtatgatcaaacgtagacgcgtggtgtggtgaacgcacgaactttattagcttcaaaatgtttttatttcctgatacaatgcacaggctattctattcatcaattttcgttgtttgtattactatcatacgaaatctataaacaacatgtgatgtaattattattagtgccatattaaagttttcatcataaaagaattacacttaataattatttattaccttactgtgtggttttaaatcggtgtataacttttacctggtactcgtgacacatcctaaaactgtgaatttggaagagagcatgtccaaatttctacaactcccaactacctaatcacccataagcaaatatcatttaataggatattctagtattttaatcttacccagtagagaataatcccttatattatagaatgaagggaatatccgggaagttgggaagtatccagtgcaatagtacttctcggtgggagaatgcgatatcctattgctagcctttagatttgaaatggacgcggtagattggagcacttcctattctcttagttgacaaatgcaaaaaaaaggaccc

SEQ ID NO: 46709 - DNA, 4911 bp, Oryza sativa
gagtgaaggggagggccgcctatctccatctggcgagcagagcaagagcaagggaggggatcctggtgtggtgagcatccacatcctcttcatgattcatctctctctctcccaccgggactacttttgcctggaatttgctttgctttcgttaagctcctctcttaatttccgatacttaaccttaatacaagtagtaacagtttgtttgttcgtctcaagttggattctcgctgatgtttcttgaaattctctcagtttcttggtgcttcttgggaatttttcaggtgttgttgttgtcgttgttgctcgccggatgttggaggtctgctgctgctccggcgtcctcggcgggtcgccgccgtcgtcgaggactgcgggggtttcctcacctggactatcgccgtctcggcccagtaagcggcgaatcggccgcgcccgggtgcagccgcgcgcgccgccgccgtgcgacgagcggagggcggcggaggacgtcatccacgcgctcaggtcggcggatggccccgccgaggcgcttgagcggttcaggtcggcggcgcggaagcccagggtggcccacacgaccgcgtcgtgcaactacatgctcgagctcatgcgcggccatggccgggtcggggacatggccgaggtgttcgacgtaatgcagaggcagatcgtcaaggcgaacgtgggcacgttcgcggcgatcttcggagggcttggtgtggaggggggactccggagcgcgccggtggcgctgccggtcatgaaggaggccgggattgtcttgaacgcgtacacgtataatggcctggtttatttcttgtgaagtccgggtttgatagggaggcgttggaggtttatagggtgatgatggtggatggtgttgtgcctagtgtgagaacctactctgtgctgatggtggcgttcgggaagaggagggatgtcgagacggttctttggttgttgcgtgaaatggaggctcatggcgtgaagccgaatgtgtatagctacaccatctgtattcgagttcttggacaagccaaaagattcgatgaagcttatcggatacttgcgaaaatggagaatgaagggtgtaagccggatgtcattacccataccgtgcttatacaggttctttgcgatgctggccgtatcagtgatgccaaggatgttttttggaagatgaagaagagtgatcaaaaacctgatcgagtgacctacattactctgttagataagtttggtgacaatggtgactcgcaatcagtgatggaaatctggaatgcaatgaaagctgatgggtacaatgacaatgttgttgcttatacagcagttattgatgcattgtgccaagttgggagggtctttgaagctttggaaatgtttgatgagatgaaacaaaagggtatagtgcctgagcagtattcatacaactcgctgatatcggggtttcttaaagctgatagatttggtgatgccttagagctgtttaaacatatggatattcatggacctaaaccaaatggttacacacatgttcttttcataaattactatggaaaatctggtgaatctataaaggcaatacagagaaatgaactaatgaagagcaaagggattgtgccagatgttgttgctggtaatgctgttttgtttggtcttgccaaatctggtagacttggtatggtaaaaagggtatttcatgaattaaaagctatggtggtttcttcggatactatcacctacactatgatgatcaagtgttgtagtaaggcattaaaatttgatgaagctgtgaagattttctatgatatgattgaaaataattgtgttcctgatgttcttgccgtgaattctttgattgatacactctacaaggcaggcaggggtgatgaagcctggcggatcttttatcaactaaaagaaatgaatctagagccaacagatgggacttacaatacacttttggcaggattgggaagggaaggtaaagtcaaggaggtaatgcatctgcttgaagaaatgtaccacagtaattatcctcctaatttgataacatacaatacgattcttgactgtctctgcaagaacggggcagttaatgatgcacttgatatgctatacagtatgactacgaaaggatgcatacctgatctttcgtcttacaacactgttatatatggccttgttaaagaagaaagatataatgaggcattcagtattttttgtcagatgaagaaggttcttattccagattatgcaacactgtgtactatcctcccaagttttgtgaaaattggactgatgaaggaagctctgcatattatcaaggactacttcctccaacctggctccaaaacagataggtcttcatgccattcactaatggaagggatactgaagaaggctggcatcgaaaagtcaattgagtttgctgaaatcatagcatcaagtggtattaccttggatgatttctttttgtgcccattaattaagcatctctgtaagcagaagaaagctcttgaagcacatgaacttgtcaaagagttcaagagctttggagtttcactaaagaactggattatataattctttgatttgtgggcttgttgatgaaaacctaatagatattgctgaaggcttgtttgctgaaatgaaggaactcggttgtggtccagatgagtttacttacaacttacttcttgatgccatgggaaagtcaatgcggatagaggaaatgctaaaagttcaagaagagatgcatcgcaagggatatgaatcaacttatgttacttataacacaatcatttcaggtcttgtaaagtcaagaaggttggagcaggctattgatttgtactacaacctgatgagccaaggtttctcacccacaccatgcacatatggccctcttcttgatggtctgttaaaagctggaaggatagaagatgcagaaaatcttttcaatgagatgctggagtatggatgcaaggccaattgcactatctacaatatactactgaatggacatcgaatagctggtaatacagagaaggtctgtcatttgtttcaggatatggttgaccagggaataaacccagatataaaatcctacacgattattattgacacactctgcaaggcaggacagttaaatgatggtctaacatattttaggcaattattagaaatgggtcttgaacctgatctaattacttacaatttgctcattgatggtcttggaaaatcaaaaagattagaggaagcagtgtctctattcaatgagatgcagaagaagggaattgtcccgaacttgtacacttataattcactaattctccacttaggaaaagcagggaaggctgctgaagctgggaaaatgtatgaagagctactgacgaaaggctggaagcctaacgttttcacatataacgctcttattagggggtacagtgtttccggcagtactgatagtgcctatgctgcctatggtcggatgattgttggcgggtgcctacccaattcaagcacgtacatgcagctcccaaatcagctgtgactaactagttagtgactgaatgtacttcttctgtatagttttgtctataaaaggaaaaggatcaactgtagatagtccacttcaatatatctgagggttctgctggttcttgttctacactatatttttgtacttgatggaagaaaattattcaatacacagctgacttgatcacttgaatcatctgttcaatttaactgacattgtgaggttacagttgttaaactcttatcaagtccatccattatatgtggttcaagtacaactgatctgtgtgcacattacccattttctttctactggtatgtctcttcagccaaatgcttgtgacatagttcagttttactgcctgtataggtttactgatgtgtgcgcatctttaggaagttgagctagtggttcagtttcacagtgttacgctgcttagcaacaatcaactttttccctgattcacctttttctcatatgatatagcactgccaatggactgcttgagaaggttctctattgttgcaatacatggaaatgcagttagatgcttcctttccaaaagtttctttgttcacatgatagtgaattggtagcattttgcatactttgggtcaaaagatgtgctcatttcttgtagaccataattacaacactggaatggccaatttccttcatgaaaattttcaatgagcagccaatgcaaattcaaatttactatttcctttagtttggttgtgtctaatctgtaagtttatggtgatttttactagaaaaggtatcgctaagtttctgaaattattttcatttctcttcagtctagaactctagattaatttgttgatcttgcttatatgccaatttgtttgactatattttcctgttgtatctatgatatgctctctctttgttttggggtttatcatggtatatttctatattttatggtgttgagctgttgatcatgagaaagtaaacttgcatgttaaactgaagtaattgacagtttgacattcgtaataccttgatataccctgatcaaatgtatttttgttccaaactcaagctactactagggaacattcatcttgatctatttattcaaagctttcttgtggtgctcagttttgttttctggttttagattgtaattttgtctggtaacaagctcttcttttgatatttttccccttgaaattcaaagaaaggtgtattttgcttgcctacctaaagagaagtttgcagttctagttgaacagttgtgcatctgtgaagttcgttatggatgtcccctttaggatgcgtttggagtgaggtattgaactgaagaagctattaattttagtgacctaacttcttgagtg

SEQ ID NO: 46710 - DNA, 3800 bp, Oryza sativa
gctgtgatgcggttatgcccttttttcctgaggtatttttagaagaaaatttctacatgtttcatattgcattatcagggactcttcaaactgttcgtccccggaagctgtcggcacagtgaggaagcagatcaccagccatcgtagctatcacaatgccaaagagccaacaacaaaggtcagggtcttgatctcttgtatgcccagtaacaggttaatcctcctggctctctgtactgaaacaatttctctggatctctttcccttttgttttggaccttatacaacctgctgatggttaataatgatgttcttgaataatagatcatgttaagctgtttgcatggtctgctgctgtcaaatagttttatgcggtcacaactcttactaactgatcaggttgacttcaagcattgggctaaaaactaagattatgtaacttaaataacatatatgccatcatcttcaatttaagtgatattgtgtcaatcttctgatcaactgtttacatcttcgggttatgtagattcatgtcatcttcttttactctgaaatgctatatgagattggcagaatgtcctgatttcccaggcatggcgatggctgtccaagggctgcttaaggagagctgctgctggaaatgcccagcaaattgctgatggatggaggatgcataatcactcagtgtggtgaccatctgatttagcatggcgtatttcgcaaaaggtttgaaattcaaaacagtgtctcatcggatacgccatagtgattttcagtttctcttattggcgtacctctgcttgtggaaccctcctggatctgaatattgcattcccactgttccatctggcttctccttcaggccggcaaagcattgcaaaacagacctaacaaagattacttccccctatttgtcgtaagaaactttggatgttatgtagaacagaccttggtatatgcagttcttgaccataagttcactatctgtcttctgcttgtaataattgatccacctagaattacaaagtggtcttattatttcatctctgaaatcctcactacgaaagaaactggagaagactattgcaactgtcatcacagcgacctcagttttgcttcgacagcttcttgtcgcagtcctaacacttgtatatatgtacataccctaatcttaatcttgctccgttttaaatcttgtgctatcagtaatcaagtccagtttgagctatgaactgatctgtaattagatattacaatcaatacacgaggagaagaactgggcaaacaacgtgatgctggtataacttcatcaaatgttatattagaactcatatcacgtcacataagtgtacacagaaaactcaagtcacattctgatttttttttttctcggatcatgctagcagatgagatgaggaataaataagattggaaatatgttatgtaccagcgagaattcttcacattctgttttagtttgctccctcccaactgttagtttttcacttacagattcaagaaaattcaagctgaacgcttagattttagtatgatacatttcttttataaagggtaggaccccctgtcgttattgaaaccaaatgttggggatgcagaaatttcagggctagggatgccagctaaaattaaaggatacaaaagacctgcacatcagagttttgcagaccaaagaatctaacaacaacaggacctcacaggagaaacaataaggacaacacacacacacgaagacccagtctcctgaaaacactacatggtcaaatgtatatcaaatattgtgcaatctcaaacaggattaacttcttgtattaacttgtataaatggggagtgattctccctcccacaaaactctaaataaatttgttttcctgctctatcaatacacaaggcatagttcttgctttcttagaaaacattctcagtcaggatcgctttggagaatttgcatgaaaatgtttggcgtatcagtcgctatcgctactaaattcctcaagttttgctctatcctccatctgcaatagcacactcttaagactgaaaaaaggcatttcaataccgcactcgaagactgaaaaaagaagataaccttaaaaaaaagagagatcaactcagtttgcttaggattttttttgttcaattaattaccgttttattgcgagtttggcgagtaagtccactgtaaaattttacagaagaacttcacatcagtgaataactggggccacggcccacacccacccttcaacagttaagaaaggaagtcctctttctatgtatgtttcaattttgaagatgtatcacaaccaagcatgtctaaaagagatccagcgtcatattcaaagaacacagagtggtttaatattgtagcagcatgaagatgaggtacagcaaacgccaatctcatatcgcggtttccattgaattggaacttgaaagttgaaaatatgacaaaaacatcattgtgggaagaaaaaagagaataaacagtaatcatctcgaaggaaaacataaattggttgacagttccaaacagaaattggtgatgcggatctacttagctgctggtagaacccttggcatcccgcgtcgccgctccatccatcaccgccgcccgccggcgtcatccccggtctcggcgccgcgcttcttcggcccatccatccgccgtcgctcctcatccccaatcttccctcttcatccttccatctgcttttcaaccattgacatatcgtcgaacccatagtctgaatcagccgtaataaacaattgacgcatacagttgacgaacaagtcaatcaagtgttttgtagcgcaaatttgccagaaattccactcaactcgatattaccaaaactgcttgtccatcggttgaacgcgttcgctccctgcgcgcgcttaaccaccactccatccgtcccgccccacacaacctggggccgcatagttttgaattaaaaagaacagctacatcgtttttggccggtgccagtaggagaggcagtgttcaatacgtcagaggatatcgttgcgttgagagtgacacgcgagacgacgggactcaccttgtactctcgcggtggtctctctcgacagcaccatggtctgcggcaacgtcagcaccgtcgtccccatgttgcagcacaccagcatggccagggagcagaagttggtgctcgacgccgacgccgacgacgacgggttgcaccacaccggcgcaggcgggaagcagcagaagttggtgctcgacgccgccgccgacgggttgcacctcaccggcgtgggcgggaagcagcacaacttggtgctcgacgccggcgcgggcgggaagcagcagaaattggtgctcgacgccgccgacgacgggttgcacctcgccggcgtgggcgggaagcagcacaacttggtgctcgacgctggcacgggcaggaagcagcagaagttggtgctcgacgccgacgacgacgggttgcacctcgccggcgtgggcggaaagcagcacaacttggtgctcgacgccgccgacgacgggttgcacctccccggcgtgggcgggaagcagcacaacttggtggtcgacgccggcgcgggcgggaagcagcagaaattggtgctcgacgatgccgacgacgggttgcacctcgccggcgtgggcgggaagcagcacaacttggtggtcgacgccggcgcgagcgggaagcagcagaagttggtgctcgacgccgccgacgacgggttgcacctcgccggcgtgggcgagaagcagcacaacttggtgctg

SEQ ID NO: 46711 - DNA, 1882 bp, Oryza sativa
  unsure (1)..(1882): unsure at all n locations
ggcgggaagcagcagaagttggtgctcgacgccgccgacgacgggttgcacctcgccggcgtgggcgggaagcagcacaacttggtggtcgacgccggcgcgggcgggaagcagcagaagttggtgctcgacgccgccgacgacgggttgcacctcgccggcgtgggcgggaagaagcacaacttggtgcttgacgccgcccccgacggattgcacctcgccggcgtgggcgggaagcagcacaacttggtgctcgacgccggcacgggcaggaagcagcagaagttggtgctcgaggacgacgggttgcaccacaccggcgcaggcaggaagcagcagaagttggtgctcgacgccgccaacgacgggttgcacctcgccggcgtgggcgggaagcagcacaacttggtgctcgacgccgccgacgacgggttgcacctcgccggtgtaggcgggaagcagcacaacttggtggtcgacgccggcgcgggcgcgaagcagcagaagttggtgctcgacgccgccgacgacgggttgcacctcgccggcgtgggcgggaagcagcacaacttggtgctcgacgccggcgcaggcgggaagcagcagaagttggtgctcgacgccgccgacgacgggttgcacctcgccggtgtgggctggaagcagcacaacttggtgctcgacgccggcgcgggcgggaagcagcagaagttggtgctcgacaccgccgtcgacgtgtcgcagcacaccgtcgggggcgcggagcagaacttgctgctcgacagcactgatgacgggttgcaccacaccggcgcaggcggggagcagaacttggtgatcgatgacgacatcgacgggtcgaaccacaccgtcgggggcgcggagcaagacgatgggttgcaccccaccggcgctggctgggagcagaacttggtgctctgcaccgacgtcgacgggttgctccacaccggcgcgggcggggagcagaacatggtctgcgacaacgttggcaccatcgtctccgggttgcacgacactatcgcgcgttgggagaggaacttggtgttcgacgacgtcggtacagccgttccctggttgcgccacaccggcgttgatgggaagcagaacttggtgtaccacctcgccacggccaccgtgcagagcgtgtggcgggagaattgcatggagcagttcaagctcgtgctggaagcgcttcatcaacctcatcgccacctctatatcgccgtcgacatggagttcgcagcggacgccgccaccaacgtgagccataggccagtaacctccatcagctgctaccaacacatgcgcaggtacgtgaacggaggtggcatttttcagatgggcctcacatttgcattcgtcggtgaaggcgaacaagctccctcgccgctgatagcactggagatcaacttcgacttcaacgtcaattcgccaaagtaccatggcaagtcgatagatttcctatccagtcaaggccatgatctcacgcagcacagcaaaagaggcgtcgcgccggagtttgtttacgaggggctcctgcgccacctcccgttcggcgacggctccgtcacctgggtcgcctttcacggcgactatgacttggctttcctcctccgcttgctgcaagggggagaccatggcggcaattgcctcctgccgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46712 - DNA, 1141 bp, Oryza sativa
gcagccctaatccccctcctctcctgcatataaatctctctccagctcgcctttgcaccatcgccattgctgcatcccagctaagctcgagagagaagcgagagagagagaaagagagagagaggttggtgcattgcggcaatggagatcgaggcggcgaagtgcgagtgctgcgggctgagggaggactgcacggtggagtacatcgccggggtgaaggccgacttcggcgggaggtggctgtgcgggctgtgctcggaggcggtgagggacgaggtggccaagaagggcggcggcggcggcggcggcgggcggcagctggaggacgccgtcagggaccacatgtccttctgcggcaagttctgccggaagaaccccgccttccgcgtcgccgacggcatgcgccagatgctccgccgccgctccagcgacatctccgccccctccggcgcctcctgatcatcacccatcaagctccggcgagagagatcaagctatgagctctgaacacgaagacgacgacgagcaattaatggcgccgcggcggcggagctaattaagctaagctagaggctaagctaagcttaagcttaagctgaaggcttaacgccatttttaacctcgaaatctcaatcaatcagctgcctcgtgtggagaagggtctccgttgaggtggtggtgccaagtgtgaagccttctttggcctagaagatggcttcttaaatcttaatgatgaacattattgttcgagttttggttaattgtagcaaggatgagattaatattgattcattgtacaaggagatgaatagaagttcaaccactgctgcaatgtagtattcagtggtttcatgaattcaattaatttgtttatattcttatcacttttaggattgtactccatttgtctcaaaatataaagatatctgaagttcttcatgaagattaagaaaataggcgaaattgaattagggatgatttatgactgttgatgtgagtaagtatgtagaacttcacggagattaagaaagtaggtgaaattgaattagggatacatgttactattgatgtgaataaatatgtgcagaaatttaatgaaaaattgttgcgattgattgagataagaaaatagatggagtaa

SEQ ID NO: 46713 - DNA, 4437 bp, Oryza sativa
ccgatcaaatcatcccatatttaactatacatactttctaatacccgtatggatcttcagaaatccacagtcattctttcgcatgagaaatagcaaaaccgttttttcagaaaaaactagagaaacaagtgttctgtgctctataaatagtcttagaagtgtggtgcaacatatatataaagatatactccctccgtcctataaaaagtccaactttggtattggatttttttttatagggggagtactgctttactaaagatgaaaataagaaaatctgactctgcactgcagaagtcacttcagatttggaagaactgttccagatgcttcatgcttgccattgagtagctactggctagcatcttgtctgtcacagttctactaagcacaatcatgttggctcatgtttttagtactactacagagcatgcaaggccaaatgccaatcatgaaaggaagatgatttgctgccaatcagcaaaagggaaagaaaaaaggaacaaaataaagaactatgctagtagagggacagatgctgagtaggactcaggtgcttggttagttggtttggcataattcaggctatgtatatacagtagtagcttaggagaaggataatctaaccatttgctcctttggaatactttgcataatctgattctgcctgagatgccaagcagaagggatggatccaaaatgccgagtcagatccacatttcaacatgtattcccctatgttagggtctcatcaatgcccctgtgtatgctttgttggctgcaatgatgatcataccctgtactgaatggccaagaaagcctagatccatggaacagtctaccaccagtggtcatgttcatgtaagctgtaaaattttcttcagattaacattatagtagatcaattgtccaacctcaagtttttactaggagtttgcatctgtctaaatacctgtttgtttgataggagtatgtctccgtctctaactgtactttggtctagacttgggcacatgatggtgaaagagacttgaccatcgatttctgtcgcgatgaaaatggtatgtctggcaagaggaatgtagaatttcagaagcgcatttgtgtcagctatgctgctgtttccatctctattttcacttttttctattatttttgctcgacaataaagaagccaataccggtttttacaggttatatccctgttaagtactacctccgtcccgaaatataagggattttgtgtggatgtgacatatactaatactatgattatgaacagaccctccatcccgaattaaaagggattttgtgtggatgtaacacatcctaatactacaaatataaactacgaatatgaacagaccttccgtcccgaaatataagggattttcgaaatataagggattttgtatgaatgtgacacattctaatactacgaatctggataaaaaagtatgtccaagtgtcacatccacctaaaatcccttatatttcaggacggagacaatatgaaactatttaaattactttcatgatacttgtatattacactgatactagaaatgttttcataatatatagattgatcaatatatcctaatagagagttatggtcaactctgtatcaaagagacggtaaaaattcaaaaatgtaaaaataatacatgttttaacagtattgatcaacattcctcctatataatgatataaacttctaagctggatagtggccagtgctcaaattgtagtagcttagttcaggtgcctggccttgctggcaagggccacgacagctgctatttcaggttcagaatcaaagcttcaagtttcaacctcccttagtaccatgtttagatggagtaatatctcaataacatgtaaatagcacaacaatcatcagcatttacatagttggatttgatcaaaccaataccagatcaactcagattgagaaattagaatataataaaaaattggctatcaatggcatttagttgtaatataaaacataataatattatatagttctgattaatgggatagtaacattatttgttaacactatgcctgctgatttacaccagaacatcaacatggacagccatctaagattggaattacattgacagaactaatactccagcaaagtgcttcttgactgctaggtggcaaacatagtaatgtagcaggaactaagacaggtaacttccaagtcttcacatagggtaaatatgaacagcaaagccaacctgcataagtacaggagtctaatatcaagcatctagtaagggaacaagcatttcacagaaatctgaaaaaacaaaatgaagcacaaacctaccatattgggacttgcatgttccgcagacatcattgtctaactttgttcctcaagaccatcgaggcttgaagagaagtagaaaactagagctcatgaaagcggaaagggattcggagggtgtatgatgatttgaatataggttggtactaaatgcaacttgtgaagagacatgagatgaatctagaatgaatgaaggtggagagaacatgtcatgatagatatgcagcaaactgggaaaaagttagtattgacatagaagggagcaagagaggggacagcttccatcttccacccagcttcttccttccaaaaagcagaagagccagtgaggagatatattggtgttctttgcagagcaccagggaggtcaggatggttgaagggtgagaatcagttagctaggaggttatatatatgcaaagaaatgcaagaaaagtagtttccctagaactatttaacatctgattggggtctaagatactagaatgtatgctatcgttaacaagctgccagactatgctattctacctgaaatgaactaaccgcagatgtttctgcactggcagagtgccactgtcagttcatcacaggtgccatggatgcaaataagattttatactacacctaaaacatcataggtgagcccaagctatgaaggtatgtcaactgccatccaccctatccttaccccactgtccaccttaacaacacctacatatgacagttttcactacccaactttcagaagatgcttcacctacaaaactccacctccaccataaccttgaccatacagtactacctaacttattattctcattactctatacactactatgcatgtgaacaactaaagtcagtggatgataacctatgtacacagacactacccttccatcctcccatcattcaatgatcggaaatatccagatggagaatcctcctaagattctccgtcgcaacagcagtttcattatcattgaagaagtcaaaccctgatccacccaccggcgaggaaggagccgatttagcatgcggcttcacctccacttcatcagaccgctcaaatagtggcaattcaagtgagatgctgcggttctgtcgcagagagaacttggggattgggagcgaactaggcaggtggtgaattggagaatgctgggcccgcccacagctcagggcgggatggaggagaagttgtttttgcttattgagatgggccggctacgcttgccaccacggcgctgcagctgttgctgctgctttggcgtcttaggctctggtgatgagtacctgcgaccacgcggaggtggtggggagggcaggaggccagcacatacaccggaatgaaaagaccggcagttcatgccacggaagccatgggagaacggcggcgatgagaagtgaggccccgtcatcttgcctcggccaccagagtgttggttatggtggttgcgctgctgtgagataaccacaagaccctccatcgtcggcgatggtgatgatgattgcggtgggcgtgaaagctcgacacttcgcgatataacttaggcagcttggagcagtaggtcacccaaagccctagtgcaaaacaaacataaacacactatgagaccaggtggcatccccttcactagtacaataaactgaagttagcgcaatcaactgtagttagagtaactacaacagaagaaaacaaaaaggacagtctttaaagctaagttcagcataatcgcaagacacaacgcttctaacagttgagaaacaaacagagaactatcactaacaatcacagcaccaactgggagtactaaatttctcagcgccacacatcaatccacaggaaaactaaagccgcgacgacgattagattcatgatgatactgtgagcaacaaattccacgggaagaaaagggattattccttttcgatgggggttaccttccagatctacagccgatgcgcaagtcgaatcctccacagaaatcgtcgtctccaccaaccaaccagactctcctcttcctctcctccgattctccgtcagatccaccacccacacggatcagcacacactgcatccatccacacgagca

SEQ ID NO: 46714 - DNA, 3168 bp, Oryza sativa
ccgctggatttgataaaagatcttggcgtccggggtgatctgggccgttggatcgggtgtgggaggctcgaatggacggtgatcgtgcgggggagggggtggcttggggctgaggagtggggggctctccggtgttttggggttaatcacggatgtgtgccgcttggggagttgggttattgagcacttttgttggagctaatccacttggtcatttgtagaaagatgcttatcaaaagtgctttccttttttttcttgtaggggtaatccaaagtgctttctaaacaagtgtttgctaaagtatcctcaatgagcaaatactacctccatcataaaataattgtaattctagattctttagtacaataggtggattagtagttgagggtaaaacaagaagaaatttgaatgaaaaagtaattaatgagactattagtactccattgtgacaattaatttgggacatattcaaatcctaaaaatacaaatattatgggacaaagatagcagtgatacgtaactaagcaaacgctaccagttatttagtttagaataaattttatgagtcacattttattatcgaagtttcgatttggataacattttaaccaatatttttatttggatcatattttattaccgatgtcggtcgaatttaatcctgacatggaagttagttttccccttttccctctttgcagaacttttttttctagttatttacaaacagggaggaacgcgaattgaaattaacaaagagatggacttgaaagaacatttttttcacaagttattctcaagtggaatggaaagtaaactatctgcaatttggctattcatgtccaagttgagatttccctatagttgtaaattttgtcttaaggcaaattttgacataagacacttaaaattgttatactttgctggtaaatattgtaaaaatgtgtgatggttgaaagacacctgaaaaattgataatttgctagagaatacttctagcctgatcaaagagaaaaactctttaaaatgacgcgaatgcccctaaaaccaaaagcttctgaactgacgctggattgatatgatgtatgctagcaatgtgcatcggatgatagaaaatttagaattggcttgcatcctcatggacattctcatctatttgaaaatttcttcaattggactaaaagtgtcatccaacaaattaccaaaatttgagggtgtcctcccactgcagcatgtatttgtgatgtttgccaacaaattacatacactataagtgtccttttcttaaacactttttaagaaaaatcttcatccagggcggcaaaaatcatgagtcacgtcattttgctagttcaacagtgtcaagaacatgaatagtaaactgttgtacattgaccaggttaaggataaataatgataacagatcagaatgtgatcaggtactactagtaccatgactgtatttcaaagacttcaattgcactaaacaagaattttctaaatccttcctgtgagtctcaacatcggcaagtaaagccacacgtcgagtatatattcctcaccggcactgcacataaagcaacactacatcgacttcatccgtgcctctgaattctgattctgggtgctactttacagtactgaatatataccttgtgttttagactgtaatccatcagattacagatgaatccacttcaaaaatctctcaaattagttaagcataccaaagtttaattactctgagacttttaactttcagcagtggcactggcaaacactattctgaacagtaagcttttggccatcaactctgtcaagagagatgggcagcttttgaccagatgatcaaatccatcagccccttcatacaccagggtgggggcaccagtgagagagatcggcaggtcatggggccatccgaatcggtgaggtcagcaaacggaagttcactgcgacaacgagatcggcgttgtcttcgttgaggacagagaagaggggatgatgcgaggctgagagtgtggggggcgaggacaaggggcaccatcgacaaggtggaggtggtcgtttcctggtgtgggaggcgattctggtgttgacaaagtagacaggaggtggtcgccaggtgcttcctgcatgtctcaagcttgccgcatcgtgctccttgctagctcctcgctgctcgtctccattgtttacaggtacgtcatcctcagctaattatcaggtaccagacttgataggtatcaagcctgatacccaccggtattagacttggtacccaagtatcagccgatacccatagttatcaggtgccaagtaccaggtatcaagtatcaggtgccaagtactaggtattaggtatcaggtgccaagtactaggtatcagttatcatgtcgcgaggaggaagcgcaggttgtcactttctagccggctagttagccatttaccaccgatttctcctctcctcttctccctcctctcctattctccctttctctcctcgacacactccctcctttccctactgttgatgcggctcacgaggggaggagccaactagcggagctgtgcatcacccgtgtatgaaagctgccatggctactccagctagatgcaacgatgcatagacaacgctgacgagctgtcgggtaggaacctggttggggaaggcgcggtcctgctcaaagtagttgcggcggcgctccgcgccaccgcaggcgaggtattgcccgtggaggcgcatgataccgagtaggctcttggatggggaaggcgtcgccggcgaggtttttgcgtggaggtggtaggtagggggaatcgtgtggatggcgtggcacttggtcgaaaatggaatgtattaaatcggccgagggtgtttagttatcccgtgactttcatgttgtaacagaatcccatgcggtagctgccctctttgtttagtgtctttcaggaaaactatattcatcctttaagagaatatcccattatttttacatttcacttaaaaaggttatcaaaaaaaatttagtaagatagattaatataaaaatttagtaagatagattaatacgtgacatgtcacttcacaaacatgcatattcaaattcaacttatataagtagaaacaaaacaacaaatgggactatgaataaaacgcataatt

SEQ ID NO: 46715 - DNA, 4674 bp, Oryza sativa
  unsure (1)..(4674): unsure at all n locations
cgccccgaactagtaccgaccggaatagcccgtgacgctccaaattaacctgtaattcgatatcagtcccaggaaacagtgctggtatcacaggaagacagattatcacagcaacagaggtctctttaatatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactccacatcagcaggatccgcttcatcttcttcagcaactagggggattatttatatagagcaagggtgagtacgggagtactcagcaagccaggggaaataagtgtttaatgcaggcttcaaggagaggctggtgtttttgcaattgattttatttgaactcttttctgaaacaactaaatgagtgcttctcaaacgacacggatgagacagtgcgtctcgtccggtcggagtatgtgcaatgtatcagtctttagattttgaaacgaggttggcacccggccaacagcttttcaaacggccactcgggccaacaactttcaaacggccacccgggcctagctgattccatcagctacagatttttcaaacatcgaacccctttccacaacagcaatttcacaagcagaagttaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgccgagaggggtcccagaccaacaacaggttaggtcccagaccatactgtgccaggaagcccaggggtcctccccgacaccacctcggcgaatccacatatctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacctaggtgtcgggttttccaagtcttttgtaaaacccaagttttacccaagttgtttttcagattttaagtttgaaggcgtccgtcgatactcgcactgggtgcacgaatatcgagacgcaactagatggttgcaaggggacatggtatcacaattaacaaaggacggatcaaatgcaacaaattaggtaggtctgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacagcgaaaataaagccctattaatgacctctaagcgtgtcattagatagatctcgagatttgaggaattttggaagttgaacggagtcaaacggacttacggttgggaagatattgaatttctaagattattggatttttgtctaaaggaaaaggatttaattaaatcctttttggaaaagaaaagaaaaaaaaagagggagggaaaatagacttccctcgggcggctagggcgcggcccgagagaaagggcggctcggccgagcttaacgggccggccggcccaagaaggcggcccagagcggcccaagacgcgcgcgcgcgggagggaggagagagagagccggtggaccgggctcaccacgcgcggtcccgggtgggacccgcttgtcagcggctcggctcaccgtgcggagggagcacgcggcgcggcgctagggtgggggagggacgcggtgcatgcgcgcggttcgcggtggatgcggatgcggaaaccgacttaggcggtcaaggcacgggctggcgctctggctagcggccaaaacggcgacaggaggtgacgccggcgagagggaaaaaggggaaaagagggagagaaaaggggagcttgcctctttggggaaaaggaggaggggagcgggggcgtcgcggcagagggaggagggctctgcctccgtcccttggcggcttgcgcgcggagaggcggggccaaggcgatgacgacggcgatgacggcggggtggtgtggagcggagcggcgacacgagcgacaggcgcggcaggcgctgacgacggcggcgaccaggcggttggccaccacggcacgcgcgcgcgggaagcaacgggcggcgcggcggtttgagcggcgcggctcgggcacgcgcgctggctgcggggctgagcggctgcaggcgcggcagggtagcggggccgggcgacgcggacggcgcagacgcgactcgggcgacgaccacgcgggcgcgcgcgcgaacgacgcgcggggagcgacagcgagggagcggagagggaggactcggctcggcgcggagggctcacgcgcacgcgcgcgggcagagcggagggggaggggcgctcggcgcggccctcgcgcacgcgcgcgcggcgcgcgggcggagcggggtaagggagagagagagagagagagagcgccggggaaggaagggggagatgggccgagagggattcggcccatcgaccctggggaggcaaaatagacttttgcggagggatttgatttggaaggatttggattcggaatttaactcgacgatagatcggggatttgagatcttgagatggcacggacactagacaacaagcgaagaaacaaatttcgcaattagggtttttaagagataattttcccgctagacgccacgacggaacgggcgctacagaccaacccccctaacaagaatctcgaccccgagattcagcacctaagggagcagctccgggaactcggcgtggagaagatcttctcgttcccaggttgcctcatcttcagaatggttgctccattgaactttgtagaacttgatggtcttccttcgagtctgacgttctgcctcttcaagaaccttgatcggtctttccttgtaggtcagattcttttccagctcgatattacccagggggacttgctcttctggaactcgaagacatttctttaactgggatacgtggaacacgttgtgcacatctgcgagaccttcaggtaactcaagctgataagccacttcgccacgtctggcggttatgaggtaggggccaatgtagcggggtgctaacttgccggacatcccaaaccttctcataccacggagaggtgatacccgcaggtacacatgatctccttcttcgaactcaaggtcacgcctccgattgtcagcgtaattcttttggcggttctgcgctgtctttaaacgttctcggatcagcttaacttgttcttctgctgccttgagtatgtcaggaccgaataccagcgcttcgcccacctcattccagcacaagggggtgcgacactttcttccgaacattgcctcattcggcgacatctgaatactggcctggtaactgttgttgtatgagaactcagcatacggcaaacaacgatcccaagtgcctttgaaatccagggcacacgcacgtagcatgtcttctaggatttggtttaccctttctgtctgaccatcggtctgctgatggtaggctttactaaaatttagatcggttccgagagcttcatgcaactgcttccagaaccttgaggtgaactgagtgcctcggtctgacacgatcttcttggggcagccaaatctacatacgacatgggtcatgtagagttctgctagtttctttccatcataggtggttttcactggcacgaaatgagccgatttcgtgagtcgatccacgattacccagatggagtcgtacccgctaggggttcttggcaaaccggtgatgaaatccattccgatttcttcccatttccactcgggaattggtaggggctgtagcagaccagctggcctctggtgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaattccttcttggccagtacacagatgcgtggaccgcaccaaactgtgccttgatcgtctatggagaaattggtatctttcttctcttgtattctttttattaactcttttatcccttcgtcgtctttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46716 - DNA, 5233 bp, Oryza sativa
atagcaccctgatactaggtagggatgaaaatgatcaaaatatacacgaacaattcccataaccatttttttttctttgaaacagaattggagtggtagagctggaaacgatgacgatattgatactaccggaacataaaaaatatcgggaacataattattgaaatagagcctctgaaacaacatatgtatcaagggcaagcaagtcatattcaaatttaattaaaactcctcattttcaaaatataaggcataactactttttcagatatttcataatatatggtgggcatgcatgtatgcatgcaactaactagcacattctctccatcaaattattattatttaaatcatttactctcaagatctctgatttggatgcatgcactgtatttattagagtgatccaaacgaggaggtgataataaatatatattgtgtctacagattaagggtggttatgccttatattttaaaatgaagggagtatgtgaagactcaaattaaagcattaagtaactaacttgaatattttataacgatattaatcataacatctccattaacaacacagggttatggtaatcggtaggtttctcttatcctaattgtttgtcagtactatacgctaatttcttcggaaattccgaatgaaaatggtataccgtcaaaatggccgggaaaaatacctctacaatttttgttccatttctaaacaatacaaaatcagaataaaacgattggtaaaaaaacagaaacaacagccactatggttgggcaatctccgtaccattttcaccactaataccaggtatgactatgagggcaccggctgaaggatagttcagcatccatcagcatgtgagcagaacaagaaagaaaagaagagaagaaaagaatgaagaataagaagacaacgacagcgaaggttgagttatatggcaatttttttacccatcctttgggcatggaaatgactggagtgaaagcaaagagaagacatgacccttgatatgagagaggagagatggatccatgcaaccctagctatctagtctcctagaggcctaaagccatccatggcagcaaggtggccggcctagccgaaagcacaaagctcagcagtacattttttgcatggggccaagccaaaacgatctcatggacagtgcacagcaaatgatgctagtttggtgaatggtgatcatgcatatggattgaaggaaaaaaattgcaaaatcaagaactagagatccattgttcattccaaaacagagctagtagattttttccacacaattttgcacgaggctggttttaaaagtagaaatggattagctatacaaactcttgcttttgttttaatcaatataattgtattttgtatgtaactaaatcaattaaatctctgttacaatctaacctaccacaatcaaacgacattcttacccttttcttctgattaaggtgataaatttttaggcattcagagagaacatggtatttcttttcctccatctccttataatatagtaatggaaacaagcaaccccatctcttcgcttatgcatatacttataagctaatatttgagttttaatatttaatttacatcatagtttatttgtacatcatttgtttttgaatcgctaagaacatgtatataaaagttttacatttattgattgataataagccatatgagaataagcacaagcataagaacgatggggctatccatccacggatccaccatccacattccctaacctgccctgattttgcatgcagttctgaattgattatgtcttctgctaatgattggggagtgccacaaactgtcatgactcatgagctgggggctgctgctcttttcacagcatcatgtcctagctgccctgataactgatctcacctccctcaggtcaggatcaaaaagcccctcattctggtctctggccatgcacaaacaacatagcctcatatattgatttgcaatagctaccaataattacattgcatggcatttatgccttgtgattaatcttttttatatcttgaagaaatcagtagcatgggaataaaggaaggagatcttacatattggatcggaaggcaatggagtgaaagtgtcacgcaaccaagataattagcttgtgatcctacttttaagacaagtacgtgcaaaaacaccatcaattggctcacaagtacgcatgcacgatgaagaacaaaagagcaaagtgcttattattcgatccggcacgaatctcgaggcacggaaagtagtgatatcagcacgacagcacctcaccttcaacttacagccttccaagggaaataaatccatagctcatatccgctgttgcctcaacaagaaggcctactgctacttcacaaatactgcattcttttctccaacttagctgtagtgctttgtcatgaagaattatggatcaaaatgcacctgcttttgatcaaatggtaaatgcaatttgaactacatgaaaagaggacgccgcgaaaacaaagcttcagttggtacccatagccaaagaacatttcaggagcaccctagacaaggcaaccagcacatcagccttttgggttgaaaggacttcggaatcggaattggagaagaacttgtgaagtgaagcccacctttttttttttttttggaaatgggagttttgcttggagagagagagaagcagccgggagaagcaactgtagggttttatcctctctaagagcaaggataataatacagctagctgcttactgtatagatctttatagtctatctcttaactcacttatatagtggttaactcttcactataaatatatggcccacctgtctgtatcacagattttcttggctcctgcgcctaagccgactgtaaacttacaccccgcttctcatctctctcctctgctctctcatccacctcagcattcagcctttttatagccctcttacttgctctaatcagtctaatgtatggagaaacttcactctgcatttctgttgttcctggacagataagaacacatcatgcatgttagtccactagtaaatagtaacactcaaaaacaggtttgcactcgatatttactcttgtacacaaactgcgtttggttcttgaagctgcatcaagccaccaaccatcttttggtggtttttacagacaagagttccaagttaattgttagcctgaagaccttagcatactggagacaatctacctagtgtgcatttgccaggcaatacctcagtacatatttgataacaaactagatctttatgactgctgcaagtagcacaaactaagttttttcttttaggcaatgcttataaattggcagtttgggaaagctttttgtaaaagtgaactcagctggattcatgcattccatagttatctacagtacacagaacacactcatttgaaaatgtttctcaaaaatcagcattaagttaaaaataaacactaaatatagtagtactgaactttataataaaatatccttaaaattctcaataatcatattgcgctattgtaaacggttaactacatggtcgtgcagttaagaccacttgagtagcagcattgcagcacatcaagcttcgagtggcagattgtgaagataataagagcagtcagatcaaccaaaggtgtaacttttattaccacggctatgtacaaaatcattatggtgagcattgtgctcattgagatctcccctaggcactagctagctatttcattcatgttctggatctagtagttgaagtgacattgttttcaagacagttccttttgtaacttgacttttccgtctaatgtgcaaatatgttaaaggcatctgcctctggctgagccaatctctctttttgaaagaagataaaacagcctgcgtttgttgatgaaggactgtgcaccaggaaggaactatcaagagaagctgtcaagaaagatatagaaatacctttatcaacaaatcgcccctttcaccaattgagctcatagtgtttgtggctaagaaaccatatatttcatatgcaccaggcccatttggaaaagaagccttctgccttcatgtatgtcactttgtgactggcaaaaaaggaagaaaatttagtagatactactaaagttgttagtatatgaaaaaagtaagtgcatttgaagtagtagtgcttgttaaacattttcatcggaaattaattattaagagaacagtaggggaaaccctatagtaatataatataaaaagcgcacagatgatctacaagactgacaaggaaacttaataaaagcactaacaacgcctaagctaacagcacaaaagagttatggagtaaggcctgatctaagctttagtgcccaatacaaggtacataaattgttaataattatggtgactattgtttgacgctacatatccatgccacaatgtcatgcttgacgcagatacattattagcgtcacagtgtctctgatgcaagagaaataaaagtgacgctaacgagatagaagatcaggtccagaatggatgttatattgataattgtagtcaccaatatttgggcccatatgttagtaatgactttttcttgagatttgaagtggtttttcagtacggcgcttccctactgggcactatgcaaatggaacaaatttaggagaataccacaggtacaccataatatgggaagtagccattgctgtctgaggtgttcattgcagcaaacagaacaacctaatatcaatatagaatcaagatattatttctgattatgaacctcactagcaggaatttacaaaatatcttaattatgacaagttgtatctgtcattagtagttgacattgcgaattaagtgtgatgcatgctacattgttttgaatcagcttttcctgttattatgctacaaatcaagccatgataaatccccatgctaataatagaagagattcttacaaacacatgatagcagtagacatgtgcaatgaaatacaatattttcaatgaagcaatgtatcataaatgtatgcctacgtatagacttatctgcatagttaagttaaggggtgcaagacattgaataatccttccaattttagagcagaaagatgtgcaccctattaatactaccaatccttgttatgtaagattttattaccagaggtttccatacagtggtgtccatccatacagtggtagca

SEQ ID NO: 46717 - DNA, 2105 bp, Oryza sativa
tggatagaggataccatattcagattttactagcccaacttgttcctgaagcttatctgataatagcttgagtaattctctcgcatctaactcaagccttgcaaagctcttatctttgaagaatgaaatatagtttagcatttgactgtcagtacatacagatttgttcgaggaacctgaattaacaggcttggttttctcataaggaagataaattttgttgttttcaactgcttcaagaactgctttagctgcttcaagtgaacgtttcgtatttttaccctttttaagcatatccaatatcatatccactgcagaatccagatctccaaatttcaagtggcaggagagcaagcaatcataaaactgcctgagctctgattcactaaggccacaggcctcattaacatgtctcctcagcttctggatctcatctctgtgcccattctgttcatatatccgggccataacaatcaacgagctgacgtcaggcttcaaccctatcctaggcattaattcaagaagctgctccgccttttttgtagtgccaaacagaagggatgcagtcagaattatgttgaaggtcaatgaattgggcttcattaatagcaatggacggttgctcttcttccgtggatcaaccctattattctggaaaaggtagccaatctccattaccatgtcagcagcaagaaatgcaccagttgcagtttggcacatatgcgccacgatagccgaccatgctgcaacaggtgggtatgcttccatctttatcaacttcctcacaacatttatagaaagattaggaagagaagaccgtgcgagtgcaagagagaggaaaataaggggctccttctccaacagtttgctcttctcttcaaatgcatgattaaccacattgtaggactggttcagccagtgagcatcacaggtctctgcgaagccagtgatgagcttactcaaaacagactttctggggactccatccatgtgaatatgcttctcataagccctccatgcatcatcaaacctctgctgatcaattgcattctctatctccaatgctagcagggatgggtcatgagcttggaccagaattgtttcagtaagagttgataagcatggaccataactaccaatatttagctttgtgttcaggaacccaattgcaccagtccggttagtccaacaacacttggagcccaagaaatgtgggctttcatgaccaatcaaatgtcttggacccaccaggaatgaagaaacagcacgggttgaagatcttgaacaaattctcccaacacgaagcatttgcctgccatggacaaggaggatcacacaacagaacaaaaagaactcagactaatatagcaaatgttagaattctgcatcgtgttagctggattcaacaaaataactagcaagcaaataatgtattggacacatggttgatgcattattcagtgttactcctcccatcctctgcccaattacaacaaggcaatcacaacagaacccaaaagagatatgcaatgcaaactataaagatctgttattgtggaacattgttgcaactaaagggagcttgcaagggtacaataaccacagccagaatcatcagtctgggttaatcaaaccaccccagtgcatgtccactaattagggaagattgtccttcagcctgataaaccagccccagtgctgtccgctaagcagggcggaatgccactcagactagataattgagtgacatttcgcagagaagctcaattgcaatgtacatagagaagaaaatctaaaagaaaatgtcataaagtttctctcatagtgttcctctagaacaagcttgcaaacaatgctactctacaaaccgcaaatttgctctaacagcactcctaaactcttctgtttctcactacccagcattctattatattagttcccatctaattcccttttcctcaacataaaacctccaccaccaccagcgccctaagcgattccagcattctagcaccacacagcagtagaggagccatgaaattttcattgagtgcgtgtcacaatgactcacaaagattgattttacacaatacaatctgcgccaa

SEQ ID NO: 46718 - DNA, 2480 bp, Oryza sativa
ggcagccaccgagtcaggagtgccgcgcgcaggacgggggtgaggcggcgcgcaggctcacgagccgcgacggcgggctacgcgtgagcagagcgcgagcatgccagagtccgcgtccgcgtccgccgcgaggggaggggatcccggcgacggcgagccggcggcgcgcgccgcctctctctctctccgacgcagcgtgcgccggccggagaagacgagtgggctgaaataaaacgaaacgccaggcagatgtaagattgggcttttgttatcgtcctagtgggcctaccgaagcccaagtttgttacaaaagcccatgtaggcccatccgatgggctgggacttaatcgcacggcccagctaggttttagaaaacaaatcggcctgaactaggataaaaatcaagtttcgttgaaaacaaaatcttttcaattttggaggaaaacagaggactgataaattgataatactagcaagttctggatcgagaggcaaagagctcatctgaaccatattttttttatgctgttgagtgctactattgcttatccaattgaaaaccatggtccatgattttctttctggatttttgtactgttctttttttaggttgttctcaatgactttggataattctctgttaatacatatagctaatactctcgattcatgtttcaacaaaagcaaattatggttttttttcctacaagaaccattaacaacatgttcagatgattcagatttcctctctaacaaaagatttacaaagcatccatgcacagaattgcttgtaaaactgaacagctatcagcaataagctagaggcagagaccaaatgcaacactgtacacttgctgcttagagatggacagtccaatcaatccgtaccactattaccacactgacccactagcactgccattagtgctggtcactagcactaatgacatcactgacatgcaaatcatggaacgcaacagttgcatgaaccactcttatacatacttaaacaaaaacagggacaatgccaatctctgaaggcgacatggatctcaactctgaagtctgaacactagctcctaattgctcacctaatgagcttagctaccactctacaagaaccagaaaagggagcagattaattaagatgatctgacaaagaccaaatatctgaacatttgccatttggaattgaggagggagaggccttgagccacttccagtttcaggatcacgctgatcttcttctccaatttctgaaaattaacctggctgattgaatcagcaagttggagtttacaaaatagaagatctggcgagtcgatcggtgtcagagttcttcgatgccctcgtcgaatagcatctcgtggtagcggcattcgtggctgcagaaggccttctcacccctgaattaagaagaagaagatcaggcattctgatattcagaattggtcactttatcaattcttctgtagataatgatcacttgatcaaatggcatcaaacagtgtgaagaacttaacaatatttgtagtatctttttgcaagtgccaggtgatacttgacagtagtttaattagttagttggcgatgtggttatcaatgtgcataaatgtccatattaaactctatggaagtacagacatgataggcttttcactgaatcatcaccgtcgccaaattgcttagagcatcaggaaagttttaattcattgtaaattaactccaaattgcttagagcatcaggaaagctttaattaattttaaattaactaatcaagcaggtttatagatgagacatacttttcggcttttcgctcattatctttctttcagaaaaaaaatcaactccaaaaaacttaaaaagatttttcaaatctttgatattgaaaatgatactgaaatctgaaggtgatcggatgaacactctattcagttcagagaaatgaagagtagagtgacctgtacatgaagatgtccttgcctaggccaaggtccttgctgcagccatggcagtagcgcaagaagtcgccgtcgccgtcgtcgtcgcccttgccggcggcgctcggtggccagagctccggcgggaagtactcgccgtcgccggagctctcgacgacgcggttgtcgaagatgtgcgtcgtcctcgggttggccccgcgcgcgatgacgcaggtgtagtcctccgacatctcctccatcatctccctcggcgacatccaccggcggcgaggaggaggcgcgtactgcacggcggcgccgccgctcttgacgccgaactccgtgcacggcgcgtagtagttcgtctggacccggagcctgatctgcccggtcaggacagacgacgccgcggcgtcgccgggggcggcgtcgacctctccgtcgtcgtcgtcctcgtcgtcgttcaaggcgccgacgagcccgagcccgacgggcctcgtcgcgtcccaagggcggtgggtcctgcactgtccatcccc

SEQ ID NO: 46719 - DNA, 2216 bp, Oryza sativa
cgccgccgccgccgaccgccgtgatcaaacgcaatctcgtgctgctgcttgttgctgcctccactactgctacttggcttagctctcttcctcaacatgctaatactagcatcaaaatcaataattaccacagcaataatcctgcaaaagaatcaacgccatgaacgcatcagaagattgtgcaagaaccagtgggagatctcgtggacggacgcatgcatacacgcgcgatgaacaagatgaaagaaatcgatttcgtttacctgcagctagctaggctagccaagcatgcagagctggctgttatcttcagttttcgcaggagatcagcagcatgtacagtgtgtgtagctagctacgatgtcgccattagcgaagctccagtggtgtctgttaaatacatgcatgcagatgcagttgatgcagtgcagctaagcttctctccggttttgactgcagctggatatatggaacgcgagcaggtaagcgagctagctaggccctagaggactgtgcaacacactgacacgtgggaccgagggtgtggcagggatgggcgagaaaatataatgtggaaactacgtatataaaatgtaaacctggaaactaccgttgaataaaaaaaatagacgtatgatattagtccacatcatcacgggtaaaaattttacttgcagattcacttagagtaaaattttaactcatgatgacgtggacgaatctcgaacgtccatttttcgatccaacggtaatttccaagtttccactacgcatatagagtttgcactacatattttcctgtgatgggcggatggcccctcttgttgaaactcaatttttaaaattgattttgagcactttagttattataatctattttccggatttagcttttaaaccgctaataatacaaaggcaaaattagttccacaccatcaagcgttcccccacttttactttatatcactaaacgttcccggtacactttaataccacccaaaatttgctatgactgttagatattgtttttttccttttatttttggctgaaatatgaagggatacaaccatattacccatgcgctacacatctaaaacatgagccctaatcaattctttttatcgatcgtcgggcattgcgcattagagaagcagcacgagcggtggcgcgcataggagaagcacggcgagcggcttctagggcaagacgtacgaacgactccggcgggagttgtaaaacaatcctagagttcattattagttgacgttagagccttaactgtttgtatgaaaaataaatgacgttttagctttggtggggttagtttggactaatctgagaaaattgatattttaccatcttcgggatagggtttccctggaatgctactcccgaatatggcttcgttaaaatgtcactttcaaacaaagccaactcgctaaaatgccatttcgaccaatttaggttatttcgaaatgttttcaccgtgatccgacatatttgcccctagccatttcgttgacttgcgtgagaaaggggatcgatcccacccagtcgtcttcttcctcccatcttgccgccggcaaccaccacttcttccaactccccctttccatcttccccttccttgccggccacgcctatctcaccacgccttcctctccggtgaccacctcggccgtcgcgccgccaaagaggaattgtgaggtgtccgtgtccatgtccatggttgcgtcggcgtcggcagtccggccgccgatgacgtgagggacgtcgtcgctgccacacaacctccgcgggtcgcccatgtgcgggagctccatgcgcaggtgctcaagcaagggctccacctcaacctgcgctccgcggcgaggctggtgtccgcctacgcgctactccgtctcctcccgcgtcttcaacgcggtccaggacccgcacgccgacgccttcctcgccaacaccttgctccgtgcctacgtgctcggcggcgcgccacaggacacgctcaccacgttctccgccatgctgcgcagggggcatggcgaggcactcaaggaggaggtcgtcggagaggacgaagataggagccgacgacgtgggaggcgatagttgcgaggtggagcaaagactgacaagggcattttggtcgcaacaagagagcaaaatggtggaaaacatatcggaatcacctaaaatgctcgaaatggcattccag

SEQ ID NO: 46720 - DNA, 20276 bp, Oryza sativa
  unsure (1)..(20276): unsure at all n locations
ttcctgcagcccctagcacagacaatgacactgaagccaggctgaggcacagttactgaatgggatccggattccctatcttaagttacacaacttttacatagcaaagttagagaaaattttcctgggtacccgtgaaacttcacctaatcccttttatgcccctgagatttgttcattccctatatacccttaatttcagtttggatcccttttataccccttccattagttgaccgttagttgacagttaaatttatattataaagcccattttgccttttgatataagaaaatataaatttatgaagtatattgatggagggtataaatttattgtatgcgactattatatgcataagtttattttgtgagatattatttaacaaaagtaatattttagtttccatcgcaaagggaaaacaaaataatttttatctatgataaaatctattttagataaaacaaaaaaataatattctttaccattgaaaacggtatatataacatattttgttatactagtacggatttttaaaagataaatcttgttatgcgagataaaagttatttttgttaaataatatctcacaaataaacccataaatataatagccgcatacaataaatttatacactctatcaatatacctcataaatttatattttattgataccaaaaggtaaatggactttatgatatgaatttaatggtcaactaacaatcaactgacgggaggggtatagaagggatccaaactgaaatttagggacatggaagggaatgagcaaatctcataggtatagaagtgattgggcgaactttccgagatacacagagaattttctccaaagtatacctacatgtcaatagctatatgttcacctatctaagatcacgttctatatcatactttcctaacttttccaaacttgtttttcgtgtgtatgcttctcaaacatttaaacaatacatttttaaaacttcttttataagaaagttgcttaaaaggtcatatcaaccattttctaattttaactaatacttaattaattatgcgttaatccgctgctccatttttcttgcgggaagaaaatgtttctaaccttttcaaaagaacaaaaccttaagcaaagcgagcctaactcaactgattagattccttgtgatgaaacttgctcactcgggtatataccaaacacgggtgcccacccatgttcaagtagacttgacataagtgctcacatttacaactagtttttttttcacgacgtactcgttgacatcaagacatataaagtgactttattaatctcaagatatgccgcctaattttatgagcacatactattgtactacgttttttttaaaaaaacacagccttagggcgaaggatcttgttccgacttaatgatgtggtagcgccaaaagattaccttagaggctagtagtatatagatgtgtcgatcttgccttacaaaagatcactgcaaagcagatcgccgtgcgcctgtgtgtgctttgcttgcctggattctttgcctgtaacctgatcctgtcgcaaagacacagcttaagtagttaagtgtaagcatactttgcagttttgagccatcactccactcgcaaaaagtggccaaaaggagatcgagaaatttaaaaaaggcaaagctagtttaaaatcgaagggaattgtttgaccgattttgtttggatcatatggattctttgatgcttttctcccaggacgtgccttccatgccataagctcagcctcagctgtcgctaaattctatcgctatcaaagagctcgtgcacaacaattcgtttacggacagaagcaactgctagtttttatttctattttttaatttttgcccagctgctagtagaatatatatggaataatggaggttttcagtttccagttatgaaaaaaaaaactttacgtcataatacgaacaaggcctagctgttgcattatgttactggaaggtatttttggaagttgcaacaagtcacgatatcacataaatttgcatgttcccttatcttagatgaaatttaccatttgctagtgaaccaaaattctgtctaaaacaaagtgaacgtaacttgattggttagcctcgttatggtgtgcaacttagggcctgtatagatccactggcaaaatttttcaccctgtcacatcgaatgtttgatacatgtatggagtattaaatataaacgaaaaataactaattacacagcctgcgtgtaaattgtgagacgaatcttttaagcctaattgctacatgatttgacagtataatactaccgtaaccatttgctaatgatggattaattatgcttaataaattcgtctcgcagttcataggcgaaatctgtaatttattttattattagtctacgcttaatactttaaatatgtgtccgtctattcgatacgacaagctaaattttttttacccctaatctaaacaccgccttattatccccctttgagttttcaacccatcataatcgtatgggtgatttgcgcgtgcgaatatgagcgtaatttttttgggactgtatttaaaaaggattttttttgttaaaaagcatttttgtaagaattttttttgttactagaagtattccagctaaaaaagtcatcgtctcccaaatggcgcgtcttgaaacgctgtagcgattggcgttggcgaccaccacaagtagccgtcgctacaaaccacggtgcgcagcgcatccaagcaaacaaaccaatcacacgagacgcagccgacgaacgcgtccatggccaccgcctggccacggtggcggccgtcctcgccgccgatgccgtcctcgtcgtcgtcgtcgccgtcgtcgtcgttcacggcggacccgccggcggagttcctctgcccgatctccgggacgctgatggcggacccggtggtcgtcccgccggggcagacgttcgagcgcgcctgcatccaggcgtgcgccgcgctcgccttctccccgccggccgtcgccgccgacctctcctccctcccgccctccgccttctcccctttcgtnctcgtccccaacgtcgcgctccgcaccgncatactcaactggtgcgaccgccctccctcccctaccccgcccctctgtcccccgacaccgcgcgcgacgtcgtccgccgtctcatgccctcgccaccgcctcccccgcgaggtcgcaggcgccgccgcccccgccgccggcctcctccgtccggacgaggagctactacagcgacgacctcgtgcagcagcagcaggaggcgaggcgggagggtgggtctacggaggagaggatcatggccatgctcggcgctggccccgcggagcatgaggcggcgatggcgttgctgcggaagatggcgcgggagaacagggagatgcggagggagctctgcacgccgcggctcctcgccgcgctccgcccgatgctgctgtccggggacgccggggtccaggtcaacgcggcggcggcgctggtcaacctgtcgctggaggcggagaacaaggtgcggatcgtgcggtccggggcggtgtcgccgctggtggaggtgctccgcagcggccacccggaggcgcgggatcacgccgcgggcgccgtatacagcctcgccgtggaggacgagaaccgcgcggccatcggcgtgctcggcgcgatcccgccgctcctggagctcttcgcgtgcgccggcgccgcccacctcgcccgccgcgaggccggcatggcgctgtaccacgtctccctctccgggatgaaccggtccaagatcgcgcgcacgccgggggtggtgcggacgctgctcgccgcggcggaggcggcgagggacgaccgcgccaacgaggccgacgccgccgccctccgcaggatcgccgtgatgatcctcgcgaacctcgccggctgcccggacgggaggaccgcgctgatggacggcggcgcggtggccgccgtggtgaggctgatgagcagcggctccgccgcgccggggagcgcggaggaggagtactgcatctcgtcgctgtacgggatgagccgggggagcctgaggttccgagggctcgcgcgcgccgccggcgtcgaggccgcgctcacgccggtggccgagggcgccggcggcgtgggccgggacatggcgcggcggacgctccgggcgatgcgcggggaggacgacgaggcggcggtcacggccacggggctgctcggccggcagtgggacgacgggagcgtcgtgtcggaggggctcgtgtcgatccggcggccgccgccgcgccggagcagctacggcgccggggcgtccgggtcaaacaccacgcagttctgaaaagtcaaagtcttcgcttctcttcttttatttctttcttttttatttctttttttttttgctggctcttgttgaagtatttggaactgtatttgccataggccccaaaaaatctggtggttaactacttctgatgaatggtgttggtgtaattggatggtggattcttttgttggaattaagctgtaatttaattggatctttgcacatgttaaattctttatgactgaatagtggaacctagaactgtgacacctatccaaattaggtctgtacattaatccatcggttctcttagaaggtatgtatgtatgtatgtgttactgggatttctgagttctttttcctgttcttgtgaaatatttgggatgtcggtgttctttttttctaaaaataatatttggaagttgtagcatgtaaaaattctcagaatgcatctacttgtttagcttccatgattgagtttgattagcacgagatggtttcatctacggtttacgattccgagatggccttccgtttcgggatctggcggaattacggttttcgcgaaattcggtgtaaagccggtagattctgaataaatttcataaaccaaaatttgaatacaaattctctgagtttacggataagcttgcgaaaaccggtcggctttgacgaaattccgagtgaaatcatcgaaatttcaatcggtaactagaaaaagaggtaaactgaaagtgttcccctctttttaattcattattattttatttcccattataaatttcactaaatacatggaatacatcattttttaaaataatatatcccaataggttctatgaatatcatactatttataagattttatttattttttcctttttatcaattcaaatttgaatttgatgaaacttatcaaaatctcagacggcttctactttcgagcctcgtcgaaatttcgaaatttcgcggaattcgaccggttttcgtcgaaattgtgaaccctggtttcagctgaagttcggaaacaagtatcatctcagcatttcatggttgtcaccaactacaaattaaattttacattagaaaccataatatttctcggtatcttctcaaccaatgcaaactcaattaatgctgtgtttagttccatcaaatatatggacacacatttaaagtgttaaatgtaatctaataataaaacaaattacataaaccgtatgtaaactgcgagacaaatttattaagcctaattaatatgtcattagcaaatatttactgtatcaccacattatcatatcatggtgcaattagacttaaaagattcgtctcgcaatttacacgcaaattgtgtaattagtttttttttcaatatttaatactctgtacatgtgttcaaacatttgatgtgacggggaaaaaaatttgccagtggatctaaacaccctataacaaatagtatgcgacagtgcaaaacttttgatatgtcgggtgtgttcttaaggtaaggttgggaaccttccgtcctagcatgaaaaacgaaacagtagattagtgcatgattaattaagttgttaactaaaattttaaaaataaattaatataatttttaaagaaactttcatataaattttttaacgaaaaacacaccgtttagcaattcggaaagcgtgcgtgtaaaaaatgagaaggtaaagttgggaaccttaagagacgaacacggttctagaactcttttcattggataaactttgacaaacaaactgtttaaagcgctgttaccaaagctagtcctcattttgaatgcatcattcttttcccaaattacatgtaaataaaacagagttcatgtggaaccctataaaatccttatattccaaaagcctagaagtagaatttaaggcaataccattccttcttccttcgactcttcacttctccagaagaggtcaactcttggcactctggcaatgtcttcaccacatctcagctcatcgaaccgttccacacaacagctacttgcgtaaatcccccatttgacataagcaaagactataaatccagcacgtaactgcgcgtaatcaacagcataataataaattaattgtaaccagttgtaggcattcataatcctaattggctcggataatgaagtatgacccattgagttacacattttaccttggttttttagcacattttttaatactaaactatacattttgtgagaaaattttctatataaaaattgttttaaaatattatataaattcattggtcaagtttaaaataattaaacctcaacatcagtgactcttattttatgcgttggtacttaatcttccgtccgtcataggttcgaatgtggcctatacattttcattgatccatgagatcttccatttcttatgaagttaaattaagggtgaatagccaattcaattttgaacttttgctcacggatcaaattagttcatggtgttttgtattgtccaaacaaatctctaaagattgtcatgtgactaaatatagccattggacacacttgacatgtcacatcattcatgcatgtacagtcaatatttaagggcctatttggactgatgttattttcaatcatatcattttttttataaagttaccaaaaaatgcctatatttagtttgttgccaaacttaatttggtaaacacgtaagaaatcatgacaaaattttggtaatattggcaacttgccaaaatgttatcagtaggtttattttggctacaatctgaacaaaccctaaatatccattttacccttacattttcttttaaaaaagagaaaaaaaagaaaaaacatgaagaaagcaatcataaaacaaaagaaaaataccacattctttagttaccaatgcaacatcttttttccaatggccaaatgcctttcttttactaattctttttatttatttcctacggagaatgtaagggtagctagatggatgtttcaaatgttgaatttgcatgcacgggtgatgcggcatgtagacgttgtatccaaggactatattaaataacataataaagtttagggacttatttggataatacgaaataccaaagactttatggatccttaagcgaaagtttaaggatcatgttgtttgttcacactttaattaataacactcattatttaatcaataaaaacaagaacaacaacaaccaaaaaaaaatcatcttgtaaaaagaaaatttccaaggctaccattcaaccagctgtccagattcaacttaaccctgtcctgtgagacgctctctaaccgccaaaacgaccagaccagtgtgtgcgcctcgccgttgacttgaccacgtgccatggcgggcgccgccgccgccgccgccgccaccccgccggaattcgtgtgcccgatctccggcgagctcatggccgacccggtgatcgtccccagcggcgagaccttcgagcgcggctgcgtcgaggcctgcgtggcgctgggcttcaccccggcggcgctgccactgtccgtggacctcgccgcctcgccgccaccggcgctcatcccgaacgccaacctcaggaaggccatctcctcctactgcgaccgcgtcggcttgccgcgtccgctcgccgtctcgccggaggaggcgaggggcattgtccgccacctcatggcgatgcgggagcctggtcgcgccgggggagtcaacggcgagcggttcgagtcgtcgtcgtcgtcctcgccggagttcgcggcgttggggttgaccttggaggaggctgttctggtgaggctgctcgacgacgagccgagccggcaggagggcgcgctggaggcgctgaagcagacgctgcgcggcggcgagaacggggtgaggcgcgcgctctgcacgccgcggctgctcgacgggctgcgccgcctgatggggtccggccacgagggcgtcagggtcagcgccgccgcgtgcgtggtcaacctctcgctggagccggcgaaccgggtgcagctggtgcgcgcggagctcgtgccggtgctcgtcgggctgctcgccgcggcgtccccggagctccgcgaccacgccgccggcgcggtgtacagcctctcgatcgaggagaggaaccggatcccgatcggcgtgctcggcgccgtcccgccgctgctgcgcctcctcgcgagcgccgccgacggcgaccgcgcgcggcgcgcgctggcatggcgctgtactacctctccctcgacgagatgaaccggtcgaggctcgcgaggtcggccggcgcggtggcggccctcgtcggcgccgcgggggacgccgcgctgcgccgcccgggcgctgatggtcatggccaactcccccggctgcggcaaggggagggaggcgctcatcgacgncggccggttgncggcggtggcggggctcatgcgccgcgccaccgtggcgccggggtccacggaggaggagtactgcctctcggcgctgcacgggatgagccgcggcaacgtccggttcggcgggctggcgcgcgccgcgggcgccggcgaggtgctccggcgcgtcgcggagggccccggcggcggggtgcggcgggacgtggcgtggcggacgctgcgcgccgtgggcggggtggccgccgccgccaccggcgagtctctgtacggcggcgaggacgccgccgccgccgcgccgtggatggacgacgtgagcgtcatgtcggaggccatggcgatgccgcagttcccgagacggctggtggagcacgcgcacgcgcacggggcgccgccgcggtcgaacaccacggcgctcgacaggctcaggcaagcgcccaacggctgacgtgtgggtcccagtgtcagtttcgtaccgtgctcgaacggtttgatctttttctcattttgcttaagaaatggtttgcttaaatttgtatatagtgtaaggaaattagattatttggtgatagtattgttgattccatatttcttgctaagcttgtatatacacatttccgttatgtgtgagaacaatttcttcgtatttatttacactgtatcatataccaatattgtcaggcatgtcccaaagtactggaatagacatattacatgtttcttttgctagtactatcttatcagatcaatggtcattgttggaataacaaattcagatcaattagagaagctcagtttccataaacaaacataataacgtttttattcaagatgaacaagatgtgttcacagtatgtaaatatgtacatagcatatataattaatttactgtttatctttacaacatacatataaacgtggtgcgtcgcttaggatgacttcagcaaggcccggttcctgcataaatcataattatgttaaaaaatggtttcttggcaatagatcagatgcacattgtaagttcatatctgcaagtttgttgtatactcacttctcatattcaaggtattcagtgggggatataggcttaggacccccaaaccaatcaatcaaaaatatgtttttgatttccaatttgaagatttggaaatgatgattctttggccaacctatcaaacagccatacatgaatgttgtcataaaataatcaccagttaatctcacattagtaaaagacacaaagaaatacttggatttaccctccatttcaggatgtttagtaaaaagtgcttctttggccaaatctgcttcagatgattgagggtcaatcaacttcaactgaaaacatgcaattcactggttccattacaacttagtaagtcaagaaatgatccaactatatcacatctatgtatggttcttatggctgagattaaatgaagtgcctatagcccctgctacttgcctacttcattgatctcacatgtcacaacagttttataaactataatttcttgatgaaatatcatctacataactttataaaccatgatttcttgaccatctgctgttttcttgctcacagtgaatccatgatagataatttgagaggggacggacacagttaggaacgtgggggaaaaaactataagacaatggagtatagttgttttgtctctcgatcatggttatcatattgtctactgagggtatctccacaacaactggaagactaggcgataacttggtcaccagtccacctagttgtgaagaaaacttgcaaagaacatgtaaaaattgagcctacaactacaatgccacaagctaaaccatccacaaggctccaaagttccaaaagcctgagctctcctgctgaagtctctcaacctctcatccccatgccaagaaattgaggcccaaaactataaagttgaaggcagacaaaacagtgataatgtttggttacgactcaagtccagcagtaagtattcactctacagcaatttataacttcaagctgaattaagtatgaattaataaaaagaaattaactactgtacattcttagaccagtcagcaccaagaaaaatagatataagaagataaccagatcagtcactaccaaagcaaaatagaaatagatagataaacagcaagtgaataatcatggtaccatggatgcaatttgtctgtacctttccagtaagagtaagttttgcacaagttgggttttcaggatcaatcttcccacatgtcccaagagggaactcgctaagggtaaaggaggtcctttcatcctccaatgcatctctcgcagtgggatctagcgttgtcagatagaagtaggggattccatggctctcacctggcactccatcactatatgaaactacattgctgtatgtacaggaagcagggaactaagttcagcaatcagaaagggtttgtaaccatgtgcgttggttgttttcaataccaaaacaagaaatattacccaaaaggagctccacttagatcacttgatattgtgctgcaaaaagaaattgcatatgtgagtgaacaatcagtggacatctagcagatacattattaaaagaaagtcaaaacaatatacaatagtgttttaaatagccaactgcactcgcgtaagtattttttgacagtgactgctacgctattgtagtatcatgtaaaaaccagcgaaggcagctatgacaactctgctaaatccactaaatgctgtaccgctactcaatcaattagtttttatcaatagttttattttgcctgcttaatttgaaatttgttttcttagaaatcaaagactatttagaatcttgaatatccttgttttcacctgaacaagtactaaaatattagttaagaaactttcatactttttatgacttttacaattaatttcaagtaatacatgacacatatgagtaacttatgctctaaataatatggggggaaaaagctatattgaccttgatgctaaaaccatagcttttcattactagataaaaatctgtctggtatatttgacctaatgatgtatgcagacattaaaacgtggccagaggtttccaacttcacaccaatttgaagaatattgtctatatttatttattttctttgcgaggaattttgatggaactgtaagttttcgttatccaattggcacagtaggacggcaatttagcaaaacacctattcaattgtaaatcatgacactgaatgtcacacaagtaagggaagagcaccaacaatttctcaatactaagcagcctcaggcgattagattactagccactaccaacacttggccgcgctaagaacccccaatttcgatcgagccacccattgtcatctcctaaagaaccgaggcatcaaccaatcagtccccccaaacagtaggggatcacgagcaagaagaaggcaaaggaattgggagggggacaacctgaggacgccccacgtgttctgggcggcgagccacctcgcggtggcggcggcctcggtgggggcgggcttgccgccggcggcggcgacgatggggcgggcggcgagggccggcagcggagggcggaaggcgaggaggagcgcggcgccgacggcgacgacgaggaggagggcggggggaagcatcaccggttttcttggtttggtttgtgtgctccgctcgatgggagactggaggaatcggaggatttttcccttcttcgtcaattgtgaattgtctcttccaaattttcttggttcttccggcggatagggttgttgtcgtctgaagcggcccggccggcgataggaacgtctcatagagatggaggagctgataagggtacagagaatcggagagagaaagactgattgatttgcaagcagtgtctttttgcttttggactttatagataaataaacatttcgaaaatagttgtatgtattttagaaacggacttgataaaaagatgtcgacactttttttggctgatctcagtcggttttgctatccgtctgatcgctaaacgtacgtataatatttacaagaaaaaccctccctcattttcagttacttttgaatggctcggattgatttaagattcatgcaactatagtgttttcaccttatactcttcttgacagaatgctcgttcactggatgtcgatgtcgcaacgtccgcctcccccgccctcaccggctggctagaaggcgccaacggcaccggcaagccccttcccctttcctcttctcctccttaagctagcggcagtaaagtgccccgtcccgccgtctttcctatctccgacagttccctatcattggttcccccaccatcgactatcgccttctaaccactcgcttcgctctggccctaccaccaacaccgacccaccgtgctcctccatccttgtggcttcggcaccaccgccgacgtctcaccacctgcccgtgtccactactcactatcgagccgctacctctcacggccatccctttaagcccggcgatctctccttctttctcatcccacccctaccccaacccaagacctcgtcactcgctagagcttcatcggagctagaggagaaggagttgggcacacgaatctccaagcaaatcggttggttcaaaatatatgagaaatatccctcgattttccgttaaataccatcggttggttcaaaatatatgagaaatatctctcgatttttcgttaaatgccatttagcaattacgtgtttagaaaacagttaataacctaggccttgtaacacttgggcatagcccaagattgggaaattaaagaccactatggacggaaagattgtggtaaattactcatgtatattaagcctactggaatatatcatttaccattgtgttagagagagaaatgtataatatttgcccatctcgtctgttatccgtttttgctatctcttctctcgtgtaagtgaaccatacctcctaattacattgaatcagagtaactgatgtatcaacaacatgttagtgagagcaaaacctttatgcaaagattagcggcaatgttggcggcatgataaaaatccaatgatttgatgaattctgtgagcaaaacacggtcgcatgtgcccatatggcaactaggctcctagtgtttgtccggatggatagccgggcaataagaggacattcttcacaactttcgatccatgtcttgctccatctagatcaagtggtggttcccatgctcttgaggaatggtgtagagtatcatgacgaagcttatcttccttggtgctaggaagatggaacatattacgaagctccagagtccggcaagatatatcaccgcatatcctattcttcatcgagtcacaacattggcaaatccaagcatgggagttcaaatctaatggcggggggctcatgatgaacagatcgaatgaacaccaaagagctcgaagccaagtagatcttgggacggtacaacttaccagcatctggcatacttcctccatgatcaccctgcccaccatcatgtgtagatgaaaaggaaagattggggaaagagagaaaatggaagaggaatatggggtttgtttgtagcaaaatatttcgatacaaatatctctctctaactcaatagaaaataatattttaatgggctcagtatgcacccaacaaattttcattatctttcagcaaatccaaaattttgcaatgtctaccggcaaaagccatgtcctgtaacaaatttttactatactaaagttcattgtaatgtttttgaatatgcataggcatattccacagaccggcctatagcttggctcaaagctaagggctcttctaagttctaaccctataggcttcttgttggtctttgcatgcttcaattcatttgatgagtggattatagtggtatctttggtaccgtatcatctgaccacattcagttcctaccgcctatggaagggttccagaaacccaaaactttagacttcagtccaactctctagctgctccaaaagccactcccatttcagctaaggagtactcttatagatttagggggtggttagatgcaggggtgtaaaattttagcgtgtcacctcatgtattatatagggtgtcgcaaagggtgttcgggcactaataaaaaaactaattacagaatccgtcagtaaaccgcgagacgaattaattattaagcctaaataatctgtcattagcaaatatttaccgtagcaccacgttgttaaatcatagagtaaataggcttaaaagattcgtttcgcaaattagtcacaatctgtgtaattagttattttttagcctatatttaatacttcatgcaggtgttcaaatgttcgatatgacagggtgaaaaattttggggtgggatctaaacagggcctcaagtctaggtataaccatataagctagtccttgtttagttccaaactttttcttcaaacttccaactttttcatcacatcaaaacttttctacacacacaaactttcaacttttccattacatcgttctaatttcaaacaaattttcaattttggcgtgaactaaacacaccctagtccattcaagctgaccctaacctagctaaatcttcatttaattagatgtaagaaataagcgaatacacacctttgtacacacacatcgtacttgctttgatcgagggtgtaaaatgtattttttttcgttgtgcatgatcaactgattgttgccgctgatgagatgaggacgatctgtttgttgcaggtgaacgtcttctgcatcaagaagggaggacactgctttttttcccccgaaacttgttagtagctttcttggcaccttcatatcattcttgttttcctttgagttgatcattgtaatattttgattcttccttcacggaacatcattcaattctttttgatgattctgaatatgtttgccagaatgtataagttctattatgcatttccttttgtgatttctgtgaggttgtgacaagcacggtgggcgagctgttgacatccgccagtgtgccatttctttcttttatgtctcaataatccacatctataacctatcggtttataacttgtaaacggaatatttccccctaatatttcacatctataatagtttataattgtgaacctattataaaaccaacaccgaaatagacattggcaatcaaacgcaaaaatacactaagatccaaacgtggtggcgacatcgtgccatgatatttaactaaagttcagctggaacctatatccccgagacactaattataggcgctcctccctaatccaacataattacacatataagggtatcaacaaccattaactggcaattatactgtttgacttacaacactattggtcaatcattccctcatttgctacagtcgtcatgcggttataacaagtgtctctctatttaaagagagtttaggaagagtattactctacttctattagaatacaatacaactttaatcctaatttgtaaccgactttatatatatatttgacacaaactttaacaaaaccgttagagatcaatggatctgtaacgggtcatgaaccattatggatgatatatcccatgccagtgacacaaatactgtaatgggtaaaaggaaccattattgatgatgcttttcacctattagtgataaggtactctgtagtagtgcctagtaggagagctttctatagcatgaaaaacaaattctgttacaaaggactacagctacagttcgatagcaaagcagcgtattacagaaccacgactgataaaagcaacagcagtagccgagaaaagctaagagattttcacaaaacctcaactggggtacaaagcaattaggtcaccatgttggatcacacacccgtgccagctgcaaaattctatactactaggagtgacattttcaatctccacaaagaaaaatgcgagaacaacttcaaggacagagaacacggtcatgagaaaaccgagggatacataaacaagaaagatagctgcagctattactttcagtatgtcctgccagaaatgcagatgattgcccctccacaactgcattggaagccgccaacatatcgggattgctaagattgacaaaacgaaaatcacccgaccaaacatcagaagaaatacgaacacaccgacggtaatactgaaaatagatcgtcccagctgttgccagagtccaatgttagatcagttgttaccaccagaaatgtaagaaccatgcccacaactgctaggaaaaccagtccagcagacaaagaaagataacggcggcggcgccttgtcaggcctccatctccaccaagagcaagagaagatacagaagagatgatacaagaaggagcagaagaggaagaggtgctggagcctgacgacaaggaagcagatgcccaggaacaaggaggaaaaccagacttcaagaccaagaagaagcaagtaccagtccagcttgggccaagagcaaggaggcccaatccacgctacaagggtgaccaatgggtccagtaaacaaccagctggcatgagctgtctgagagagagagagatcagccgaaactatgtaatataaacgcaaacgaagaacaagtagaaggcggctaagaactggaatatgcgcggtggcgtaggcggcggcggctcgatccttcggggttgagaaatcttgtatgtgcaattcgtgattaattccagttcctgagagataatcgttgggagttcctaacaatctggtatcagagcgcaaatttgagccactcttcctacaatctctcggttcggctgtaaaattccagttcaaggattggaatccgtctcttcggaggtggaatttccgcgaaaaggcaacttgccttgactggttagctgaatttggagcgggaatttgaggggcaagtgagagagtgtgtagcgccatggatatagaaggaaagttcgatgtactcctgaagaccatagctgagaatgagaagaagaggatggcggcggaagatcggacccgagaagatctgatggaactcaaggcgatggtggaggggcgccttccccaggtagagaagcgggtggaggatctgaactctgccctgggaaagctgaactccaaggtcgagcatttggagaagcagctgccgcgcgtgatgaacacgaacgaagaggtggcggctgcgtccgcagggttcaggactccggcttctgcccagggtacgcatgaatctcctcctgactccgctgctcctttcagctttgattcgtctgcgcaacacagtactttctctgcaatgtccactggagtttgtggtagtgttcctccgatgacttgtccgcagttcaacggtgataatccccagatgtggcgagcaaattgtgaagtttattttgacatctatggagttttaccgcagaattgggtaaaagtggctactctgaatttttgtggtaatgcggcattctggcttcaatctgtgaggaatcaactgattggtattactttgtctgatttgtgcgagaaggtgtgtgcaagattttcgcgtgatagacaacaggccttaatccgacagtggattcatctgaaacaagggggatcagttggagagtatgtagagcgttttgattgtgtaatgcattagttactggcttatgagcaagctgttccgccgatttacttcgttacaaaattcatggaaggtcttagagatgatattagatccatggttctgatgcaaaggcccaagacttggacactgcgtgttctttagctctacttcaggaagaaactgctgctgaatcaaaaccaaatagtttcaagagatctgatagtggaacttatttgaaatccccacccagaagtgctactcctcccatttctcctaactcatacagatccagtcccagccaatcccctgaagacaagagaaacattgaatcacctagagtgagagaagataggatatcagccctgaaagcttacagaagatctaagggattgtgttttacctgtggagagagatggagtagagatcacaagtgtgctactacaatacagttacatgtggttgaggaactattggaagcaattcaggctgatcctgagattatttcaaatcaaagcagtgttcctgagggagatgaagatacacttatgtccatatcttcacaagcattacatggttctgaatcttctaagtctatcaagttaagaggatgggtgcaaaacagagaacttttaatgcttgtggattctggcagcacacactcttttattgatgagcaaaaaggtcaacacatgagaggcttgcaagctcttcagtctcctttgaaagtgcaagtagcagatggtggccagattccttgttccaggattataccacagtgtagctggtggactcagggacacagttttaagactgatttcagacttttacctttgggttcatatgatgtgatattgggcatggattggttggacagcatagtcctatgcaaatcaattggtcccataaatggttagaattctagtataaccagcagctcaccaggttcagggactgattcctcagttggatcagtgtgatactatatctgtccaccaattgcaaggtatggctaaaactgattcaatagaatgtatggtgcaactcattcaaactgctgaacaagaaactagtgaagtcctgctgaggttcagcccctgctacaagaatttcaagacctcttcactgaacccactggcttacctcctaaaagaacttgtgaccatcacataccacttattccaggagctaaaccagtgaacttaagaccatacaggtacaaacctgcacttaaaaatgagattgaacgacaggtggcggagatgctgaaatcaggagtgatccaacctagtcagagccccttttcatcacctgctctcttagttaagaagaaagatggctcctggcgcttatgcattgactacaggcagctgaatgctgtcacagtgaagagtaaataccctgtcccaattattgaggaattactggatgaactggctggctccaaatggttttccaaattggacttaagagcagggtatcatcagataaggatggctgagggggaagaatttaaaacagcgtttcaaacacactcaggtcattatgaatttaaagtcatgtcatttggactaacaggagctcctgccacatttttgggtgcaatgaatacaaccttggccactgtattgaggaaatttgtgctggtattctttgatgacatcctcatctacagtccaaccctcacagcacatctggagcatttgagacaagtacttcagctgctatctgaacacaactgaaggtgaaattgtccaaatgtcttttgcacaacaagagatatcctatctaggtcacatcattggttctgaggggtttccactgatcctaagaagatacaagatgtggttaactgggctgtacccaatactgtcaaaaaactaaggggatttctggggttagcagcatacta

SEQ ID NO: 46721 - DNA, 5129 bp, Oryza sativa
  unsure (1)..(5129): unsure at all n locations
aagaggagtttcagggaatttcaagtgggtgattgggtttacctcaaacttcaacctatgtccaaacatcagtttctactagagccaacaccacaagttatcttttcgttattttggaccttttcaaatctctgccagagtgggctcagtagcttataaactgcaactacctgcttcctgtcacatacatccagtattccatgtctcacaattgaaagcagcccagggattctctcatccagtgcactctaatcaacctcctgatctgaatcattttcagattcctcaccagtttattgattatagagtgactaaaagaggtaacactcccattactcaattgctaactcaatggacaggttgtgatgcttctgcagctacatgggaggacatggaggacttgcagtcaagatttcctcaggcaccggcttgggggcaagccggtttccaagaatgggggcttgtcaggcctccatctccaccaagagcaagagaagatacagaagagatgatacaagaaggagcagaagaggaagaggtgctggagcctgacgacaaggaagcagatgcccaggaacaaggaggaaaaccagacttcaagaccaagaagaagcaagtaccagtccagcttgggccaagagcaaggaggcccaatccacgctacaagggtgaccaatgggtccagtaaacaaccagctggcatgagctgtctgagagagagagagatcaaccgaaactatgtaatataaacccaaacgaagaacaagtagaaggcggctaaaaactggaatatgcgcgggggcgtaggcggcggcggctcgatccttcggggttgagaaatcttgtatgcgcaattcgtgattaattccagttcctgagagataatcgttgggagttcctaacacgcctatttgttagactgtcatgcacaagcagacatgtcgcaaatgtggagcaatagaacgacatgctatttgcagccacgtagctcgagaattcagcatattctttgagcaatggcatgccagcatcctcaccgtctgcaatgtatcccccaggaggagtgaaagcagcagcaaatgaacctgctgcgattagtacggagatacataagatactttgggacacattggtgtaaacgcttgattcctccttgtcttccaagaacctcttatcagctcgatttaggaatctgctggtataagcattacaagcttgtaggcacatggtgatgctggtactagagagctgcacagaattcagaagagaacaaaaattaacacaaaattaaggtgatacagaatgttgaaagagcagaatgcatgacataggaaacgtacccatgataatgaataataacgagtgctcttgttgaaggcaacatctagaggtgttgatcccccatggttaataatgctgagattcactctagtattcatcataagacaggagatgataattgcattgccatgctttacagctagatggagcggtgtgtttccttcacaatctcctgcattcaacaacctcgtgaactttgggtttctgcatatgtaccacaccaccattaaccttccatattcaacagcgcagtgtaaaacatttctctgtttgttgtcaagcaactcatcacagtttaaacacatttccatcaacatacgggtaacactggccttgccggctatagcagcaacatgcacaggaaataggccatcattatctggaatgtatgcagctgaactgttgtccagtagaagttcgaccaatccagtttccccagttaatacagcatagtgaagggcagttcttccatcgatgtcaaccttttcggcaagtgttggctcccagcgcctcagggactcgctcatttctctagtggaaaaagaagtaatataggttatcagttcactaactaaagctgtgttcgggagttagggttgggaaccctcactccccagcacggaaaacggagcagtgattagcgcgcgattaattaagtatttgttaatttttttttcaaaaatagattaatatgattttttttaagcaactttcgtatagaaactttttgcaaaaaatataccgtttacagtttgaaaagcgtgcgcgcggaaaacgagggtgggagttgtgaacccctgctaaagaatgcagcctaagacaagtaaaaacacaatcaattttctgtatctccagatatgcaaaaacatatatacatagttattttgtactactccactacttaggacatatacgatgaccattattagtacgctcttagccttgcaaattatgaatatttgccgacatggaagagataaaaaagagtagatatagaacatcgttgctatgattaacaacggctcaacattgattcttaccctctataaagtgagaacatggcataacggtgaagaaaaggaataaatagtattaaatagtatttttaagttgatggttagagcctttatcgtcttaacagtataaacggtccgtaaataatatttgtattgtctaagagctcatactagactctaccactgaagcatatcccaactttcgcaaaagcttctccaccagggagatggagttgagaacggcaaaagttatggattgtaaggaacatggacgatttctagttacctttaccgatgtagaccgcagcgtgcaacgcggtttttccatctggccccgcgtagcttgctggcgacctcacaccgtcagaagattttccgatcaatatgccaaccatatctggccggttggacacaaccgccaagtacagcggtggccagtccgctatcgctcgacatcagcttctgcaagaccggtgcgtagccgttcctgaccgcctcatgcatcgcggtcgctccacctgaattccatgccctcagcacagaacgttcaggttcttgcatggctgaagcagcacggacaaggtaatcgaccacatcggcatggccagccctcgcggcacagatcagaggtgtgtccagctgattgttcctcgacttgatgagcgagatgtcgtgagtacatatcatcacgacgagcttcaggtgcccacggctggctgcgatatggagcacagagctgccctctgctgtgacaccttttaggcagcagctctgatcaacgtcaccttgctcagctgttgctgttggccatatgcctagagcctgcgctaagaggtctgcatcgccggtggcaacagctttgagcaatttgtgttccattgtgtgtgaagtgtgcctccctgccatggttcttgcttggctcacagaacaagcgaggcacggggaagtcaagtcagctcttgcaggtaagttccagcccatatataatacagggtcccctgctatcctatcaactgtttctctgttcagacaatatctatgtactagtggagaaagaaaagtattagcttagtcacttgcattcgtaccttggaacctttcctatgaacctcctgttttgttagtattataatcatcatcatttttttaaatgtaacaggaagggttgacccctactgattatattatggtcagagaaaaggactatattatggttaaagaaaaggatatttatgtacaaattaatttgctaggcttcagttgcctgattttagttatctgttcaatcaatgcaaagcagccgtccgttctcgatcctatggttggtgcttcatctttgggcaggtctaatgcatgggtcgcacgggacccacgcgaatgcggctaggcacacatgcacgagggtctaagggggaatccaaatcccaaaaaggcactctagaatgaggttcaaaacacaatctacctttatattttttacatctttaaatgtgttttctgaataatctgaagcgtatatctttttaacaaatcatgaagagaacaacccatcctcctacaataatgatcagctccttgagtactgataccatgctttatccaatcaaatcatactttcatgaaaacgtgaatatatttttttaaagaaaaactaaaattgttagtgatagaataacacatgatattgtaattaacatgcaacaactaatgtgatggctcctatgagaaaactcatctaaaagaagggttataaacaatcacgatgatagttattaaagacatatcttcccattgattacataaaaaataatgatggtaaaagagaacgtagtaatatttctactaatcgacagatcagttggcaaactgcagaagcactaaaaaatttgctcactttagatgccattaactggacctgttcagctcctatatggactggatgcaattggactttgtagttccatttagttttatttctgaacatcatcctcagaatagccatcaaccagtaacagtaaccatcaccgtgcaagcttgagcaccgacgttgtgccctagcactggagtactgaccccttcatctataagaaaagtatcttatcaggtcaaatgtgcaatgaaaatgctagattagaggaatgcacaggcaagagcaccttccctataactttgttgcagaagggcgtattgttgttgctggtacaagaccaaattctgcaacagcagatccagcggtggctgcttctcaattggcattcacctctgtcagtgctgccatcatgatcgtcagagagatcgcccctgagcaccagtgggcatttcctgtgaggataatgagagggaagggagtgaccgcggagcgttcaatgcatatatccgtttgcaaactgaagtatcttctgaagaatttcatcccccgtggcttcttctgaagccaatatactctcagtagcttattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46722 - DNA, 16072 bp, Oryza sativa
cgtgagctgcgccatcgcatcgacctcaaggtataatattattccagcaggagtaatttggttcatgtcatcttcatttgacaggatttgtttcttattgataaaactaaacaaatttcaatgttccttttgctgtttgcatctccagtgtcttcaatagtcttggtcttatgttcgtgacacatcaacaaagcactgctttgttctttgtccttttatttatggcattggcatgaatgtgattataaacttacaatccttcatcttggtaaataaaacaacatttatagtgatttccccatcgactatgccatgcaatatatgctgcataacattcatgtaccaactcatgctgataaaatggtgacaattcgatgttagaaggtatacccaaggaacagacatgcatttgggctgcttgcttggactggcaatgatgttctgaatcgacggtatgcatttgagctctttagtcatacacgttatcatgatcaggaatgcaagaccacagcttttttttacaagtttcgtaattgaaacatgcagattaagaatactagcagattccaaaggctacattcttgacgacactggtttgtatcttgctacaccggcagtggtggaaagcgtgtatgtacatgtgatttttcattccaaatccatacaagttgtttgctttgctccattcattgtgagtttttgcaggggggaagatcagatgctataattaattgtgacaccgagaaggatgtgttcgatacacttggattcccctggttggaacctcacgaacgtaatctctagcctttgtcgaaacccttctgtagaaaatgcagtttgctagagctatataccttttgtatttcccctactttctattgccagtaggctggctgtttccaaacctgtctgtagaaattaggaaaaatgtagatgtagtttgctagatttttatagttttgttttctcgtactgcagaaaagcagagttgtttttgtctttgacacttgccgcaatggtcaaactctcttttgctggcatgtactaactgcagacaacagtatatatataactctgttgtaaatccatttcttatgacctctcagacatcacaatggtttgcaaagatcataagcagagtttgcaccgcagttgtgtctatttttcagtcaaatcaagattatttctaaattcaacaatgcaaggcctcacaaactatcaagcaaccatgcatgataacacaacggcaaaaaaagaagtgatgttaaaccatatcccatcggggcaacaatgaacacaaaacatacaagaattcaggcataatgtggttcatcttgaatgttcttgtgaaatttgacaggtcaaaaggcatttcttaacctgttacactgagataataatcacaatcctaaaactctcctttctcttgacattgcctatccaagttccgcatgcagactaatgataatgctgcatcccggacactagtagtggtgtcaaatttgtaggcataaacactcaaaagtcaagaaaaccctttagtccataagtagtaccctacatggatgtgatcatgtgaagattatttacatctctctgtgcctaaacctacaactggaactaagaagtggaactagggcagcaaaaactgtgatcatcagaagctattgctgggaccacctccaagcatctcctccctgtcgatgaagcgctcaagaagctccttgttcttggtaacgatgcattcatcatccttgccaaaccaatcgtagcgattctttgcaatgtaatcgtagattgcatcccgcagtggggcggggatgatcagcagggagctcaaagctgagtagggaagaggcaggtacgatgcaactttcaaagcagctgcaaccaaaacatggaagatttagtaccctgattaccacaggaaataagggtgggcaaatatgacatgattaaacagcaaaaagtacataaagaattgctgtttattttttttccctaaatgagtatcattaaaaggatccttcagttagtactttcgatcttccagttagtgctgctatatggacagtacaaccatatctataatctatgtattctgccagattaattggtgtctcagggaatgattgagctacattatgaaaggaactgtggcctctagaaatttgtacttttttgcaggagcacagcaatggctatcattgcaataacttggttgaacaaatgcatgatccaaaaaaaaaatactagagtgtaaagcatgttgctctcatgcattactggtaaataagggggcacacctatctatcacaaacctagcaaatgttgaatcctgcatttgacacaactcataaacaccagaaagaagttcagaggtgatcccattcagaaaatcaaagccataaccacagacactagatggtactgaaaatcacccaaagcatttatcaagtggcctctaaactccaatgccctccatgatggcattcttgcagaaaatgacaaagaaatccactgcatttcccaacgaattttgcctcatgccatgcaaaattgctacaaattcaaacaaggtatgcaaatccagcgagtacagggtactaactatcactcactggtatccatccaccaatggttgcaaatttttctaccactcttagatccccagcattgctaatctactagtccgttgatacagagcaagtttaatagtatagcccactactagctctaaatcatctatagccaatgtaatagccaattcatacaatagttgcttattacactattaatatctggtcccacctgtcatacacacattacgttttggagttcgtgctgtagctggttacagatctatagcccgctgttcttctctatcttcatttatctctttaaaatatatttatagctggcatatagtatgctattgtacctgctctaacaagtagccaacatgttcttggaaagatcacaacattgccccgatttccgaatcatcagagatgcaatgctaacctgtggatccctcgtagtaggcctcaggcccctcgatgaagaggactcgccgcagcacgtcctccctgtccatcccgaccagtctcaggtacggctccgcggccttggactgcacgcagcagaacctgatcttggcgtgcttgtccgccttgatcacccacttcacccctgcaatgcaaagccccaaaccgcatttcgatcacaaccaaatgcccccaattcgtcgccgattcgaggtagaaatgagtccccccacaattgggggcctgtacatgtgctcaccgcggtggcagaggtggcagacgccgtcgtagatgagcacgcgcggctgcaggacggtgggcgcagtggccgcgatggagacggtggcggcggcggaggcggaggacgcggtgcgcggcgggggctcctcgtcgccgacgacgacgaggtcggcggccgcgcggggcgcgtagccgcggaggcccgcggcagcgaggagggggcggacgcggccggcgagggttcgggtgagcattctctctctctctccgccgcggcggcggcgcggcgaggcggtggttctacacacaacacgcgggtgttggtttccttttgcttgaccgctcactctctccaatttattttggacattaaaagggccttctggcttggagggtaagtaaaaaaaaagttttatttttccatttgtgcttgtgtagttgccaaagattatgtgtgcttatttttaaagaattatgctcatctgcaaaaaaaatggtgcattttaattaaaccctaataaaattgatttgctattacaacaactataaaaaaggggttcaatttactccatcacggtattttctctccatatgtaagttgtatttcacactgaaatttgattggatgatagatgggtaacaatttacaacttatgtcttattatccttttagaatattttttataggtgtttacataggttggaaatacctaagattaattttgaactttgagattttaaagttcaagtaaacgatcatgaaaaaagttgcaaatattatttgaactttgatagtggtgtctctatggtttaaaaaatttcaggtataaagagaaagaaaaagaagaaaaaaatgctattagtgagtacagtgaatcattttcaatagtttagagacaaaatgaaccaaaaagtacttaggggtaaattagaaaaatattttagtggttaagtgatccaaatgaaatacttcgagcgagtaagattgattttttctcctttttgttttccaaaatagatatcataaccaatttagtgggattttccttggtcttaccactcggccctgcacctttagaattctaaaaggcacatttttttttgtcaaaatttgaataataaaacttaattttagagttaatttaaagatttttcatcgtattttttaaacattaacgtttaagttgttattagttttaaccgtaaattatttttaatcgataatatgttgtttggcgcattatccgtaattggccaaccgatgaaagcctgagaatgaaagtatatactaacatttatattaaaattatttttcattgctttcatcactaatgcttcgttcgttttttattaacttttgcaactccattcaccgtgagcatgctttctaaacatcaattgaatggtgcttttttttacagaattattttatatataagtttttttaaataattcaaataaaaccatttttttaattttgtaatagttaaaacttaattaatcactactccctctgtttcatattataagtcgcttttgatttattttctcatttcgtaagtttaaccaagtttatagaaaaatatagtaatattttcaacccaaaagttttatatgatcacaatatatttacattcaatgttacatttattgaaagtaaatttaaagttatagatattgttaattttttttgaacctaaaaaagtttaattatacaaaagacaaatcaacttataatacgaaacgaaagtagctaataacatgtctcagtttcatgtgcaagaaaacagctcagtacaaccgagtatatgtcccttttcaagtcacattcaaaatattgtaaaatattggggattctaaaaagttaaaaggcagttcagattgtaatcaaattaaaccttatcaaattttgtcattggcaacttagtaatattgccaagttttaacatgatttcttatgtatttattaaagtttggaactccctccgtcccattttatgtgcaaccatgattttccgcgctcaactttgaccgtccgttttatttgattttttttcaaaaaaattttaaaacataagtcacgagtaaagtactatttatgttttattatcacataacaacaaaaatactaattataaaaaaattcaaataagacggacaatcaagtttgtgcggggaaacttatggttacatttaaaatgggacggaaggagtaaaaactaagggcttatttggttctctaccctacctatttattggtagtgccaaaatctaggcaaattttggcactaccaattttttggtagggaaaagttaattagactacttttggtttaataccaatatggagccaaattttagtagtatggtgaagaatattctagaatatgtccaaattgagtatgggcactatcaattgtttggcttcaaaccaaactagcatatttactatttaaattaccaaaattttggtagggcacagttttagcttcaatccaaaacggtcctaaatagatgcacatctttaacgacatttcttaaaaaaaattggtatagtttaaaatgacatcaatctgaacaatccatagaaacatcactagcctaatgctgtatagagaccatgatccatggagtagttttttctgaaaaaaaaatgtttttttcatttttttatcacatctccttccagattttgttcctttccaaacggtgaaacggtagaacccaaaacctcaactccaggagcttccagctccagctcacccctcctctttcacgataagaggcacccagacgaacacctaagctacgcgcgcgatgctcccatgggcgccgccgccggcgacggcggccaccacctccccggcctcgtcggctccgctcctccgcgccatgccccggcgcgcgcgctctccgcgcctcccaccgcccccgcaccacccttcccctcctccgccgccgcttctctcggttggccccggggcggcgccgcgcgccgcgcgcccttcccacggcgacgtgttctgggaggagccggacgacggcggctccgggagcgacgacgaggatggggatggggcagaggccgaggccgagcggcaggaggccaccgggcggaggagcagcttctcctcgttcccttccccctcgctgttctccaggctcggcgccgcgcggcggcaagagcagcgagaagaagaggagcttcgaggaggtattggttcatctgctgcatgcgctagacaaatcaaattttcttttttcatttttcagtttcttgatcagctgaattgaaatgcttcatgttctacacttaattctgtcgaatttttctgtctagaaatcgagcttctcttgacgcctgaagaaatggctatcctggatcagaacgagaccccggatatcaccaaaatatcatcagtaagtgtcactctgtaaatgtctgacagatattatattttggtgtgtcataaatttgttacattgctacagaatcttgattaaggaaatgtgcacaccattgatattttaactgttcccaattcctgaaattggactgttttgtgcagccgaaatggcatccacttcatagttacgcattggcgctgcagatacctctcatggacagcctgctcgatagtggtgtcgatatcaatttacttgacaaagtatgttctttctacataacatgttgaggaagcatgtttcatgctcatgattttctattttggtgcctgtgaaaaaccccatcttggattatgcctgtgaaaagcttttgcgcattcacgaaaaagaaaaccgtgttaattttgggagtgctgatgatacaggatggtttcaccccacttcacaaggctgtcataggcaaaaaggaggccgtcattagccatctcctgcgaagaggggcaaatcctcatgtcagagatagggtaaccttgcaaggctgcaatctctttctatgaattatgtgttccataataacattagtatgtggaatatagtaaactttgtgatgttagcgcctatcacattgatctggtttctctctctagcaacataagtacataacaatttccactccagtttgagatattttttatgtcatgttggcccttgaattaaatctgtctgatttgcaggatggagccacaccattacattatgcagttcaagttggtgccctgcaaactgtgaagttactgattaagaatagggttgatgtcaatgttgctgataatgtaatgtgctatggtgcttttttttttcttattagttcaacccttttcagtgccattgatttttcttttattttgtctcgtttcatgcaggatggctggacaccgttgcatttagctatacagagtagaaatagagatatagcaaagatattgcttgtcaatggtgcagataagacgagaagaaccaaggtatgttatgcccctatggtttactgggtttttttttccggaattgcattatcccaaaaaattagacctataacagctgcctcttgtgcactcagagccttgattttatttggcaaattggcatacattttcatgtcatttttagccgcttcacagaaattgacttctatggcattgtcatctcaaatgctcgtatttccatggacatcagctttgtattacagtctataggccaatactgctttctgatctcagatttggttacaggatggaaggactgccttggatataagcttgtgttttggaagagatttcaagtcttatgatttggcaaagcttgtcaaacttgttccggcaaatagaaaaatgtgactcagctctgtcacaagaatcagagaaaaaaaaaagatttagatgttagcaactgttgatttgggtcattcctcctattgtttttaatgggatgattcctccaatttgctatagttgcttgttcaatccatttttagaacctgtttattttagagaagttgtctaatcctgattcatgatcaacttatgtaaaggggttcgaaaaagctaatgccacaatggaagaaatagccaaatttagatgatctttttcttatttgcaaaccgaggttcctcagaggcgttattttaaacgtttgatgtgttaccgttcggctatgtgaatacaaagctggctaagcaaacaggacacctccataaaatgatctcactgagattgcataacagtcgttttgtaattggattaataaaagaagtaaggatcaccacatacataagcgagcgttaattataaatatatttttttcatatcgaagccaagttttaaacctcagatgatttcatttggcgtttagaaagagttgagaaatgcacctgtctaggcaatgaaacagaatgggattgcacataaacctcaaattttctgaacatgcaattatcacacgactagctacagtaagggcgcatgtttctacagctacagataagacacatgtttctacagtaattcatggggtttggcaacatgtcactgcaaacttccaaacagagcatgtaaggtagacaaacatttcacacatcattactatggtatgagtaactagtacaccttaaacagcaaaattcatgcaacataaatttgtagagatgacacaaaatccatacaataggtgcaatggcactgcaggctagtaaattcaagagttgcctactcttgcaaggagatgcgtctaaagatggcctggaaagtctgacctccatttcttgcaaccttctgaccttcttcagtggcggtagacagtagcttgacaactgggtctgcttttgtctcttcctctgggatagcttcgaacagcgggtgtttctccaggcatgaccgcatccattctccgagctcctccacatctgtgattgtatatatgattcctcccacttccatcacataagcatactcatctagcagctgcatgctgatcaccctccgccggtggttcttctccttgaagtgaggatcagggaacaggaagaacattttcgaaagctgagccttcctgaaatagtttggaatgtatttcatcgaattggtgcgcacgacagatatgttgtcgtactttcccggattcgatgctcttaaagccaaaatccgctctttgacatactcagtcacctgaaaaatatagacaacgaagaaaaaaatgaatcaaaagtaaatacgtactagctttgaaaagaaaaaacttccagttcttttgttaagtagaaatacatgtctattgcataatataataccatcacaaactaaactatgcaacttttgtctagtagaaatccatatttactatagaatctaaattggaaggcaacccaaattcccaatatttggtacactaaacattcatgaagtaaaagccatgcgcgatctaatcattctacaaaggaaagctcaaatggtctctatgagtaatgtaacactgaattcttcagtgtcaccttgtgctgttatccattcacacatgaatgtatctctactgcccaatcaaagtttagggggaaattctaacaaaccttgtccctgagctccatgccgatcatgagggtgtccgggaagagcgtagagaggccgacgagcagcccgccgaacccacacccaacgtccgcgaagcggatccgtggcaccgccgcgtcgccctggcgggcctcgccctcgccggaggggaagtaccgcgggtagtgctgcgagaggtctacctcgtcgggcgatatcgggatcgggaagtgcgagtcgctgagcgggttgctgtgcgcgcgcgcccggtagaaccgcttccgcgggagcttcccctgcccgccaccgccaccgccgttcgcgccgtcgccgctcgccatcgcgccgccgtccccgcctgcagctgcttcttggtctgggagaggcattacgccgaacacccggtgagcatgtcactcgacgcgagcggtgttgtgggagagggaagcgggagaggggtggggagggagtacgaaccggagagagagagagccctcgcgagtcgggagagcgggggattcgccggaccggtcggcggcggcggcgtcgtgggcggaagctggcttggcagcgagtctcgagccgcgcgggttagggcttggatgttggagagggaaatggaacgaggcgggggaaatggattgggccgcgcgagttggtttaggccctaagctgcagcccagcagcgacgagatgggccaagtgccgcgaaggccccgagcacaccgggtgttcggcgtaaggaaaaagttcagctgaggtcccttatgccttatcttgttatcgtttttaaaattattatccctgaatagcagatataacacatcccgaattttacaaaaccggatcacattggatcccgaggcagtattgcttctggttttgtacaaataggaagtactccctgtgtgtttttcttggttttgtcctttatcaaactatgcaaattttaccaaatctattaaaactgcgataatattacaatatcaaattattttatttaattctaccattcaatataattttttagaatatttttgtttagtaaacttgattaaacttgataatgtttgatttatgacaaaaccagaacacctgatattttaaaacggagatagtatatcactacgttagtcatcataaatacgtctgtaatgtcgcatgatttttttattatatcttggttgatgttaaaagtgataatcagaatgagttttgcaagagcacaaaaaagtggaattggtgaaaaattgcggctgcatgcgaagctatatagatgtagcagcatgcaagttgtctacttgtctgcgtataaatctaccgcttcaaatcaaataatgatgctcgtcatagtattatcatttcttcagaagaatatcttcggctattactccctccgtttctaaatatttggcaccattaactttttagtacatatttaaccattcgtcttatctatatgtatacatatacgtacatttaaaaatgaatcaaatgataggaaaagaattaataattactaattttttttaataagatgaatagtcaaacatattttaaaaagtcaatagcgttaaatatttagaaacaacggagggagtattattcacaggagcatatctctggccacatatatttctttacaggctttagcagtgaagattaatgcatggctagctagctagctactccctccatccataaatataaaggattttggttggatgtgatatatcataatacaacgaatctagacaggagcggttggatgtgacatattctaatacagctcctgtccaaattcattgtatcaggatatgccacattcaagcaaaattgcttatatttagagagagacatagggagtagttcgttggctctgcagactgcagcagtgtcagctcgtgatatactcctccccagtgtgttgaatattggggctgtcagtaaaaacttgagcacagaaaagggaccttactaaaaatggagcatacaacggtaaagttcacccgttgtggaaagttcccaaacgttgtttccataggagtcgggccgtgtttcaacaccgctgataattcaagtttagccagtcaatttcgtccttttaataaaaccagtaatcatgcacgtgcaatacatgttctttccatcataacatgtttcgactaaattttacaatttatcagcatgagcccttaaaaatattggcggttcatcttgagaaataaagcaacacttcaatgtgtaaaaatacccactattatacactggaatccatgtagctaagaaataaatctatttaaacagaagtgaaacaagcatcatttctattttcatgcaaacataaatgaacaaacaaccaattcgtgcacataggaatccatgtagaatattaattgagaaaacacactcattcttacaatctaatttgaagaggaggtatatattataaatccacactcacattattatcctttcatcacaacaataccatatagatacacccccaagtgttgcacataattttgttaaaacttgagtgccccgggccatacctggaggaccacctcaacaaatccacaatggatttagccatgcagaatcgatcatccaaaaacaaattcctaatacatgaataaagataggtcacaagttttagctgagaaaaatatcacacatatacaattgtacaaataaaaagttatatctgcaatcgtaccagcagacctgtaaaggcacctcaactctaatgctaacatatttgtttccatttggcagtggaactgatcatctgcacagtcagaagaaaaagaacataacagtagatttgtcaggatcaatggacgtgcaaaaattcaccgtataaatgttcaatgggtgaattaacaatgaaaactttgatgtcaggtcacaactctaggatcccacttacagaacaaccaagatttttcaagaaatttatttctgcttcaatctgcagtttccgtttaaccaatcatgaggcaagtatgccaaaattttagtggtttttcctaacaatattgcctataaactataattacttcactaatcctgaacctatttcgataaaagaaaacctagaaaatccactttgcagtttgcaccacgtcgagcattctcattctcattgaaacaaaataatagatatttttgtgtcattccaccaatcatatagatcatctcctccaaaactaatttgtgaactatgggaatttgtccatacatattttagatcattaaagcatctgatagtacatcacattgtattcctaattctgtaagcaagatatttgcacgcaggatgtttttttagagaaaaggtcgaagaacgaccctgcttatatagaaagcaaatttgtcttgctggggattccagcttacatcaatgtgcatacatcgaccaaaagaggcccctccggcctagagaaacaaccaatttttagacagcagggacaacacaagacccataagtgaagatacagcaggcgcatcgattcaaaaagctttccaaaacacctccacaaagtaacagacagcaaaaaaaactctaactaacccaccccagttctgatattttgcagtccagcacagcattccttcagtcttcttgtcagcaactccagttcatcagtctccacacctttgaaaagtggtttccactgcttgtctttgcactcaggatgttgataaaatacaaattaattagcctcattttgttggtaaagggatgatgcgagtactattgcaactgcctcctagcatcctttccattttgttttcctggccctttagctcattttcacttctagaaaattataattggtaccctttatatttagtctaaatcaagactaattacctcgtctgaatagaagccaaagcatgtgtaggcaccaattgttcataatttactttccaacttccttaaatcctaattaaaaaaagtgatcatgatataccggtaatcacatgacctgtagcagacaacgtggtatgttcaatttataaaagagcgtatgctataaaatttatgtgtattgctcatgtatcaacccaacgaattcattgtaatctagtaattcaggttcagatgaaagatcaacatattggctattcacttaataaaatagcatcaatatgaataccaggtataggtacataccaagaaaatgttcaggtttgctctgttattccaatttcttacagattttcctacaaaattaaaagaaactgcagtatttagcaccaaacacagccaatgattatgcattaaggaaaaactacataatttacaaatctaacctgaagtagttaatgtaaatcttcattggtcatgagagcaacatcatatttcaaatagcaaacaccatgttcaaaactattatacataaaaatattggtaattggtgcagcccactaattttaggatgattttttaaaaaattacctcaacacaattagaagaaggatcgatgtagactattgtagggtttacgcaaatacatggggtgcttgactgctcgatccagcggttgtggcatggcggttgtgggtaggataatggcattgatgttgtctcggtagcgaccggggcgcagtacaacggagtacttgaatatgttaaaatagctcttcaatttggtgctaatataaacagactcatcaaaattccccaaatctacctcttgaaatgttgatgctttcccttccttttcaatccatcttcccaattcccaaatccacaaatcaggtattacaatttgcaaatcacaaataagtatatgagaagagaaaacaggatcccaagcccagctagcaaatgctggccgactgatgcggtcctgtttgctgcttactagggaggcagctgattgctcctcggcgcccacccacgtgctggctttctgcccgcacaacacagttgcattgcgctcttgtggcgccgccgccttggcctctggtagtcaggcctcggcccaccaccaccgccaccgcctttcgtaacgcatgccgcccgtgcccgatcaccggcgccgcctccctcaatctcatacgctcgcggcggtagtggcggctagggacgacctcggctccggcggggacagcgatggagggcagtggcggctggggacaacctcggctacgtcagggggcagcggtggagtgcggtggcgggtggcggtggctacggccgggggcgaccacggctcggtcttcggtgggggtagctgtggagtgcggcaacagcggcgacagccgggggagacctcggttccggcggggcagcgatggagtgcggcggcggcaacacggctggggacgacctaggcttcgacaggagtagtggaggaatgcggcagcaacggggacaagcaaggaggagcgaggagcgcggaggcggagtcttcgcgcgagctaaaatcatgatggatggatagggtgaaatcacggtcgctgtgggaagggtgaaatcgccggtgaacggtgcggattagggattaggcgatgcggatgcggatgaacggtagggattgattcgggtgatttggcctgtaggattggagggggacaactcctcctttttatattagtatagatatgatgttgtaagtttaaccaccagcaaacaacgttcttttgctgagttgggatcctctcctgtaatgcatgtgcagtaagtgccaatgacatgtgggcccggtataggtgggacccacatgcatgtcagtgacacgtactgcaggtgcagtacagcagtggatttgcgtcctcttttgctaggttctcaacttctgcactccatcgtttttagcttcccgagctgttaaacatattttgcaaaaattttctatagaaaaattactgtaaaaatttataataatctattttaaaaacttttatttactagtacttaattaatcatgtactaattcattactctatttacgtgtcggtgtgaaatgttcccaacacagcctgacgaacgacacatcatcctcatctctaggtagcgctagctgcgcctctcgcagattcactacaaatgaagacttaccggcaccggccgcgggttttttgtcatggttgtacaatggcactgcttttatcatcatgctatgcacactactacatgaaagatttttctggacgccgaacccttttgtttccaggcggaccatatgtggaaccgcacaggaaaatggggggaccggcgctaggccatcgctcacacagaaaaatcaattttcatgtgcgggcca

SEQ ID NO: 46723 - DNA, 12417 bp, Oryza sativa
cgcacacgaaaataggtgcccaccatttaatccggccgcgcgcccattcctccctctcccatctcctccctcctcccatctccatctccctctccccctcctcccaagctgcccggatctggcgggcgggagcagcgggctcggcgaccgagagcggcgtgcgcacggcggcgagctcggcggcggcaggcgacgacgatggcagtggcggcaccggtctcccagcgtctggatccgtcgccggcgatcgcggggcgatggctggattatggttagggttttggttttttctctttttttgattttttattttaccgtgcggcgtgcgagcacggaaaaatcatgattttcgtagacgttgggttccagacgagcgaaactactgcacgtgaaaatgagtttgcaacacacggaaagatcgttgttgtagtagtggcagccatgcatcgatcactgctataaaatcgatttttgtatgtcctagctaggtttttctttgcacatacagccgaaatgtgtttagctaaatagttagcctcgccttaggtttgtagatcatatgtacttcctccgtttcataatgtaagttattgtagcattttccacattcatattgatgttaatgaatctagacagattcattaacatcaatatgaatgtggaaaatgatagaatgatttatagtatgaaacggaggaagtaaaatatatttctgttaacggtctctaaaggaaccacttgtaagaataaattagtgcagacagtttgttagtaaatccgtgtgtcaaaacctttgtttctttattctttaacaaaaatacctaaacaatatcatagaaaattttcgactgagatgaaccaaggcgttcatctaaaatccttataatacctcctttaatatgaccaggtcaataattcctcagaatattttctttaacatgacataaatgaacgatcgtgacagtggcgtatttgtatatatgtatatgggtatggcacacatgtgtgtatacatgtaatcacatgattgcgaaagaacatgcagtctagtatttgtaatgaactaagcagcacttcaagagtgctgagtttaaatctttataagagcgaattttagattagattatttgaggggctaagttttctatttaaatcagtggcggatcttctcttgtggcaagggatggcaccggccatacctatgccatgcccaaaatagatagggtatttaagcatatggccatctcagccttgattacatatgctaattatgtgattagttagctgtattttaattggtacaagcttattcgtctaattaactggaggtaaagacctatagtgggactgccttgtgtctgcacaaatgaatgaatagtctagctaacaatcggtaaaaatcaaatgctaaataatagtgaatgtctacttgttatgaataaacacacctaaaaaacaggggaacactcgtggaaatgtagtttagtcgtaaaagttatacggcgaatttaagggcatcagttgtaaaaactgcataacaaatttaagattataatcattgtttgttattcgacgaatttaaagtgtcagttgtaaaaattgcatcacaaatttaggattataatcatcgttaatagcatatattctaataaatgcgaacatatattatagtttgtgtataataaaatgctacttcatttttaaaatattcgttctggtgtgatgatccgccatagctaaatttttatgctgtgtccgccactgatttaaatggctgcataatctagttggatataaaggccgggtaaaaatacatttttaaaaaaattaatcacatgattaagcgtactaccggtggctcctccggtgatttttcacggttgcacatgcttgcagatccactgacacgccgcacataatgcaacgaccagctagctatagccggcgtcatgctactatacaagcattaatatgttatagtacaaatactgtacatatatgtagcggaccagaagaataatggtcctatatatcctgtaccatacgacgactttcagctaagatcgatatctctacgacattatatttaccaacttggttaagaaaaaatcacttttaatcatcgatcactatacctagctagactagcttgtccgaggtgagcatgaattgagacgagagctagcctagaccgtagtctaatggtctaattaagacgctagacttgtccgtctagacagttaaagacgatcctaaactgtcaatatcacacatttaaataacaataagatgagcctaaaccataaaattatcgtttaaactatgatccaagcaacactaatgtattttttgtgagagaggagctaaaacttcgtgtcccacccaaggtccatattgcttaaggttttgacaccattacaaacccctctgctctgcacgaaaccttgcgttgccatgaagttgcaatgggaagagagaaggaagaaaatggagaaggaaggaaatgaatgaaaaacatgaccctagcatggttccaaatttgtaaaatccagtgacacaattataaatagacaaattataatgatatttatctaaatagacatatttacaatggcacgaatccaatttacactaaaatttagtagtggtttctattattttggatctcctgaagaccaaactaaaatgaccaaaaccgatgggttttcattatcatgcaatgcattttgaactttattatatttctagcgaaccgaaatatattgttttggtttgaccgaacgcccacccaaaatcgtgccttcatgactgaaatcaaaacttttaagtaaaataagagcgaaggcaatatatttttgtattgacatatacaggcatgaagccgttgcagtatttgactggaggggtcaaacctgcatatatatgggcccggatgggcagccactcgaccagccagtacagtagtactaccgcacctactcataaaagaccaaaacatgtaggagtaaaaagctggatccctggcctatccgctcatgccgtgcagcaggcagtgctgtatatgcaatcaggccaggacatggcccatcatatctcctacgaatgtgacttatatgtgcgtgatatatatgcaccagatctatgatccatctggctagccaaacatgcatggcccatatctgcatcttgcctttaatagttcagtataatactaccttcatcctagaatagatattttgggtgtgattagttcacgccaaaattaaaagtttggttgaaattagaacgatgtgatgaaaaagttagaagtttatgtgtgtaggaaagttttgatgtgatggaaaagttggaagtttgaagaaaaggtttggaactaaacaaggcctttgaaggaatgagacatatactagtactacaaatttaaacataaagattgtctagattcatactactagaatgtgtactatccatttaaatctcttatattctaggataaagggattagtcgctaaaagtaaaataatattatatagatacccactttgtttcatgacattatattgttttactttgactactcctgtttcatgaatatttttttaaaagaaacatggcacaaacgtaaacgcttacagcaaacacacactcacccttaaaaacacactcacacataccatacctctataagcacctcctaaaaactaggctggcatatcttaaattgagtaagccatcacgaggcaactcacccctaagaacttacacacgcacaccctatcctataagcacattcaaaaaattgtttcagcatatcttaaaattgatgaactcaccacggatggcacgctgtcgaatgatacattacctactattgaaagaacaattagtcatacacccgtgtcatttctaggatttaaacccaggtgaataggattctagctaaatacactcacttcactttcatgaataaatttgtaagagtgtccaacatactatattattaataaagtatattatacaataagtatataaaaaatcccgttcatcatgattaaacgatttacttctctatcttaaaatatagctatttctagcacaatatcttgtcccagaatgaagctatttctctaactacctcctcctctcaaccaatcacaaccattcttcttcacctatctcctcttttcaaccaatcacacacctcctccaatcatcccacctacttttttaatactcgtgccaaccttaaaagcaagtttaatagtacagctaactactagctcgaattcatctatagccaatctaatagctcattcatacaatagttacatactacactattaatatatggtcccacctgtcacacatacactgcgtcttggagtccgtgctacagctggctacaaatctgtagcccgctgctcttctctctcctcatttatcttcttaaaatatgtttacagctggtttatagcctgctattgtacctgctctaaaaatacctatattttgaaacggagtaagtagaagatatcagtgatcaaattaaagcatgcactgctactctaaattatagaatattatgaaacggagggagcacattcttttgtatgcgtatggacggatgcagccttttacatgcacctatgtacagtctgctcattgaattatggagttgctagaaatatggcgccatatgctacaatcgattttttttcagtcacttacatatgtaattagtatgtaattttagtacttacatatgtaattttaagacttacattataaatacactaaaattacatatgtaatttagggatttacaatgtaaatacatgccgactatttttttataaaaaatatggcgccataaatatagctacacccttgaattaaccaataaactttgcatctcgtacgcagaagttgatggaatttggattttggatgtttgatacggccgtcacactaatgtcattgggcagtacgtactgactagccggtaattacatgcttgtacgtctggccaattgcccaaacctggtgtttaccgaaatgattgtactgttgtgaaaggctgaaatggccttaagtgcgagtgtacaactttacctgctagggataaccctgatgttcatgtttatgtacatgtaggtgcatgctctttaacagaaagttttgtaagttgtacgttcggatttattgttttgattaatttgtttattatgggccctgcattgcagtgatataaatcttagcttctattttcataaaaacaattgtacctacatggctacatctattaatccgagcaatctatgccattataatttggtaccacaatgattgatcaatggtcagcgtgaattttttttctccatgaattaagttttgtttggcacaactttagatcagaattttttagagccaatacacttcagaaatatatggatctaaatttgttattaataacatttggataaacacttttctatatattttatatgaaatatatataaaattttaaaccactttattttaacttacaaagtctaaatctagtagttatatatgtggagtagtaggaccatttcctgcttcagctctagaaaaaaaagtggtttagattttactactactcccaaaaaaagctatgtggagtagtaggaccattatctaaaatctattactactccacgatccactttattttctgcttcagcttcagctctagctccatttcttagagctgaagtccaaccaaaaaaagagtgaaattctgtttagaaagctctagaatgtgaagactccttgtataatctttactccttaaattaaatttaggataatctttaaaccctcgaatgtgaaggctccttttataggctttgataacttgtgtttagccttgagtttattgtcctttttaaggaggattgaggcaagaggcagcactcagccaacgtacagtgccgttctgccgggacagacaaataaaaccaagcatcctgcaggtttcatttccagttctcatatccagcgaattctcagctttgctatcgcccacagtgatccgctgctccaccgctacgacgcacgccatcacacgcgcgcgcgcgccgtcgcatcgcagcctgcaccttgtggcggccgtagctcgctctcgctctcgctctcgcggccggtgaaatggcggcgcacgacgcaatcatgtcttcttgctagctagctagctaagttcgtcggcgcgatgatgtacaagcatgtcggagacgacgcacgcgggtcctccgcgggcgtagtgtgctgcgtggatgtcgtcgacgacgacgtcgacgcgctgctgtgcggcgaggacgccggcgagctggagcgcgagggcgagccggcgcaggggtcgtcgccgtcgtcgtcattgtcgtgcgccgccgcggccgccgcagccgctgacgacgacgacgaagacgaagacgaacacggcgtccatggcgaggtggtgcaggtgactccaggcggggaggagcactgctacgactacgactacgacgtcgacgtgcccgtcggtgccgagctcgtcatgcctgcttgctcgccgccgaggacagccgtccaccggcccggctggtcggagtccgtctcctggatcctcaaggtgaagctatagctagcaccgccgcaatctagctagctcgatccatggcaatctaattaacttgcacatcttaatttcactcgcctttcttctccaggtccggtcagtccacggcttccagccggcgacggcgtacctcgccgtgagctacatggataggttcatgtcgtctcgcagcttgccggtaaatcaatggccgcccacacttttgtctctagctgtgtctagttactggattaagcgcagtgcactgcagagagccagagattaggccttaaaaaaagaattagctgcagattacgaatcaattgatcagactatgctgctgtagcatacatacttagtacagagttggcagaatttgcagtaaaaaaaaagcacacttgcactatagttatgtgccgatgatatgtgggttagaatggtactgaatttctaagtaacttgtgtgtccgtcccaaaatatatatacttttttgagtttttcaaagtaactaaggagatatataaaattaaattggaaaataattgtgattagtttaatgagctgaggaagcatgtgtatgaattaaatatataaaggatgattgtgattgtttaggacgagagaataataattttattgtggattgtagggaataagtacctagctagctagcacacaaggctaacgaatgtttttggcagatgcaactagtagcagcaaattaattgaggtcattagggatggaattctgaatctatgttaggtggctagtagggcattattctctgtcagaggatgtgtctattcaacagggaattttaactttcccattagtagacaaaaaacatgcatgtgaccggtgatgccattttctgcccaggtgtgccaccacaccaagattgagaattatgattggcaggggcactattttgatttggatttggtctcaatccccgatctacatggtcactaccctgattaagaggtaggacaaggcactttttcatggatcgacgttctacatatttttgcatatgattatcatgatccctctgctacagaaagccacagccattccttttcttaaacggctccaatttataatcgtctatagaaaaggttggggccgttgtaaggtcataggctgcctgtgaaaatatgtcaccatcgattacttaagaaaaccgcctacactaatgaattcattattatttgcaaattcctagagaatccaagtcagtcgtaagttcataacagttaatatcaatctgaaaatgactctgtacaccacacttgcaattgctacatagagttgtcgttggttgtactattccatcatcaattctcattgtgatcagttgcatggtttgtgatttgatgttatacttcagatttttctcttcgaacaagatttcttttaatcgatctcctcttgttcctcaatgctcagagaatgcggtgcattctttgttaatgcagagatagacagctgaatttccagttatcttaagaactctactcatctgattctagcttattattgcaatttgatttctttcacccaggatcatggttgggcatcccaattgctatgtgtggcttgcttgtctctggctgccaagatggaggagtcctctgccccacccctccttgaccttcaggtaactaacttgatgtgaatagtgagtactcaatgtctttatttgcttttgttatgaatatgaatttcagcaaatgcaaacagattgaaggaacaagattcatttttgaacctcggacgatccagaggatggagctcatcgtcctcgtggagttggattggaggctccggtcagtgacgcctttcgcctttgttgatttcttcgcttgtaaggttggctcctctggaagaagctcaaggatcttggcattgcgtgcttgccaaataattctcagtgcaattcatggtaatgctaacgttttctttttgagggaacagaaaacaaaattttactctaggatgcatataggttgatcatttattcgcatgccatataatatactagatgaataatcaaaattgttttcgttagagtctagttaaaatatctaaaataagcaaaatgttgattatattttaattttattaccatactatcactagtagtaaaaggtggcataacataagtaaactaaatgccaatgtcaagaggtgcaaaatagtacaatgaaatataatttgttgtttcattgcctgaataatattatcattgcatctttgactctctattgaagtacttttttgttcccctctctttgatgaaaagatgaatcactggagttatggtgtgagtagtgagtactcaatgtcatggtcccgaaaactgttggttttaccggtcaataaccggatggcaaccagttccccgggtagttaccggtcggaaggatgcgaatataaataaaataacatattgtaaaacttgaatatagaactattctgttcgggaacatgtaaaattctaaatttagatttgaattcaaaattagcatttaaatttcaccaggcctgttcctgccaaaccggtattctgaaccttgctaggtagcactatttgcgtcaggattaagagggtgtttggatggtgaccacactttaccacaactttaccaaaatctgttgtagtacataggaaggagattattggatttccatttcaatcaaccagttagctggctaaatgatcatccactacctgggccaatccaaacacatttgtaacatcctggattcctggtgacagttcaatgtgacaagagatcagatgctttcttaaccctgctaaaataatagtacttgcaccattttctgtgaaaaactacatgagtctcatcatcattaattacatattgaaattaagtgctagtaattatccttaaacatcccaactaatgctaaacttgtccttgaatctcgctgcatccaatgctcgctaattgatccaagaatcttcttgttgccatccgtggaacagagctcgagttcctgaaccactgcgcctcatcaatggcggcagcggcggtgctattcgcagtaaatgagtcgcctgcagccatgtcgcacaggagcagcgtcagctctgaatcagctgcctcgtggtgcattggcctgactgaggtaagtaacctgatctctgacgtcctgaccaacccaacccacgacatgatcaattgaaagatcttgtagtttgcaaaactttgtcagttcgtcagtaactttgaaatgatcctttttttaaaaaaaatgtttttatatttgttattacaggagaggatcagcagttgctatcagctgctgcagcgagctctgaatgctactgcgaggaagaggaagcgacatccgatgatacttgcagcttgtcatcagtaacaagttcatcttcccggagcaaaaggcgcaaacttgatggccattttggagaagattgaatctttcttttcttttcttttcttttcttttatttgagtctgaattatattacattcctcggcgatttctgttcctggatgagctatttatttgtttatttttgcatccttgtggttgttgaagctttgataattttgtagcttaattcagaaagatgacatatttgaacataaatgtggggatcgagactaggattaaagatttctcaaagaaaaaaaaagagtaaaattaaaagaggagcacctgtatgatgaaatcgatggggaccaatagggcagcaacctgtgtgtatttctttctgcaaagtgatgcgaaagtgaagcaaaggatgcattcgatacgacactttggactattgggcacactgcactttgcagggctgatcaagttagctaccactagattagcaaaagcttcctccccttgtttagccctgtcaaagatttgtgtttgtttagctagttaaacctgattagtattatttagtagtactttttttttcactgctcaggaggactactcctaggacagtaggacctccattttcagtgacatgcttatactacttctgttttaaaatatagctatttctagcataatatcttgtcccaaaataaagttatttctccacatacctcttcctctcatccaatcacaaacattctttttttttttgaacggaaaaacagcactagagtgccttttcattgaatagagcaggagaaaatacaaacccctaggggtaaaaggaaaacagagaaccactatagaaccactatagctgtatagtgtgcgagattaactcacgcaaccacttagctcctgctaaagccccaaaggctcgcctcctctttgattttcattagtaggaagttcgttgccacctatttgtgatcaaaaatccgccgattcctctctttccaaatttcccagacgactaacagaatgagcgatcgaagtccttttctcgggacactaggcgtgtttgcaatgttctcccaccactgtttgactgactgggcttcctcccattccttgggtccatctgctgatagcccacccatgcagagacgaggtgccaaatcctcttggtgtatctacaagtggcaacaaggtgcaatgccgtctcaatctcgcggcggcaaagagggcaacaaccattgttctgccatcccctggtcgcaagccggtctgaagtccagactctgttctgaatgatgagccaagcatgaaatttgcatttccccgacgcccaggctttccaaatcaaggaattgaattttgtgctcggcgccccgcagcactgtgcatggtaagccgaggaggccgtgtagtgcccgttgtttgtgaacttccaagtaatctgatctggttctctaacgtctaagtgcacatttcggaccacttcccacagtgcggctagctgttcgacaaggtcgattgtgatagatgattgtgaatcaagcttcaaatcttgcacccaggtgtcctcctcctttccttgccgaaggggttttcctctgttttttgagatcgcatagacaagcggcatgaggtctttgggtcttcgcccaccaatccacgtggactcccaaaatcgcaccgtgtttccgtcccctattgttatgtttgttgaggcggcgaagaggttcctatctatttcatcacatggcgtctccagccccacccaaggtttggtctggtccttccattcatgccacaaccatctcaacctcaaggccctcgtgaatttgtccagatttaggacccccaatcctccttggctggtcggcatgcacgtctttgtccaattgaccttgcatttccctccggtaataacacctgtgcctgcccagaggaagcggcgccgctgcttgtctagctgcttgagggattcctttgtgattttcagagcggtcagaaggtagattggttgcgccgttagcacatatttgacgagcgtagttcttccagccgctgccatattttttcctctccagcttgctacccttccggaaattttgtcaaagataggttgcaagtccaccttccacagtcttcccagagctagggggaggcccaagtacttgatggggaaacttgccctcaccacagggatgccctcaagaacctcattcaactcgatgccgccgcatctgatgggcgccacttgggatttctgaaaattggtgacgagcccagttgcagtgccgaagtgctgcaggatgtccgtgaaggccgtaacatcgcctcgggtgggattaatgaagatgatggcgtcgtctgcgtacattgagatccttagcctag

SEQ ID NO: 46724 - DNA, 15685 bp, Oryza sativa
tcaaaagttatcatgactattcggaaatctcgatgtttaaaccagtctcagacgctttcaacatatataaacaatgataaagcatttctaaagaaaatttgttgagaggtaagttataacacatctatcaatcctcctgctaaatttcattgcaaaacgagaaacctcattagcacatgattaattaagtattaactattataaatttgaaaaatagatttagttgcttttttgaaaacaacttttatatagaaactattttttaaaatacacatcatttaacaatttgaaaaatgtgctaacggaaaatgaggaagttgaagtttggagttgaagaatacaacaggaaatactattacgaagtaagtgaaccattttcaataattctcggtgtaaaataagctgagaaattatttaggaggttaagttcttcaaggagatagtctaaaggagtaaaatggactttttctcaacactattaatcttctaatgagtgatcttttgagtttagacaagcactagttgaaaaatatataatcatagccggttaggcgtgctcaaaagcaattgagcattactaagcggcccaagagtggaaatcagggttggttcgtggcaagggccgacggtgctttcaatggttcataccttccgtcttcggctcagatggtccagagtgcagactcaattatactttggaccaccctaacttttatttttctccaactctaacacatcaagaacctcaaacacagcagctcttgcacaccaaggaactctcccatgtgtgccttatgcccacgtggagaagatgttggatgccgattgataaaagagttgagatggtccgtctaaagtacaataatgataaattctaaaaatgaaaatattaagtaaagaatggtccaaaatatacttttttttcaatggtccaaaataaagtttgaagcaaaagatgtcgaccgcaatctagtcttgcctaaatgggttcccatcctctgccgttggggggagaacggcaaaggcgcacagttaaacgtgagggaagctacagtgccgtgcagtctctacagtggaaaatactgtagctacagtgaaaaatatatattaattattttcatcgttactgtagtgtttaaactcttgcatccaaaacttgatccaacgggtataaatgcccccaaaggcatggcactgtagctctctgccgttccagttggaacggcagaggatgcgaagcctgcctgaatgggtagtttggttttctcaagagggagtctagtgcacggcattccgtccgaacaggataattaaatgacacctccacctccccgagcaagatatggataaggatcaaagatggactcggctagcctgacgtatcaatatgcatggctttcacaaaaatctgcacataggaattaatggttggcccccacgtgtatctagcgcttctccttgagtttgtaggtcagaacaagcatgtgtagtgcatatcaactattttattaccacgctattctactagtactaactagattgagacgatttctaataggtatcatatgatacttgtgagatatcaccggtgatatttatcatgtatcagacgattccaatcaggtttcacgcgatttctaccaggtatcaggtaatacttgtgaggtaccacttgatagatatcacctgataccggttaggtatcaggacatgatacttgaaaatatcagaacctgatacatgtttttatccaaacggtgatacttattaggtatcagacgattccaatcaggtatcacgctatttctaccgagtatcatataatacttgcgaggtatcactcgatacctgataggtatcacctaataccggttaggtatcaagacaggatacatatttccgtccaaatggtgatacttatcaggtatcagaaactggtattaggctacccgatacatatttctatccaaacggtgatactcatcaggtatcggatgattccaattaggtaccacgcgatttctaccaagtatcaagtaatacttgagaggtatcacctgataccagttagatattaggtcatgatacctaaaagatatcaagaactgatacatatttctgtccaaacgggatatggtcttgtacaattcatggaatgagaacagcacaatttccaaagagacgaacgattaaaaaaatactattaaagtcccatgtcttctcagtgtgaacatgcacccataaatacactgatttgcctagctttatcatattgtattgtcaccaactcagatactggtgtgacatgtctgctcgtgtcacgtgcccacgagtactcatgaggattgcaggcctgcaacacacttagctgctcatgtccgcgtgtcgctggaggtatgattgtgcacgaaatcaggttgacttatgtccgtatcgaggaagtcatagaatacttcattaaactattccgttcggacggtatcccgtacaataatttttctcttttctcaaagcagggggaactacatttatcttcctgcttttgttcccttcttaccgtgtcctcctttttattgggcttaaccatcgcagtattgttactttcttctcaatccacccatccagtcaatccccaattatataggtgtaggccgtgctttattcctaatctgtccaaccaactattctttaattataagggaagggcatgtaccattacaaagcatgatcaagccttaaaaagagattcttcatgttttggtccaagatcatcttttcagcatggcccataagcacggcaaggcccatttcttcaatctcttcgacgtcctcacctcaaacctgcccactccaaccaccaacacggctaggtggccatatggaccgggccgaggcataccggcctgacaagacagcactatagtcggcccaagcacggccactcgtgggttgttccggcacgacccatttagccgtgtcgtgcttggagcgacgcttgagtccatgggctggcacaggatgacacgatttccattgggctagcacgctacggcccaagtacgagcatggtcggaattttttcatttttaaatttatttgtttaatatttacagaaatattatatcggcggattgatttacaaaaatagacccttccgccctccatttgggtggcaagctgacgtggcacacggcgtcgtaacggtgtcgtgtgcgcattttgcatttagactctttgcagccctctgtaaggacggtaaggggctaaatgcaatttttgcgctgccaaaaaagcaattggatggttctttttgcatatgagacctttgccgcccttgcgaattttgcacggaggcctcttgccgcccaaacagagggcggtaagggggccacgcccaaaattcgcagccccctaaaaagaccgtcatgcgtccgtgtgccacgtcagcttgccacccaaatggagagcattagtgtctatttttgtaaatcttttcgccgatataatatttctgtaaatattaaaaaaataaatttaaaaatgaaaaaaatcgcatggtcgatcgccccaccaaattttccccataatttttcatctgttttttccatttttcctatttttaaaatatattttgtctattttctctcattttcccaaattttccatatgttcttttctttttcccactatttttgtcattttttctagtttttccccataattttaggcctgttcactttgatgacattttcaaccttaccaaattttaataaagttgccaaaatagtggatacatttagtttgctaccaaatttggtaactatataagaaatcctgccaaaatttttggcaaattttggtaaggtttttttcatcaaagtaaacaggtcctttctttttttttcttttaattttcctttttatcttatttctcttttttcggcctcgtattcaaattctgtgggccaaacgtgataatgggcctataccggcccacatgtcatatttgggcccgtgccggcactgcccgtattttccatggaccgtgcttgggccgacgccttagcacatgggcctgcacggtacggcccgctacaggagccatgcctaatcgtggctgggccgggccatgacgttcggcccatttgttcacctattgacggccacacgcccacaccacacctcgtcgccggcaaccgccacctccacggcgccgccggccaagccgcgcaggccagcgagatgacccggaagcccaagcggaagcctccgccctcgccggagccgtaccacgaccacccctccccttcccccgcccaatgcctcgccgtccgcgacgccctcctcgccttccacggcttccccgacgagttcgcgcccttccgccgccgccgccgccgcctcggcctcgacacatccccggacccggaggaggacacggatggcgatccgtctccgccgcccaccgtcctcgacggcctcgtcacgaccctcctctctcagaacaccaccgacgccatctcgcgccgcgccttcgccgccctcaaggccgcgttccccacctgggaccaggtttggtggccgcatccaggaagcttctagaagctccctcgtgtcctctgatgcgcgattcgttttcgtttttggaggtggtggatgaggaggaggggaagaggctggaggacgccatccggtgcggggggcttgcggcgacgaaggcggcgaggataagggcgatgctgaggggcgtccgggagaggcgaggcaagatttgcctcgagtatttgcgggatctgtccgtggatgaggtgaagactgagctatctcggttcaaagggatcgggccaaagactgtgagttccatctctctcttctcctgtttcttcagcgaatttggttttcgtcctgttggatttcatcgtaatgtagagaatgctagtattgattttgttgtgaaggatgaggaattgataaaatgtgactagtgagaagtagttgtagtttgcatgatggtagataatgatcaaaagcaaagcaagttgcttttcttgttgccatgtaagttaatacagcctgaactcaagtttccgcaaaagcctgcaaagtattttggctaacagtagtgttggtactaagttgtatgaaaaggaaattagagaaagtatgcccttgtgactgaaatcatatgcttgtgtcggttatacttaaatattgctgtgtgattatggatgggtgttagtcaccaacaaccagttttgctttgcaatgaatggctaacagaaacaggtgcctggtagcctccgtgcaatggcatggagcttcttctagattcttgtattcggagtgcaattgtccaactattttccttctactaagggtggtagttacaatcatggctggagttgtcaatggaaacttttgcaattatgattgacagtggaattcaaacagcattcccaaatcaaagaagggaccttacttgtgaatgtttataatatctttttacgctctttgattgcttgcttaatactatattggctgcttgagtaagtgtgcatatagctgatgatctttctaatatatgcaattatgcatgttatgacaggtggcgtgtgtgctgatgttctatcttcagaaggatgattttccagtagatactcatgtatgtgtaactttatgtggttcttgtccataccaagaagtcagtttagtgtgtatggcgtatatgtaataacatacatttctataataggtactccgtattacaaacgctattggttgggttcctgcaacagctagcagagagagggcatatcttcatctgaacagcaaaattcctgatgatctaaaatttgatctgaattgtctatttgtaactcatggaaagctctgtcaatcatgttccaaaaagttaggaggccagaaaaccaccggttcaaattctatgtgccccctagcaagttattgttgcactgaagaaaagatgaagcaataggccaatagccaaggtaagctacttggtcccatttcgaaatgatatgtatatgctgcgtgccaactatattgtgctctccagtaaatgttcttcaactagctgttttattattcgaaagttagatcatgagctggtttctcaactttagaattttcgtaagcactacacttctgctgcacatcttaaagtgcataatataggcccaaaatttatcctagagaggtcaactattacttgcttcttgcttattaaggaagtacctatgtttaaaagagagttatagttggtatgtcaaaaataaagagagttatacttcatgggtaacatgctgagtttttacaatgctgttttattctggtgtcatgaaatttattcaatgaaaattctactgtgttatttgcctatgggaatcatgccctctttattgtgttgggatattgtaagttaatcatatgaccttgcttgcagctactttcttactggcaaaagcactctgaatgatgtaaaatatgatacctaatcgctgttccagtctccacccaatcattcatgacataatcttttgcaaatgtaggaattgtttgtggttattgatattttctgaaggtggtgtcataacctcccaacaatgctaatggtaaaaggatttatgcgctgaaatgtctcatctgatggaaacctcaggttcggtttcttgttttatcagtagagactagagagcttccaggcttcagttgtatgatatgaactcatttctaccatgtaagtgacactagctagggaatttagtttggaactttggatgagaagcaaaacactgggggaatatcgacttaatcgatacatatctcattgattacactgaccaaaggaatcctaacatttttgctctaaagtgcgctaaacagagaaaaaggcaccaacagaccacaaccaaaaccaattgtatgcaccaggtatcctcgacttttctggtgcacatgatgtcttgtgcctgacaaggaggcttgtgatttccaggcaagcagtggctgacggtgagctaaagattctggtatgtcacttagattcagcatatgttctcggtcaccatcagtgcaatcccatctgagtctcgccaccccacctgccccaatgggacgggcaattgtgcaaccaggtttcagtactaaacttaactgtagtcgcttttgaaaatcttgattgacaacgtactggaccttgatgcacatttggtaccgtatgctttggagtagagcaatgtgctgccatgtgatgtgatggagcagctgggcagtttgcttcttgctttacacgaagtttagtactgcgaatcatttgatttgatctttggttaggttgcaatgcactctgtcaagttaacctgagaggcttgtcttaatgggaacatctggagtgaaagtcaagtgccttttacagttattgatctgtcttaacgctaacagagatacaagtgggctgtaccactggctgaaaaaaaaaaactagcatactactccctcttgtcataaatattcaatgtttaggaaaagatctgtttaaacttttaagattccaaccatcaatttgtagaactttataaaatctaagttttatgatcatgaaagcactttttagcaaatctacgtataccctttgttttgttttagaactaagcatttgggaaattattaattgtctgaattttaaaagtactagcataatacctatgcattgcaacggattttttttaaaaaaaagttaatatatatttttaaagcctctaagagaagttattactattaattaatatatcatagagatagagcgatgaaatattccataataagggtatttaattctcgtatttatcttgtgtgaggacttgcctgtgtggcttaaaaaaaaggtaaagtcttctcgcactttttgccgaccctatacgctagttgtgggtatagatgatcgaattttattataaatgtcaaaaaaatttcatcagaaatagtagtttatttttgattgactagtaaaaatagagttataaatataactacattattaagtgggttttatagcgacttactgagcctacttaatgggcatcatcagggcactgttaaatacaatatcaatctagatcctctacagtattatttaatgcagtattgcatactccctccgtccaaaaaaaagataaaccctggtttccgtgctcaacgtttgaccatctgtcttatttgaaaaaattattaaaaaaattaaaaagacaagtcacgcacaaagtattagggcccttttgaatcaaaagatttatgtagaaatttcataggattcaaatcctatagtaaattttcctatttggccctttgattcaaggattgaagctttccaaatcctatgaaattcctatggaatggcacattgcatgtggattttggaggaaatttagcaagagctccaacctcttgaaaaatttcctttgagtctatctctctcatccgattcctgtgtttttcttgtgctccaatcaaacgaccattcttgtgtttttcttgtgttttgcaatcctctgttttacacttcaattcttcagaatcctgtgtttttcctattcctccgttttttctaccatgcgattcaaaggggcccttaatcatttttatcatctaacaacaataaaaatacgaattataaaaaaatttcatataagacggacagttaaagttggacacggaaactcaaggtttatctttttttgggatggagggagtatgtagtagtgctcacttgtatatataggctcgaggattatgaggctcatatgtatctagcattctagaggacctgcatccatcatatatctttttttaaacaactgtcatatatccttgatcaattggaaatggatcctctgccgtagcaactatctacggaggttttacagtgtccgtgcattaggatgcacgtacacctttcgatcagcaatagatgcagctacagtaaatcgcatcgcccgtgcttggggtgcacgtacaccgttcgatcggcaatatatgtagctacagtaaataatgctatagtggtctaatgttgtatgcacgtttttctgcaccttaacagtacaaatcgaggaaatagatcatgattagctatggtcttagcttcaaatattgatcatgtcatcaactaaaggagctgtagtaacatcgcgcctgtcaatatagcttaagctctaatgatccatagccaaattttaattttagaattaactttagtgtttttcttttttcagccatgacttttgaaaatgttaaacgtaaaagtataagtcatatcctaaaattagttttcgttgcctcaaatcctagatcacgtgtcttaacttatagttttgaagtatttggatcgaccagtcatactcgtgtactctcttcgttccaaaataactcaacctttgaattattttgagacggaggggtaggcctataaagtataaactcgagggtcagatctaggattttaaattgatggtgttaatgtcatctctatgtaatgagtatagacagcaagaaaataatgcgatgcgacaaggtgaaattggattttctttcgaagaaacattttatcatatatttatactatccatctaattcagtgaaaatgaaattgtaaagcacaaaactaaagttagtgagtacacatgtacacaaaaatatatagcaacacagctgattttattacatgaacataatatataagaatagaattcatggaggttgcaacgtatcttcgcttataagccgtagcaaaaaatgcattccaaacagattctaagaataatccccaaatgcttaaaatctgtttagctcaaaagtcccaaacctaagaaatcgttaactttagggaaattgatcggttgacccgctaagtaagtaggctagagcgtaattaaaatgaaaataatatgataaattgaccattttctcggagttttttctaaaaaaatctcacttctgctactcagcggtttttcgagaatcagtggtgtgatctgaagcctattcactgggctaatttatttagctcaagcccaaagaaatttatggggtggtgtcatttctttgacggaagtggttaggttaggtctaaagcttttggtgttatcctcgcataaagaaaaccgtgatgatgttacctaacaacggtactattacattgtctctgtctatataagctgcagcctaaaacataaactttaacagatcatgacagttttaaactacaagaacatgtaagcgttcactacttatgtttgcttattaagtatcatcatttgataaagtctaaaggcgtgagcaaccgtgcaaatgcaacaaaaggagtcactccggtcggcaacagcctcattgggcccggctcatcaatcaaaaacacgggccccacatgccaggggcgagagggcaactgaaacttcatacatacctcctccgttttttttaaaacaatatgcaatcgaagacgcttacaacacgcgtacactcacctcctatgaatacacacacgcacatcctacccctatgagcatagccagaagactgaaccgatatatcttgagatttacaaagtcaccacgggtgccttgttatcgacggatacgtcgcctaccgcaaaatagccgagcacctgtgtctaagttgaatctgagtgggttggtttcaccacaagaaatctaatcggaacgctcacttcgcataaatgcttcctctgtttcatcatattacgagtcactttcaccttttctcaagttcaatttatttaagtttcaaattcataaaaaaagatagcatttctaacacaaaacaaacatattattaaaatattttgtatttaatcaaactaatttataatataaaacaaagagagtatgtagttatagggctctgtttggtagagctccaacttctaaatttagctatagaagttgggtctggagtagagttatggagcaatctaaacctagctccacttctctagttcattttgtgatagtgttccatccaacttcgctcctagtttatgtggagctgaaactgtttggttgggcttcaactccaggagagatgaagcatgagttgcaatggtgggttgttcggtctttttacgatggttggcttttaaagaaatctgtttatcaaggtttacggattttatgagaccaaaaatgtttttatgtgatggtggaggatcactacaagtatgctataacgggatcataagttttttgggtggtttttttatggatcagtttacttgagtttttttgaaacctttctttaaaggagaggaaagagaacgactttgcttttcaaaacagttaaaaagaaaaaaaaaaagagagattattaggctaatagctgctatcactaacatcaaagatatggagtactcctagatgtacctaagagcaggtacaatagcaggctacaagctagctacaaacatattataaagagataaataagaagagagaaaagcagtgggctatagatttgtagccaaatatagcacggactccaagacatagtatgtatatgacatgtgggaccagatattaatagtgtagtactacctccttccctaaatgtttaacgtcgttgactttttaaaatatgtttgaccgtggctcttattcaaaaacttatgtgaaatatgtaaaactatatgtaaacataaaaatatatttaacaataaatcaaatgataggaaaagaattaataattacttaaattttttgaataagacgaacggtcaaacatatttaaaaaagtcaacggcgtcaaacattttgagatagagggagtatataactattgtatgaatgagctattagattggttatagatgaattagaggtagtagttggctatactattaaacttgctctaatgtttcaaagagaaaaatatatactctagtagagaataatggccgctatcactgacaggcgtgcccccacaaggccacaaggccaaggccaggccaaccgctgtcacgtgtcagcgaatggctacaactgacggggcccacactacaccaacacccactgagctgcgggccccacggccccaccacgaggtacacctactatgccacctcttccccccaccaccaccacctcactcccacgcctccctcctcccattttcgccggcctcgctcgccgccgcgtcgcgtcgcgccgccacctcacgccaccgccgcgcgggcgcggcttccccttgccttccactccgcctccgcctccgctgctacggcgcgagccagaaggggcggaggtcttcgccgcgacggggatgagggggcggtgagcctgcgcctactgccccggccgcaacagcgcagcagccactgccgccccccaccgctcggcgcgagatccgagcgcgacgcggctgttgctgttgctgctgtgaagagccgggaggggttgacgcggcggcggaggagaggtcagggaggaggcggaggccatggcgggttcgaggttcgggtcgttcaagtcggagaagggggacccggccgccacggcggcgcagaggagggacccgtacgaggtgctcggcgtggggcgcaacgccaccgaccaggagatcaagagcgccttccgccgcatggcgctcaagtgagcactccccgcctcaccctcagattcggccccctcattcgatccttctggcatcctagtcctagatgaacgcgtctcgcgggaattcgtgcgagataagataaattataggagcttatttactgtttagtgaacttttggagggatttgggggcgcatttaatcttgctagccattcttgtgtggagattggttcttctttttttgctttgctatcaatgttgcaatggtttcagaagttttccttgcaaattgaggcaggtaccacccggacaagaatggcgatgatcctgttgcatcagacatgttccaggaagtcacattctcctacaacatcctgtcagatcccgataagaggcggcagtacgacacatcaggatttgaggttagttcttgcatgaactggtaatttttaatctaccatgttatggcaactggtgcaatttgttcaggccatcgaagccgatagccaggaattggagctggacctatcgagtctcaataccgtgaacaccgtgtttgctgctcttttcaggtaaaaacattttactgatgttatatttcttttactgtttgctactagcttgttatgctgctttttttttcttcttaactgtgcgtacgtatgtgcagcaaacttggtgtgccgataaagacaaccgtatcagcaacagttttagaggaggcattgaatggatcggttatggtttctcagctccagcttggaaactctgttcacaggaaggtaggtaatggcaactagctgtccatcatccaatgcttcttttcttgatgttagcaactaaataattgaaagctgcatgtggccaggtggaaaagcaatcagctcatttttattctgttgacataacagaaaaggaagctaaaatggggttagtttgtcgtgtgaaatcaactgatagaagcaaatttaaggttggtttttgttagcaaatgttttatcatgtaacctgtgtttcgtaagtacatttcatgcggttctggtgttgtcagttctgttttaatttattttgatctagacttgttcaagttgtgtacatttatcctgcgtagtgaagctatccttgtttgacaatgagaaaatttgcccttcagttggtgaaatttagatgatttacttttgacatatagtactccctctgtttcatattataagtcgtttgactttttttctaatcaagtttgaccaagtttatagaaaaatatattagtatattcaacacaaaataaacatattatcaaaatatattcaatgttagattttgtgaaactagtttggtattttgaatgttgctaattttttctatgaacttagtcaaacttgactaggaaaaaagtcaaatgacttataatatgaaacggagggagtaataaacaatggtaacctgtcctttaaatgcatgttctgtgtgatcaataagtactggctgtgctgcatatatagaataatcacacctatggtacaaaaaaatattgttttgttgtattcacttttggaagggttctttgagagggctctgataatgaaattattttgatctggcagtttaaatgatggaatacaacatgcatcatccacatgtgtttctgtaataattatgtcagcttttgtttatcctgttatctcatggctttgataaagttgagtcacacaatgcttagcatgtaaaacatttattcaatactattgattgaatacataaaattctcttggtttaatgtccttttcctttacttagacccttaacattgttattcttgcatacaatttcagttgctttactttgagcttgaagaaaatggtggcctgagccttgctttgcaggtaagagtgccagaatcctgttcttctgcacataaatttaatcagctttacatctgagcatgtagaggttttggatagagattaaaaccctgcctacctcaaggggttgcgcgcaatccctatctaaactatccattactaagaaattggtctcgctatttaaacattgtgtgtgcaaaaatgacttaaaagttagcttattatctgcaaaattatcatagtttcaactatgtagcaatataaaatgctgcatagttgtcagtcctgcagattcacaaacaagtttgagtagtcctatactcttgtctattgaattcgctattaaactgtaacaccatgtaatgagcaaaccggtgaatatgtttttgctttgacaacctttgcttcatgcaatatgcaagtggcttaagtttgttttctcttgttccatctgcacaacctttcgcaggaagacagtgtaaagactgggaaggttacttctgctgggatgtattttcttggctttcctgtgtatcgttttgaacaaaacaacctggtgagtttacatatgtgtcatcgttgttgaatcctccaagtgcttctctgtgattcatttctcacaagttccttttaatttcaggcagctgctgcaaggatcctgatagtgccttctttaaaagattggacagcttccaaccatgtgatataaatgaactaaaaccaggcacacacttctttgctgtctatggtaatcactttgtttgttggtgcagtgtcaattacttaagacagtacgaatccccttaaactctacgcttcactcaggtgacaatttcttcagaagtgtgaactatactatagaggttgtatgtggtgaatctttccctgctgaaaaggagaagctccagagtgttgaggcaaagatactcacaaaacgagcagagctatccaaatttgagaccgacacagagaagtatgtggttgctgcctttccccttgttttccctcacattctttctatgcactgggcgtagctgtcaacatttttcatattccgagattcacaggttttggcaaagttcactgagatgaccagcagatacacacaagaaatgcaagcagtatgtacaattctattgcatagtcatttttgtactccgtcccataatataaggga

SEQ ID NO: 46725 - DNA, 4877 bp, Oryza sativa
tattatgggacggagggagtattctactattttcttagtccacatggtctttttgtagatcgataatcttctgaaggaaaggaatgaaatccatgcgtcctataccaacaattcaccactgaagaggagttcaagcaggagtaaagctaaatcgccttcaaaattttccaaaggtgaggaggaaaacagtcagagaaaggaaaagaaagtgaaagaccaacccacgggtggatgcagaagtgcagatgaagattcaaacgaaaagaaaaccaaagagcggttcccaaagaagaaatggttaaacattcctttcaaaattgacaggagaaagccatgctgagtgatgtaatatattcttcgctgtgctatttttagtattttcttatgaagtatcctcagtatacttatctttcacctttggtttttgcaggtaattccctgcatcatactgtttaaccaaaatacagagcattttggccctgaccattcataacagaacccctccctggtttattctagaaagattgggtgcaggcctgagatggttggagaaatatttttttcgatccccttgaagctccttttggtcagtggccactcatcgaactgtatcaaaataattaagagaccgagctcgtgatgtgatcgtgagatagaagcatccatagcttgtcatatgtgcagccaccattgtccaattatgattcttttcatcgtatattcgtatgtttagttttgtttcgattccctttgtaagcagttgtaaatataggttcttttcaccatatgcttgctgtacataatgtaccttcttccctcgtctggattcctgatgtgtaagaaagacaaaccatttacccagttttggatttgtcattcatgtgtagtttgttgatgcatgctaagctggagcaaagtattcttgcatcgaactaagttgccgtttttgcaaaattctgaagctatggaatgttgccatgagccataggagatgccaactccatggaatctctcttttaacaagcaattcacatctcaagttgtcaacgattttgctagcactgaatagcgtcctttgagatcctcaggcaaaatttattcgttccaaaaggacccaaaatgtaattgatcatgtgatcgccgtcagcccaaagcatgtaataattacaaaatggattaaaacgagggcccaaaatgttattgatcatgtgatcgccgtcagcccaaagcatgcaataattacaaaatggattaaaacgaggtaacatactattatatgattaattaagtatattagattaaaaattgaaaaatacattaatggttttttaaagcaacttttctatattttttttaaaaaaaacatattgttttagtagttcggaaaacgttcgcgcgaaaaacgagggagtagaaattgggaagaggaattatcgaacgcaactaactcttgtttttattgaattactacctccgttccatattacttgtctttttgagtttttgtttgtcaatgtttgatcattcgtcttattcaaaaaattttggaattattatttattttgtttatcatttgctttattatcaaaagtactttacatatgacttatctttttttatatttacactaatttttttaaataaaacgaatggtcaaacgttgcaaataaaaagtcaaaaacgtaagctattatgggacggagggagtataagataatttcaaattattccatatttccattggacaataaaatccccttttcattttcgaagtaaaaaccgctcctcatcaacaacgaagaaccaataaaaatcgacgattttcgatcaatgtcgtacagaacccggttaatatcgatcggtttttacgaaccaagacctaacggtttaacgaaaatcgatcggctttatgaactctgttgacaccaagtcctgagaccattccctaccactctctttccctccatttgctctcctccaagaagctctcccgccatctaatccttcctccatccatggcgagatctcagatacctgaaggtaagctagctagcaaaaggtaggtgtagcatcgcacgctgccaagaaaccgaccatggacactcacctcgtcgtcgtcctggcattgctcgccgccgccgccgcggcggaggccaagatgtcggcggactactacagcaagacgtgcccgcgcgcggaccggatcatcgccgacgtgctggcgcagaagcagatctccaaccctacgacggcggcgggcgtcctccgcctcttcttccacgactgcttcgtcggcggctgcgacgcgtccgtgctggtcgcgtccaccgccgcggcgcgctccgagcgcgacgccgacgtgaacctgtcgctcccgggtgacgccttcgacgccctggcgcgcgccaaggcggcgctggaggtggagtgcccgggcgtcgtctcctgcgccgacctcctcgccgtcgcggcgcgcgacctcgtcaccatgacgggggggccctactacccgctccgcctcggccgcaaggacgggctctcctcctcgccgtcggcgcccgacgccgagatcccgcacgccaacctcaccgtctcccgcctcgtcgccgtgttcgccgccaagggcttcaccgtccaggacctcgtcgcgctctccggcgcacacaccctcggcttctcccattgcaaggagttcgccgcccgcatctacggcggcggcggtggcggcgccgacccgaccatgaacccggcgctcgcgaagcggctgcaggaggcgtgcagggactaccggaggggcccgaccatcgcggcgttcaacgacgtgatgacgccggggaggttcgacaacatgtacttcgtcaacctccggcgaggcctcggcctcctcgccaccgaccaggagctctacggcgacgcgcggacgcggccgcacgtggagcggtacgccgccaacgagacggcgttcttcgccgacttcgcgcgcgccgcccggaggctcagccaccacggcgtcaagaacggcgccaacggcgaggtgcgccgccggtgcgacgcctacaacggcggcccgcgcggctgatcgcggcgcgcacggtggcggcggcggcggcggcggtgcctcgaagcattgatagtctaatcttagattagtgcaggaagataacacggagaaattcaaattagtaggtataaaaagaaaatatcttgctgttcagagaggaaaaaaaaggggaaataatcaactttcacaagtgaaatcatttcgtagtcatatactttaggctgtgttctaacgattatcaaggcacgaacaaataaattaaatactactccctctgtttcacaatgtaaaactttctagcattgtgtctagattcattaatatctatgtgaatatagacaatgctagaaagtcttatattgtgaaacggatgaagtagtatcaaggtaaaagtaactatttaaaaccgttctctaacaaatgttgattgtcgacgaagaaagttccacttcctgctacagtattcgtatgtatagagttggaacaatcggttagtatgaaatgcaaatgaagatgtagctagagacaggaagaaaaacttttatacagttttaatcctcgtaaatggtatgccatggccagattgggggcggcgtgaacttgcctgatctgtgggtgatgtggctaggcttggcagctagagggacaacgcgatggtctggtgacgatgttgtgcaggtgggttgtgtggtgttggatgaaaattgttggtgaaagccttggctagcctttggctagcttgacaacgacgaaacccttaggtgttgtttccctccttggaggcgtcgttttggcgtcatttctcctccactatcaagaaccttgcctgtgcaacaatggtcgttggtagactccagtgtcgaaactccataggcttagctgtttggcaaggcattcaccttctggcttttgtcttggttgtggtgagcatccaactttcttcgtttcggctaggtgaagtcgaagctacttcgttgtggtgcaacaaagctcggcaacgataacacgttgtagtctctaggggtgctggtgttagctgtttgcaagaagtgtttgcaagaagtggtgcttggttggcttgggttgatgtccaaagcaagcagttggtgttgttttgttcgttttggcgatacctttggcaatgatgatgtaacagctgtgaagttggagctgctatgtcgctaggcgacaagctcggcaatgataacacttgtctcgtgaagtcgaagactttgtgcggccttacgataagctcttcttcgatgattgttttgggctccgtttttgtcttttttttcttagtcttggtagcttagatagttagaatgtgcttgtgatatgcatgatgtgattgtggaaagagagatggatagtgttggggcaccctaggtaatatactatccaatatccaacgtgatcaccaaatgtatttttatcctacttatccaaatacatgtgatggtcacgttggacactggacggtatattacctagggtgcccgcagatagaatattttttgagggcagatagaatattcatatagcaataaacgagcatacaacgctgaaaagatatctatcagtactttatggctcagtgcagtctatatgaagtgggatccacctttgtcgatttcaatacaaatagaccctttaggggataaatgctactagtgtaattatactaggtcggggggagtgatttgtgaacacacttggtatacattgagggggaaagaaaactctaactctaacctattatactctctccgtccctaaatataaggaattttggtgggatgtgacacatttctag

SEQ ID NO: 46726 - DNA, 18005 bp, Oryza sativa
  unsure (1)..(18005): unsure at all n locations
atattgttttgctttcatccattgactatcaaagcagtgtaaattacattcatagaagttcttgagtgtttctggattacgtggctgccttttcaatcatggtatccacaccacctcatttggggaaaaaaccagaacaaaaattttctttggtaaattattaaagcatatcaacccataagtaaataggataccttgtcacccaaaatcaccataaaaaatatactcgggatgttatttgaacagtttttatggttgaaacatgtgctctaagcggtattgatgttcagagtataaattaaatccaagcagaagtggagggaccaaatgtgatctttcccatttgtttataatcactcttctcaaaatctctgaaagtagtggccaagaacttacctcaatgctgtgtatgctgaaaataagatcctccctcaaaaaattgatgcccttcaagcgctgaacaaattttggtaaaaagcctacatgactggagaaaaatgtatggtcccttttacaatgtccagatgattaatcattgatgttcttatataaaaatgtgttgtgtgcagaccgcataatagaaacttggtcataatgaataattatgcttatgatagatgacaaattgataaaccaaacctacaagttgccagaaaataactttccatgactgtaaaataactaaatggctgtttggtgtggtgccaaggttcagtgttgaattcaatagaatacactgaacgcacagcagatgggtaatttctcatcatacttaaataaaaatcacgtggcatactcaataaccaacaatttttgaaagtttgaagtatacctttcaccatcaggatgagtgataataatatccatgtcaccacaagaagattttccacgtctgtatgatcccccacatacaattatcacctccaaataaaaaagatcatgtataacaacccaataatcacttaagggaaattattgttctactaaaatcttaaatatatgagctatttgttttcaagaatcaaatcggcctaggatctcgataggatgaccccattcctcatttttgtactggatgtgtactttcagaggatgactggaggaatggtgatgaaccaacccatctagttctccaaacaaaataagtagtcaggttcagactaatagggaactacaaaaaataggtgtaagcaactagctgctacaggaaacaataaccaccgcatatgttgagacaaattgaacatggaactgatgcttcagtattagtttttgaatggcttgtgtagttatatgtaatggagacaaatggttcctttaaatactatatggaacttaccccaggcaagatatcagtcccaacttcttgcaaaagcttctccatctcactaacctagataacaggagagtaaaatacgtgtaatgttagattgtacttcgaatagctagtaataataggaaaagaaaacaattcaatgggcttacagaatacatacctcatgtcggggtattctttgtttgatatcgtcaaagaacttcaggccaatcctctgagcacttgtaagtgaatcgtctttttgaaggtcatccagtgtacgatgtcctttatcatataacttgagagcagttgcaggaccaacaccccaaacttcgccaaataggctgacagttcgaacctttaaggtgatatgcaaatcagtaaatatcagggagtatggctggataatgcttaagagctactcctgttcactgaaaaccaagttaccttctcatcattctcaaagtgctctagcttggaaagctttcctgtatttactatctcattaatctgcatatacaagggtagttagacaatcaaacacctgagatattacatgtagaacgatgaatgtatgaattcatattttccttggaacttctgtggtacttttagaacctgtttgctcaatgaaggtgtgaataaattttcagccctcaacagcaaaacaaaatagaagaccaacatatttttaagaaaacagagttatgacacagttactacatcacccatagaccatagtggataaaaaaatagaatcatgaacttgtacaaaggccaaaaatatatatgttgacttgtaaatcaccaattaatatgaattaatggtagaaaaggattaacatacatggtctttcaatgatttcccaatagcagggaggtctttaacttgatcagcgctttctattttgaatggcaatttctcaatcactggaatagccttgtaatagctaaatgatcttcggtcatctcccagggcttcaagtgaaagggaaggaaatgttatttgtagagaaagtatatgaaatgttaatacaatgaataagaagaatgagaagatttctgtacaatgtccttacctctatatatattgatcagctttccaaaaatctcagttatgttcctgttcaagtctggagagcatacgttgaggattctccagaagaggcttcctagttatataagcaatgaatcaacactaggaaatataaatcctcagggttcaggagttatatgttgtatggtacagagcaatatatcaccattgagggtgcaaaatagatatacagctgaccaccaaaggtcttaaagttgctacagcagtgttttcatttttgaacagataaaggcaactgcgtacatttttatagcagaagaaaaacagtctcaagtctagtcatgttgaagtcagtgtagatgtaacttagagcttagagtaagctaattacaaaaaggagaagctaaaaagtgtttcctcttttttgtttacatatgttcagaatggagcttgtacgaatttgagcaaaccaaagaggataagtgcagcaaaacaacataacccagactttagagcccagttagtttgtactataatttataagaccatgcttatacctcagctttgaatgcattttgagaagctatggtttccttagaatctccagaggcactttggctacttgtacacgtgctaggcccctttacaacatccgaatcttcatttggatgtgcaattgcatctcgagattctcgattacccccagcagtttccttccgattctcaggaccgtctgatgatattttgctcctctttgcagactgcaacacacctgaacctgcagcaccaccttccttcttcggcttaaattcctcttcgtagttgatagcaaacttgtgctccggtagcctctccccggatttgaggcactcctccagccactcgaatgacaccacgctctgcaatcaaaaaaaaaatcagttcttatagtagtaaatacaatcacttgatgttagccgagatctctctgcaacaaaaatccagtccttatagaaagaaacacaatcacttgatgttagcagaaatctttccatgttatgaaatctctataactcaatgtagtactactactagcagtagatttgggctgtgaaaatgcagatggtagcaaggcacaccaagcttgccgagaggagattagggtttcaagctagggagccaagccgattaccccgcgaaagcggtggagccaggcggcgtcgagctcccggagcagcgccttggcgtcggcggccaggacgtgggtgaccgcgccgccgccgcccttggcggcgagcttctcctggacgcgtccccccatctgcgccagcctctgcttccacacctgcaccgacgacgaaagccaggaaaccctaagcacaggagagagagttggtgggggttgggatggattgctcggtggagccgcgacctcgaggcggcgagactggacggcgtgggggacgacgaaggcggagacgccgcggaacatgccgtcggggtccaacttcgccgccgccgccctcgccggcggcttccgcttcggagccatggagaactcccgccttctcccttcctcgctgacttcagagttcagagccacaggggttttggggaggttttagaatttcttcttcatcagggttcctttaaaaccctaaaatttagaatttactggattttcgtagaatctactagttcagttattttaaaaaccttttaaatttttcccatttcaaagaaggcctgacaggttgtccaagaaattatttctgaaatttgtggatgaattgaaattcaaaccacaagccacaaggcacaatcaagaacagctccacagattatcagagacaaatgagcaaaagcacacagtaatttgcataaatatcatttacatcatccgatgtacaacaaattaatcaagccacacgcaaaatctatattgtaagtatgtaaagctcaaatcctcaatgctgctctcctcctaatattgggaggggcttattgcttgtgagcaaatcaaatcaatacctatagttccttttctgttttccctcaaattttacaactcaagcattgtacaaaacaagaaaacaagcaaaatggcaaaccaaagtatcaacagtagtatccacccatctgggttaaaaactgtgtactgttgctaactaactgtaaccagctcaggcagtttctgtggtgtctgcttctagtgagggtttgtcagtggctgtttctgtgtcaccttgcaatggcgcctcctcaacggcagcatcctccggtgatgacttggtcgcgccatcttcttcctctgatggtttgtgagcctctggcttttcaaggtccatgctatcctctgatggcttggcgctgtcatcatcttccactgatggcttatcaagaaccacactgtcctctgatggcttcgcactcgcctcgtcttcctccaacggtttctcaagaccagcattgtcctgtgttggctccacacttcccttgtcttcctctggttccttctcaagagttacagggtcctctgtctgcttggtgccagcatcatctttctccgatggcttctcaaaggtcgtactgtcttctggtagcttggcactcgcctcatcctcctccaatgttttctcaagagcatcattgccttctgatggctttacacttccctcatcttcctctgatgccttctcaagagttatagtgttctctgatggctccacgctggcgctatcgtcctgcggcggctcctcaagagcactgctgtcttcggatggctttatgctggcctcgtcgtcgtgttttggttcctcgacagctatggcactttctgatggcgtttctatggatgcactgctctgaggtggtgcctcctcagaaacgttgccgtctgcagcttcgctaatgcttatgctactctttggagtgttatgaggcagggtttcagtatctggggtgctttctgatggtttatcatgcacatcatcactttcgatttccggtggcttctcatcctcgacagatgcatcattttcaggctccaatggctgctcagttgacttgtcagaagcttcatcagtttgaggttctgatggaacctcgttagttctatcactttgatgcagcactggtgtctcaactccagtttgagattctgataacacctcagctgacctttcagcagctgcatcaatttgaggttctgctggatcctcggtaaccacatcactttcacgcagtgttgccttctcacctgcagttcgagattctgatggctgctcagccaactgatcagaagcagtatctctttcaggttctgatgactccttggcagttgcatcactattatgctcttgtggattctcttcatatgcttcgtgttgaggttccaatggctgctctgaagctgcagccttttgattttctaatggttgctccgttgcaactttagcaggtgcaacatcttgggactctgatgactggtcagcagctggatcggtgttagcttctaatatctggtcagatgtcttctcggcagatacaatgccttgaggtcctactaactgctcagcagttggcctgatttgagcatctgatgagttcacaccagaagtggcatcactttcaggctcggtaggattcccaacattggcatcaacctgaggtggcttctcaagactgagatcactttgttttgttgtgctttcagcattagcttcattttgaagtggcttctcagcagtctcttcactctcgtgtggctgctcagaaggttcattggtttgcggtagcttctctgcagcatcttctttagatggcttttcggttagagtagcagtttgagatagcttctcaacagccatggtactttctggtaatttatctgtcagtatctccctctcggagatttcctgatgagctgcatcacttggagatggttctgacatggcttctacactttgggtcaggggtagctcgtcagtagcaatatcagtctgtgatggcttctcattttcagcagtgttttctgatggcttcttagatggttcagtgatctgagatgatgctacagcaagtatgtcactttctgacaatttttctgtggaagtatcagcttgcgatttatttgcagtaagtggtagttttttggcactttcacttatttgtgatgaattctctgtggtagcaccattgttctttttatcttgaatgatctgtgatttgttatcagcagtcacattggttttctctgcttcttcagcaagtacacggttttgtaacggtttgttgctagatatatccttctctggctctttttctctagacacgcttctttgccatggctttttcacaaccacgctgctttggagcgggttggtgctagccacactaacttgtgatggtgtcacaaccgacgcaccgctttgcgattgcttttcagttggaacattgcgctgccacaatcttttgcccattcccctgctttcaggtgtctttgcatcagttacactgctctggggctgtttctggaatccgatgttacgttgccattgctttttaaccactgctgcagtgctctctgatggctttacatcatctgcactggtctgtgaaggtttctccgtgattccactgtgttcctgtggcacagtgggtgttgtactggtttctgccagcttcacatcgatagcactgctagatgacttctcagtgtctgtattgttctgcagtggcttctccgtgtctatattgttctgcagtggcttctcattgaccactttgtgctcccatggccttttaattgatgtggtgctttctgatggctttgtatcatttgtcaatgatgacttctcagttggtccactgttctgtatctgcgcctcagcagccacagcacgttgccatggttttctgatcaatttgctgttttctgatggcttcacatcatctgcactggttgatgatggcttatctgatggcgaaatgctctgcggtagattctccgtagctaccctccgttgccatggcctttttaccactgtgctggcagtgctgctttctggctgttttgcatcaaccccattacttggcaatgattcctcaatggcagcactgcttggagttgacttttcagtggttgtgttactcagcaatggcttatctgtgggaagattgcgctgccatggttttcttacggctgcactacttcctgatggctgtaagttaactgcactgctctggaatggcttttctacactgctttccaatggcttcttgctgactacatgactatttgactcacccttggtaaccctttccccttcttctgacctctgaactgttgtgctgctttctgattgttttgggacatcaacgctactttgtgattgcttttcagccacaatatcgtcttgtgacggtttctcaggagtgagttcactttctaaaggtttctcagtgagcccatcaccttgacctgggcctcctggattcttggtagcatcttcatgttctggttgcttctcgatatccacttttgcatttggagtactatcctcaaaattgctgaagtttcccttaaccataaataattgagagtgatgggtcttgcaataaagtttgccttcatgtgtgacattgttggatgggctaagagtacagcctccatgggtgcaacggaagcatgatttatgatatgagctcccgttaagattaacctgcaaaatattaattgaattaatcatttcttatcggttatcctaacattgcattcttctatagcttacataagttagccacagaaaatgactaatgcagtagtatgagggaaaaaagtatataacgcccaaatattgctaaaaatatagcatattggcatgtaataaatgtgttcttaaatattgtcaaaaaataggtcaatgaactgattctacaacattgtgaaaatttgacagcaattcagtattttaggaaagggtatagaagtctccatttggcttagcttgccactctttttgcttgtgagaagaaaattattgatacttaattacaactggaaaactttatcagatgtagtaattctaattattgtggatatattctaataacaagcacgataagatttatcgcattagcagttgccactgaattagtcttgtgatggagcacataagatgatgaggccaactacaatgctcaattgtcaaccatatcataaatagaagagcgcttacatgattaattccctgaacaggagaacagctgttggtttataacatttattgaagttgaacaggggaagattaaataatacagtagtataatactgaccttttcaagagggtacacagtcttgttacaaactacgcacttgtcttgtgtgccaacaaacatgctagagaatctgttcggttgcccctgcagtttggataacataaaagaggaagtggacatgaatgttatgtcctctacatcaaagctgccaaacaatttagatactagggacgtgcttcaaaaacataaaagagcatatcttagaaatatattacgataccttgtttccattcgatttttctgctttagctgattttgatgtccctggcataatatagtcaaaatttagggcaggcctaaaaatcatgagacaatagcaacaatttcgaggtaaagacactagcaataattaaggcatcaagcccagtggatttagttttctcttcagtaccttcaaaacttttctccaaactgccggttgatttcaatatctggtcatagtgaggtttgcaatataggacaccttcgacagaagaatagttactaaactgtaaaagataataaaaaaatattagctggtttcatatatgtagcttagttgcaaacagaacaagataggtgtagttctagctagtatgatgaggcataaagatttagtgtgatcattattattctcaacagaaatataccaaaaccaagaaaaaaacatgctagctgcatttacatccatgatgcattgaggacagcatgattaattccatgttattactttcaaaaggcaggctaatcatacggcactcaccaacagcataataccaacctagcaaatcagccagcactatatttaataggtgaaccagtcagttcaggaatatgatgaacagacaacagttgtaccaaaaaaaacaaacatttatttgctaccctatccattccagtccatccctcatgccacaataacaagaaaaataattgggatatttactaagacgccaagaaattgcgtcgaagatggattaaacaaataaaccgtggttaggcaaatttactgatgcttcgtgggttcgttatcacataaacggatagcaaagtgattggttatccagttagtcaatcacagtcgcaacttgattattgaaatgagcatgcaacctaactcccatcttcgactggtctcgagaaaagaaaaaaagaaaaagaaaaaagcaggccatacagtacagcaacaacaactaaagcattccaagatggatatgatttcaggaagccgatagtactcgcaataatagcatcgacccagattaacaaaaacaaggcataaagccagtacaaaaaaaaaatctggtaattaatggatggatcgagcagagtaggggacgggggacctggagggtggccttgcagtgggtgcagcggaagcacgggcggtggtagacgcggccgtcggcggcgagctcctcgacggggtagaccgtcctcccgcacgagtcgcacttctgcgttgtgccgccccacgccgncgncgncattccggcttccccccccccccccctccacctccgcctccgcctccgcctccgcgccgccctggatgcttctcgttctcgccgcgcgcgcgcgaggttgtgtgtgtgtggggaggaaggtggtggggaagaggagaaggaggaggaggaggcgatgatgattagtgaaggcgaaagcagcggcagcacagctcagcttggggagggggcgggtggagggaagcgttggcgaataacggggaacggcagcgcagaggagacgggggagtgggtgcggcgtgcgctcaaaaaggagggaaggggaaatgctacgggcactccgacgagaaaaaaaggaataagagcctcatctttccgcttacttatcagctagtaaaatttaaatttttaaccttaaatttaatttaaattgattttaaggtttattttactcgaattttattttttaatctttacttttaaatcgctaagaacacgtttataaaagttttatttacaaattattttttagatcaattttacgtgcggttaataagctcgacctattccccatattaacggggccataattatctgcgagactgcgactgccctactagagacatgcatagtatgatgtgctatgttagtgacactaactacacatgaagttaagcgaaggatcgcctctctctactagcctttaaactttgacctaatattgtctgtgtgattttgaacagaatggaaaacccatagatgaatacatgtgaattgtccaatgcattttatgctttatcagttatagatggtacgcgctagtataaacggttgtccgtgctcatcaatgatccatagcgttatatgtgttggtagtgtttttcattcattgttactatacttctagactgttttataattattttttaacaagttgttcttttatttctcttacatttcaagcagtatgatcacttgcgtgaatagaaaaaaacaactttcccaacgtaaaagaaagtattttttttgtcaaacgtaaaattattgatcgttagacaagaacacatatgcaaataaggcatcttcttttcgcttatacttatgcttataagttaaaatttaaattttcaatcttaaatttggagctgattttgaggttttttcatcgaaatttattttttagctgttgcttttagattgataagaacacgtatataaaagttttattcacgaattattttccatttgcaaataagctgtttcgctggatggctccgtaaatgttgcatcacacgaacacaaggttaaataggaacctgtcatgtcaataaagttagaccgtaagatagcatctactaatattcatttaaccgtttaagaaaatggattattagacatttggtacataaaacatgtactctcagcattatcattgcctactaagggagcatttatttgcacctttaccattccattatccagagcccacccaaacacgagcatgacacgcagaccctacactatcgtgcacccacatgtcaaaaataacaaacaagagtgtgtctgtgtgtgcaacatctccgtgaccgtaccatttcaccccccgactttccccaccgaagtggcccccggcgacgatttctttcttttccttctttcccctctccaaatccgatccagcccgtcgcagccaactcttgccggtgcatatctcctccgcttttttcgtactcaccatgcatgtacctaccctacaagttccactgacagaccccgcctcttggttgaagggcccacctgtcatgcaaaggggtagcctaccacggttgatcggggattgcggattgggcttattatggccgattcgccgaaagtgcaacagggtgtggccccaccgtccggcgccgtcgatgtcatccctcccgacgccgagcggcgccgcgagcgccgtccgtttctggcggagcccgtagggcgctgtcgcccaccagggttcccaattcagccccaatcgtttgtcacgtatataaataaaaaaacttatatatatacgtgttcttaatgatctaaaagtaagactaaaaaataaactatgataaaaaaaatccaaaattaacttttaaatttaaagttgaaaatttaaattttaaatgataagtatgggcgaaaagatgaggctatagagttgatcgcaacagctgcagcaaacctaatataatgtctactactgtagatacaacacgaaaaaaattactaatatacttatttttttcaataatttacgtttatatatctgtattgtaaggatttataaaaatatacccatcctacaacggtcccgcagctctaaaaacacgggagcgacggtcccgtaaatctaaaacgcgggaccgtcacggtcacacgtgaccaaaacgcggcaccgccatagcagcgatttttatcaatgcgttgacactgttcacgcactgttttatactgttcacacactatctggcaatgttactatttggcactgtttgcatgccggttccgcacaatgggtctgcgggactgtaataaacagtgctaaacagtgtttaaaacagtactaaacagtgccgatcggataataaaatcgctctagccgcggtgccgtgttttggtcgcgcgggaccgtcgcggtcccgcattttggatccgtgggaccgtcgtggtgcagcactaccgtcctgtgggaccgtcgcgagataggtatatttttacaatttctttccatgcatatatataatggtaaattattgaaaaaaaaagtatatttacaaattttttccgatacaacacagccacagccatagcttgctgcaaagcagcacaaaagatcagcccctatatcggatcaaaatccactcacaagctgtatcatcagatttcgtggaacctattaacaaaccgataaaatccggcaaattttatcaaaagtttaaaattcactatggatttttgaacttaacggaaaaaaaaagagtggtttgtatttttaatccggttttcacgaaatccaaatcggatctcactcaggcttggttcgatagatgagtttgaagaaagatttccggtgcacgcgaaacaagaaaactcactagcaaatgattaatcaaatattaactattataaatttaaaaaatagatttatttaatttttttaaaaataacttctatgtagaattttttttaaaaaaaaacacacatcatttaacaatttaaaaaaaatatactaatggaaaataagaaagttaaagtttggagtcgaagaaaactgtgaacctgatcgctaccgtcgtatgggtgcggtgccgcacgcccgcacggcgagaggtggctgggctggcgagctattcgagtactcgtatcaaactagacaacggggcgagctttcgggcaaaagaaaaatgcgatggagtgcggccggttttttctgttggctgtaaagcggttggttcttttccgctggcaaaacctttcgttgcggcgcacacggccagccgggcaccgcgcacattctgccgggccgggggcctctcttttgcgggcggactcctggtcgcgaatcatggcgctagctagcttcgtgcacgcacgggcgggcacacggccgcggaaagcgtacgtacgtgctcgccactggagtacgactcaaatcgatcggatatcccgtgcaaatgatggtgtggtgtggtgtcccgggatcgttcgctcggcgggcacagcagcgaggaggagaacgagagctttggctgcgtgccgtggcgggaggtggaatggactaatgggggcgggggcgacggcccggccgaaatagtataggttttggatgcgagaaacggcccaacaatggcagtggtgtctgggcctctctgcctgagggacacacggacgcacagggcactgtcggtgtcaatgagcagccttgcactgcagtggcaatcggcaacttgaattccatcctccttctaacccattggtgtgacctctacaacctcctgcttcttctttttttttaacgtgtcctgtaactcagacttaggccctatttagtttcaaagttttttttcaaacttccaacttttcatcacatcaaaccttttatacacacataacttttctatcacatcgtaccaatttcaaccaaacttccaaacttcagtgtgaactaaacacagcattactaaaatgtgactacaacatataggtatagaaaaaaattttggttgcaaaattgtactagtaagggcttgtgtagttcgcgaacgaaaattttaggctgtgtcacatcagatatatggacaatcatttgaagtattaaacgtagactaataacgaaacgattttgcttggaaactgcgagatgaatctattaagcctaattaatccttcattagcaaatgtttactataacaccacattatcaaatcatggcgtaattaggtttaaaagattcgtcttgcaatttacacgtaatttgtgtaattagtttttttactatatttaatactctatacatgtatccaaacattaaatacatgtatccaaatatttaatgtgacaggtgaaaaattttcgtttcgaaactaaacagggccttaagtcaagaacacaccatatttatatcggaatggctatctgtaatcacaacctttccgaattccaatggatgaacacggggcttaattgctaacatataccagtatactgctgcacctttcatcctcgcaattaattctgctaattttgtgcagtgaatttattcacagttagcttaggtgaagctgcactcgggtggcggcactgggcgcttcttgctattgtcggtgcagtagtcataggtcaggttccccctcacgccatcgtacgccgcctgctgcgccgccgtcagcctcctgtactcgccgccgttccaccaccacgtgtccggcgacccgcagtcgtccgagctgacgccgccgccggcggcggcggcgcaggcgtcgacggcgaagccctggaaggccgcggtgaatggcgcgcgggcccagtcgaccttggtccggccgccgtccgtcgcccagtcggaggcgtcccacacgctcccccgcggccgcataggcttcgccgggaactcgaactccgggccccggctcgtcaggttcttcagcaccctcaccggcgtctcgtccacgaatatcctgccaaataattaatcaaatcgatggcttgtacatgtgatttgtcttagcttctacagaattcaggtggtcattttgtaggagttagatttatccaggttttaaatctccgtctagagctgcttgagaagggtcaactgctaaatgttatagcccgctatttaaaacactggatttatcccatcgcttattgtatgtgcaagtgtttgttggtagagacggaagatgtaactatttctactatttgttttaaaacaaaagtgtatacggccgtcatggtgacattgaactgagcttacacgaggtggaaggggttccagaggatggagtagtcatggaagtcggcagcggggtcgaaccagaggcggaggcgctgctcgcggtcgccgtggccgccgacgaagacgttggtttgaagggtgatggggttgccatccttgtcgccaaggaactcgaagtccacctcgtcctgcacgtcccagtctggctctgacgccagctacccgtgcaatttcagaaataaattaaattaattgttacattcagttaattactggtgcttagtttttagtcaatattaaagaacatgtgataggaattaacacttatataattaagtgaagttgatttagcagtttagcactcacatagtaggctgtcacaacgccggcagtgtagccggcaggaaccttgatcctcatgtggaagaaccctgagccgtacatcaacttggacctgaatccagcacctgcatgcatgataattaatttgcatgatcacatcaagctagttaagcataaaatagagagagaaaagaagcaaaaactatgatcaagctgatctaaatgctgaatctaacagtgtcatatatataatctatctgtgtgtataccagagctcttgtccagggtgaggctaatctgcgtgccctggttgaccaggtggtagccgtctccaccatatgttgccacgtagttgtcgtcgaacaccgtcgccaccgccggcggcggcgccggcgccggcggcacactatccacggccaggaggaggacggcgatggcgatgaggtggaggaggagcagccatggcggctgcacttggaaaaccatatatatactttagccaatgtttgctagtactaactaattaattaactcgattgattattgcaatggagaagttcttgtgtacgtagctcacctagctagctagctagctagcagtccgttatatagtgttgatgtgtcttgatgatgatctgatccgagctagatttgatatatagtagcaatgatcatcagatggagatttttcgatcgacaggaggatgatgatgcatgaaacggattgatttgggaaggtgtgagctgtggagtgtacgttttatctgcctgcctgcctggccctgagagcttctcatggagttcgaacagaagccaacttgattagcgttgtgtgtacatcagcttacttgattagcaaaaacattgcctttgttctatcacctgttcctaagggcaagtgctatggtagatgtgactaccatctccaaatttatctattttattcactcatgaattaagatgcaacacatacaatatatcgtatttggtacacaaatacaaatatttctaatactctcacactcttcttgaaatttgtgtagatgttgcctcttgacttagggatggctcatcttctctctcctcacttctctcctccacctcatcactctatccaatatggtatttttaagggcaacatatggaacattatagtacttgccctaatgacttcatctttgataggtcacaggaaagaaattaaccgacacaaataactaggtcatcttttacgggccgtgtcaagtagtattctcacccgatacggatggggcttatttgtaacgtgcatcttttaattaccacccttcacccatcactgatgtggtcttttagaaaaaaaaatggttttatcggaataaatttccacaatatatatacaaatgtttttcttcacacatgtgtgtgtgtgtatatatatatatatatatatatatagtgatcgactgatcgtggaacattccaccactcatcatacattggaataaatttccatacactgaaaattacaactagcatgtatttggtgctagttcattggtttcattattgttatttggttgtctcctgtgaggactggcatatgtattaagggcttgagatttgagaattcgtatgctagtgatagtggtttacggatatagtattagtccggcaaagtttagctagagtttggcttgtgtcttcagttccttgaaacacttccaatattaaccaaattattgcacttgatttagagaaatgacagaaatgatatggggaaattggttgctgacaagattccagagaataggcacggtgaaagacaccaatttcgtgatgtcaccaaccaaaccaaaacattcctttgcaactaatgctagttccaatgaaagattttgtcagaattagggttttgaccacggcaggattactagctgaacaaattccgtccaactacaacaaatatcgcctgacacaaacgacaaccaatcaatctgaggactagcctagtaaccaatggcatcgacatctcccatttttagtttaatttgtgtcgaa

SEQ ID NO: 46727 - DNA, 1335 bp, Oryza sativa
agtagattgcaagaatcattatatgtcacaattggtactttgccatttaagaaattaaacatacacccacgcaacatcgataggagtaattttggtttgcatatcaaatacagaaaactgatcaaataagaagaccggcgcatataaaattgttctcccaaaataatttgcatagctttaatacataatgtaaaaagatgtcaaactcagagagcatcgatgaaggcaagtgtgtctgtgccatcaacaattaaacatatgattggcactcgacatatctaagaaatatatgatggaaaattatatagtaatgcagcatgaagcatggtgcttcctaatcttatatgcttcctcatttgagaaagaagcatctgcattaaggaaatcatccaaggaatgcccagcaagggattagcatatttccatggaattataacaattaaacatgaactcagtcaatcccattctacatggatgatcttgcaaatttggatcataacgtgtattctttgtgtgacattcaaagcatgctattgttgtggacagtgtgcccaacaccgacagatgtgaggtctgcataattgaagatcatcacatgtgcacatggatatggcatgagtcaacaggtttaaagaacacaagacgagcacaaaacaaatccttgggcatgaacgcggttataccgggaagacaggaactcaagtactacaatactctctcctagttttaaaacagacaagctatcgtatgcccaaagtacaataaaggacaaccaatgacacttaaaaagtaaaaaactagcataagagcacttactgctcaaaatccagacatgcaaagagtgaagccattataatataatatataatgttcatcatatggtctatttcaaccaatatgaatgatcaatttgagatcaatgcttccagaaaaaatgcatatggacagttcaatgactaacctacagagttaactagtttaccaaaattttctatgacaagcataaatcatgctctattgctcttccccatgttcttctttcgtttcttcaagtagtgccaaaacaaccatgattgtgtggctaattatgcagaaagtatcccttccaagcagaagtcatggtttaggccattttttcgaagctactttgcaaaaataaacaagaacacctaaaagaaaatgtctatttccttttcgctcatctcatatacatgatcccgtgcctcagacagagcaacctgcattgactcaaccagcatgaataaaacataactcaaatgacaccatgaatagccaactggtacggcaactgacctgtccaaatttagtgaagaa

SEQ ID NO: 46728 - DNA, 1467 bp, Oryza sativa
ctgccactgagtatccaggaccaaatattcaaattgcgggaccaagtgttcatattgatctaggaaaggaaatgcaatagaacaaagcgtaacagtgaaaaaaacctttgaaagattggacataattgaattgtgcataacagcagcttcctttcccacgatatatacatcatgcaacccctctgctattgccaaaacctgcaaaaagaattcccagaaatcaacaactacagataaaaatttggatttgatcaccatgaacaactaaaaagggacataagtgcataaattgacaaaaccagagataaaatatctaatttcccagatttatgtgtaaaatagctaaattatatatagctcgtaaactaaagtctaaccaccaaagtgttcacaatcatttacaaagttgcacagctgaaaacaaacggctgacttcataagtagcaactcctatgcactcacagtagattccaacaagatttttgtgcgtggaaaggttatatttaataatcacgtacctcctctagtaacgaaccacattcagaagtcaaagcagtgcgatcctgtgaaacatgtttgaacccagataatgatgcagtgacttcagaagctcgttcatacatggacacaagagtatcctgtagattaactgggaaaatatagacagaacactctatgaggaacaaaaagaatatttatttaaccaaaagaaacacaaagcaacaaagtcatgagtagatggcagacctaaagcagattttgctctcgaagagactacagagagctgattggttactgaatacaagcttttcccagcactttccatgttgaactgactgagtttccactcttgttctgcacctgcttgcagcaagcagaaataaaactgttacaataacacgagaaaatcgtatcataaagcaggatgaactaagacaggtgcacggcatccaaattctgtcaatactttggtggcctacactcatttactgatgtcttatacagaataacactgaaaacagtaaccgaaaaaagaaaagcagtaggatgattcattgaagcctgtatatgcctgcatctcatggtggcaagctatcttgggcagttttgacacaagaacaagtttgggggtccttgatctaaacatacatacaatagaagtgcgaaaaagtagtcacttacatgtgaaagaacgatatgctgcatctagacgtgtcaggagattcaagaaagtttgctgccatgtcctgcctctgtcagtagattgtccggaagatttatcctcaggaataaggtaaattccgtctctcgatccttcaaactccaaaacagatgtgcagatgttagcaagatcagatgcctgttcttggatgacccaaagcaatttcctcctttttaacagatgatcatgaaattcagatgggattcctgaagcctttgtggttgaactgcctgctccagaagtat

SEQ ID NO: 46729 - DNA, 7491 bp, Oryza sativa
tcacacgcgtcatgcataagatcctattactatctaatcaaagcattgttgaatggaagttttaataagttacagcgtagttacggtacagatacagtatagttacaatacaattacaatataattataattcaattatacaatagttatatttgaaagtttctgaaaaaaaaattgtgacaattttttagcttgtgcttcaatcccgaaatcaattggactttttttttactgtgtgtttcaaaaaaagaaacacacaaacaattgacttctccttttaccctcaccgagtagtacgccgcatgtgatccacaccaactatgtggggactgagagtctgaaacacactgtcgctcttatctcttttcctacacagactagcatgcatgcatgtataccaatctcttgttccttttttttctcgatccgcacacacacacacacacgaaagatagcacagtgagaatcgtatcgtgtagtaggtgttcagaatttcagatcaagctagccatgctcaattatatatggtcgtgaatcacgcttgctctctcctaaacaacattttttttccatgcacgattcgtttatatatacccatattaatttgctgggtgtatacttacatgtatatcaatcattggtaggcctgacaaaaatacagaaaacgccgggctttcgagttaggaaatattcctatatagtatatcagacgctaatgagagggctgtgttcttaaaaaaaagttctcggaaagaaatgagagggctgacaagtgacaaacatcccaacgggaattgcctgcagtattgctggtgcagtagcagtgactgacatgtgagcaatactgcagagtacctgcactccaaacatccgtatatttgtgcaagaaaaagagaatggcgcaccaactgccacaccaaaggattcacatcaaattaacgatttacttgtggggcataataacaattaataagatagtacacaagttattttttaactgtgtcttgaaaaatggcaagcatataaagcacgtttttcaacgccctcaacaggatatgagtgggtgagaatatatagtatgtacagtaaaaaggtactgttaaggacttttgatcaattgaaaaataactcattttcggatagccaacatttgtcacacgatggcattgctcaagtctttaatacatattgatataaactcctgacagatataagacatgcgcatgaaaacaagcaaaatggatggttagataaaagtttcactaaattgttacagttgttgataaatattctttcagtgggtaatatataaattgccggaaacaacataccaaacgaagaagattatatgtccctttggtcttgaaatacataaaattcatacttatcagaatgattgcatactttacttgggtgagtatacagatttggatcaatgttcagtgtgcaaggcatctcagtataagtgtgaagatgatgatggtggaactaaaaaaaatgtaccaagtgaagaagattatatgcccccttggtcttcaaatacagaaaattcacacttatcgaaatgattccatattgtatcgggtgagtatgcatatttggatcaatgtgatggtggaactaatggtacagtgaaagaagaaaaaaatgcctcagaaggtggtgtgatattttcaattgtctctcgtttggaacgtttgtttgcaaacaagaaacatgctcaactaatatgttggcaccacaaagggcgtaaaagggatggaatggaataataagacacccaactgagggatcttaatggagaaagatagataggaagtatataaaacatttgtgtatgacaagaggaatgtccggattgtactcaacacagagagcatgaatccatttggtgacatgagacgtcgccataacgcatagccagatattgttattatctacaacattcctctttgacactgtttgaactgcaaatacatcattaattcatgatgccatttctaatttaagggcctaaataacttgagaacaatattaatgtgtacttcgagccactgatagaggatcttggaatactacgaaaggatggtgtaaggatgtgggatgtgcacaaacgaaagcacttcacctgtcgggttgttttgttcatgataaatcaatactgctccgctcttagtaacacgttcggtcagacggtgaaggacatgaaagcatgtttaagatgtatgacccagacaggagacaagtgattaaatcactaccggaagaccgtttatatgcgtgatcgaatgttccttggacagggtcactattacgagagatttctacgagacgatgaaagacggatcacgtccaaagttcattgcatgctggcagtgagatctgggagaatgtaaaggatatcaacattgtattcgataagtgaatggaagcgtacgtgcatctacatcaagcggtgagacatctctttcgaaaaggaattgaaatccgtctttcgggacttaccgtactagaaaaacttagatatacgtcatgcaatcgacgtcatccgcgtgacatagagaaaaatgtgtgcgaaagcttgatcggagcattgttgaacacggtatgcgtacacggtacacgtgaagaaatatgtgcgcgaaagctctaatctctctagcacggccggatgaatcaaccacgtacgcggtactcctcgtcctcgcgatccgagtccgacgacgacgaagccgccacgtccgcccgcccgcccgcgcgcggcgccaaggcaaaagaaagcacgccgcaatggcgcccatgcaagcaaagcatgtgcgcgcgcgcgcgacccacacgcacgcttctcacgtacatatcgatcgcaaatatcttgtgcaccttaaacaatattcaaatcgatcagcctctcgttcagtcgttcgatcgctcgcctcctcctctataaatagcgggccagtttgctcgtacaactcacacacactcatatccactactactactagctaccgagcactgagcactgcactctgctgctctagaactgaagctttgcattggttggttagtgagagattaattattccaagatgttgggcgggatcatcggcggcctgacgggcaacaagaacgcccgcctcaagggctccctcgtcctcatgcgcaagaacgccctcgacatcaacgacttcggcgccaccgtcatcgacggcatctccgagttcctcggccgcggcgtcacctgccagctcgtcagctcctccctcgtcgaccccagtaagctcacacacacacacacacacacactcgctgactcacatggctcgagctagctaacgccggtggcgtctgcagacaatgggaacagggggagggtggggacggaggcgagcctggagcagtggctgacgagcctgccgtcgctgacgacgggagagtccaagttcggggtgacgttcgagtgggaggtggagaagatgggcatacccggcgccatcatcgtcaagaacaaccacgccgccgagttcttcctcaagaccatcaccctcgacaacgtccccggccacggcgccgtcgtcttcgtcgccaactcctggatctaccccgcctccaagtatcgctacaaccgcgtcttcttctccaacgacgtaattaactaattgatcaatcaatcaaccaaattataatgctattcgtaatctaatcaaacgtctagtagcttaattaattaattgactggttatattgtttttttctgctagacttcactgccgagcaagatgccggcggcgctgaagccgtaccgcgacgacgagctccgcaacctgcgcggcgacgaccagcagggcccgtaccaggagcacgaccgcgtctaccgctacgacgtctacaacgacctcggcgagcccgactccggcaaccctcgccctgtcctcggcggctcccccgaccgcccctaccctcgccgcggccgcaccggccgcaaacccaccaaaactggtacactacccacgaattttcgtacctggagtagtacgatactgttgaaagatattccctgcgtttcaaattaaaaatcattttgattttttttcttaaaatttaaccaaattaatagaaaataaagcaaaattaacaacatcaaattagtttcattaaataaaaaattaaatttattttgattatatgtttattttatattagaactttttttaattttttctataaactttatcaaacttaaaaaaaatttaactacaaaaatcaaaacgacttatataatataaaacagatgtactaaattttatattagaaaatatcgcactactatattgttgaatactaaaaaatcattcgctgacatgtgggacatgtaactttgtagaccccaccgcggagagcaggctgtcattgctggagaacatctacgtgccacgcgacgagcggttcgggcacctgaagatggccgacttcctgggctactccatcaaggcgctcgtcgacggcatcgtgccggcgatccgcacctacgtcgacctcacacccggcgagttcgactccttcaaggacatcctcaagctctacgagggcggcctcaagctgcccagcatcccggcgctggaggagctccgcaagcgcttccctctccagctcgtcaaggacctcatccccgccggcggcgactacctcctcaagctccccatgccgcacgtcatccgggaggacaagaaggcgtggatgaccgacgacgagttcgcccgcgagatcctcgccggcgtcaaccccatggtcatcgcccgcctcaccgagttcccgccgcggagccgcctcgacccggccaggtacggcgaccagacgagcaccatcacggcggcgcacgtcgagcgcgggctcgaggggctcaccgtgcagcaggcgatcgacggcaaccttctctacgtggtggaccaccacgatcatttcatgccctacttgttggatatcaatagcctcgacgacaacttcatctacgccacgcggacgctgctgttcctgcgcggcgacggcacgctggcgccgctcgccatcgagctgagcttgccgcacctgcaggacgacgggctgatcaccgccaggagcaccgtgtacacgccggcggcgcgcggcggcaccggcgccggcgccgtggagtggtgggtgtggcagctcgccaaggcgtacgtcaacgtgaacgactactgctggcaccagctgatcagccactggctcaacacgcacgccgtgatggagcccttcgtcatcgccaccaaccggcagctcagcgtggcgcacccggtgcacaagctgctgctgccgcactaccgcgacaccatgaccatcaacgcgctggcgcggcagacgctcatcaacggcggcggcatcttcgagatgaccgtgttcccgcggaagcacgcgctcgccatgtcgtcggcgttctacaaggactggagcttcgccgaccaggcgctccccgacgaccttgtcaagcgcggcgtcgcggtgccggacccggcgagcccgtacaaggtgcggctgctcatcgaggactacccgtacgccaacgacgggctggccgtctggcacgccatcgagcagtgggccaccgagtacctcgccatctactaccccaacgacggcgtgctccagggcgacgccgagctgcaggcgtggtggaaggaggtccgcgaggtcgggcatggcgacatcaaggacgcgacgtggtggccggagatgaagacggtggcggagctggtcaaggcgtgcgccaccatcatctggatcgggtccgcgctgcacgccgccgtcaacttcgggcagtacccgtacgccgggtacctcccgaaccgtccgtcggtgagccggcggccgatgccggagccgggaacgaaggagtacgacgagctggcgcgcgatccggagaaggtgttcgtccggacaatcaccaagcagatgcaggccatcgtggggatctcgctgctggagatcctgtccaagcactcctccgacgaggtgtacctcggacagcgcgacacgccggagtggacgtcggacgccaaggcgctggaggcgttcaagcggttcggcgcgcggctgacggagatcgagagccgcgtcgtcgccatgaacaaggacccccaccgcaagaaccgtgtcgggccgaccaatttcccctacacgctgctctacccaaacacctccgacctcaagggcgacgctgccggcctctccgccaggggcatccccaacagcatctccatctgatctccatctcatcagatgaggctgctccacggaggcgccagcgtggacaagagtagttttacggtggtctttaccggtagtattttactttcaataattgccatgacacctacacccggaggtgtcatggaggatgaattcgttgtgtaatttccctttcagttcctaataaagaataaggaagcatatggttgtgtagcattttcaagcaaatcctccatatatctaccatgttttgaattgaaaggactgaattaccgaaaatcctttgatgaacattatctgaagacttaataagttggattaatgtctaacaaaccattaagtgatttaaattgtctgtaaactgatggcaacaatatgaacaaagagcaaaccactagtgaatgtgaatcaagccaatagaactcatctcaggtcataactgaatgatgtgaactgtcagtaaactgaggctattcttgatgcctttctcctattttcttatactaaacattttaatcaggcaaaatagcattttctaagtttggttagcctcctaaaccgacgaaagggagcaatccgagggaagtggggcccaccgtttcttccccgccccaacctcgcaacggtctcaacacttttctcgcttcccgccattttctcgtcgcctcacactcccctcccctccacacatacacacccaacgctctcccacacctctcgcagttctctcttcttccccccctcatctccgccgcctcgccgcgaacgggacgccggccaagagctcgaagctgatgagagatagcgacggcgaaggggccggcggcggcctcccgcgctcgcacccgtcgaacctgccgctgccggcgccgcactccgacccaaacctccagttctccgggacggacgatgacttctccaaccgtcacagcagctcgtcggcgacgggcggcgcgagccccgggtactactccgactacccgtccagcttcagcggcgagtgctcgccgtacaacatgtcgccctggaaccagaccatggcgtcgccgtggtcgcaccacagcgacgcgtccatggccgggctcggcggcgcgcccgccatggcgcccgggaccagcctcatcggctcgctggtgagggaggaagggcacatctactcgctcgccgccaagaccgacaccctgtacaccggctccgacagcaagaacatccgcgtgtggcgcaagc

SEQ ID NO: 46730 - DNA, 9693 bp, Oryza sativa
gaaggtgtggaagagggagctgcaggggaaagggaccaagcacgtcgcggtgcagacgctgctgaagcaggagcacgcggtgaacgcgctcgccgtgagcgccgtcgcgccggtgctctactgcggctcctccgacgggctcgtcaacttctgggaaggggagcgccacctggtccacggcggcgtgctgcgcgggcacaagaaggccgtgttctgcctcgccgccgcgggctccctcctcctcagcggctccgccgacaacaccatctacgtgtggcggcgcgacggcggcgtccactcctgcctctccgtgctcaccggccacaccgagccgatcaggtgcctcgccatcgtcgaggacaacaaggacaacgccgccgtgcccgtcgacgccgtggacagcagcttcgcgtcgggctcgtccacgcggtggattgtgtacagcggcagcctcgacaagtcgatcaaggtgtggcgcgtcgccgaggacgcgcctgacgcgctgctccgtggccccggtggcggcgacgcgccgcagatgttcgaccggtaccccggcgacccattcggcgccagcagctcgtcgttccgctagaacacgcgcccgatcaaccaatgcaccattttgatcagttccaagaagaaattttcaccttacaattgggcagatcaacgtcatgaacctctctgatggctaacggtttgagcgaattgaaggaaattgctgggttttgtttgttacacgtcctatatatactgtgatgaagacaagtatgaaatgaatagcatcaacatcatttctggccatgaacatctgaagctgcaacggcaagtggtagaaatgaagagcgtatataggtaagtttgctttcagaaagtggccggggggaatttttgatacatgctcatatatctgatgtgtactagttgaagccgcgacttggtattcatcttaaggatcgattgaaatcaagattaattgggaaccaataaaaggggataatttcaaactgtttttataggttgacgttagaggattgttaattaccctctttgaagattagcaccaaaaaagttcatcgggtgcttattcatatgtagtattcccagtttattgtgatgttcaatgcaaaacttatgctcagttatgtttcgatttggtttatcctttttatacatacttcacacttctacttgtaacttcatgatggagaatgcatgattccctaatgaacagtctgtcagatttaacaacaaagttcggttcaaaagaaaaaaaaagatttgacaaaaaagaaaaatgggcgatcaaatttggcccataagaaggggccatctctactgttgaatcatcacttcacagcccagcccattctagatacactaatggaccgtccaactctccagaggaccacaaataggaaaatcgaactctgaagcagtccagctctagctcagatcttgtgacagtctgcatgcagaacagtacagcaaaattttgttttctgaaagaaaaaacggaacagtacagtacagcatcgtagctggaagcctggaatcacatgcttatgccctccctgcatccgatattccgatcgatctgtccaaaccccaaacctgcaggtgcatgaccggagccaagggattagatggccgttgttatatccagccggcacctgccactgacacaaataagtgcaaggctataattaccaatgcacaactaaccactcccttaataatacaatcatcattcgatcagctagcataagatcagagagcctgaaaaacatcgtcatatctgaggatgacactgacgctgcaccaaaccccgaacaaacaaacaaattaatcatcatgcacgcagggaacggaaaagaggcagcagtagctacaccgacttactcccttggtttaaaaataaactaacttttaaaaatgaatccgaacaaacatttatttatgagcctcactgaggtgctctcaagttataataaaaattaatttaaacatcttatttaatcaaagggtttagatttatttatactacaaccctagttagtggtagtagaaatatggaggggcattattgttagaaaaaatagatgcgaagggtataatcatcatttagcagtgaataaacttttttttttgccttttttgatgaaatatgagcgatactagtgtaatagactatcaatgatcgatttagctgtgaaaaaacttaaatgacaaagtaacttctaattataaaagtaaattactaatttatctcaatttacccttaataatactggtagtataatttatgaatttatctagaattattttcaaaagttattttttttttctggaatagagtgtgtattaccgttttcttttcactcgtctctctcgtgtcgttgtatcgatcggcaaaaaaaaaaacttgtggcgccaactcctcccggtcctggtcccggtccgacctattcgcgcgcaggcgagtcgccggctggctcacgtgcagagttgcagacatgcagccgcgcgccaaccaccgcgacggatttgccttcaattttgcagcttctctccccgacgataatagagacagtctctctccagggatttgcatatatccaagctagtagtgtaatactaagagtactagctagcttcagatgatgacaattcgcccgtttctccctgcttgtttgtacgtagccgatcgagctagtgcttaattaattacctagggacattctgttctctcagatagttctgagcaacattccaaaatacttttttaaatgggacatgagatcgaattaaccaaatccgatggatgttgccctgcagctagctagccattcctttgtcccatgctgcacctgatcgaatagtggagtaagtagtactgctgctaattaatcagctatagctcctgcgctaaatccagggcctgattgattaaacaaaccgaagaccgcccaaaccgtcgccattggatagatcacatgaatgcagtggctttatctagctcaactaataatcgcacaaacaagctcgaaaaaaaccagcatcatcggcattgtaagctaggagaaatgataaatccaattaagcagtaatggcgtgacccaaccaagatggagatggttggagctgttggtctgaatggggctaagcaatatggcagaggttgaatgctggaactgtttctctcttggtgtaaatggcggttggcaacatgcaattactagcaggagctccaaccccggcctctcaaaggcaacaggccacgagcaagaacatggtcctgcaaggaggaggcacagtccgtgcaacaccttgtgctttgattttaactagcagtctagtacactgtatgtactagtattacttttatcagatttattttggggaatcacagatatgcagctagcttaatctggagcatatttacagttacagacttacagcagcagcaacactggttttctgaaactctgtataggagcacagcatatctgaaatcccaattataatgttcttataatgttcagctcgtcacagcggccacatgcccacatattttggcacctttccccttctctccaaccaccatgcattggtctctactatccagtgccaacgcatccgatcaggccactgtcctggtctgatgcaaccatgcaggtatatatgccatgaggcagcctgttcttcatcagtttctagttcaatttgacaaatttatggtaccatatttgtatacacgtagtaatcgatcgtgacctcgtgagtatattgtcacctgcaaacgcaaggcagccatgcccctaaccgtagtgtcagtgacagtgtgatctcacaatcagtctgcgtcacattcacgagtagggtcgttagctcgtcttcaatgcgccgtatcagctacgtagcattgagcagctgacctttcgttgtgatctcatcgacccattcattcactcatcctaccgacatatgcttgcattgtactttctccatttcataatataattttttctagcattgacaacattaatatatatgttccccgcaaaaaaaaacatccatatatatgttaatgaatctaaattatgaaacggagggagagagtatatttgtttcgtgtaatttcgcagtttcatgttcatcatggcgcccgtgcattgctggttgggaaaaggcagaagaaaagaaaggaaggaagcaggagaggagaccggtgctaaagcagaggaattgcacacgaaagtttcataatcaggttgcctgaatctaaaagcaaagtaaaaaaaaaagatagtacataaatcgttcaaaatcaaacatgatagtatatcactacagttaactgctgaattgtgggtcaaaaaacaaacattagtcaggcgctgacgagtacctaacacaaaaaggatatctgaaaccgatgcaaaattcattcctgcaatcggctgcagcagtagtactgatcatggtttgttggtgaaagattgttcttttctgctgcaaagacgaaggaagatgaccattcttgcatccctgttccttttgtcgcctccgacctttcattcccacttttcacaaagtttttcttgtgtgttgacgcaagaaagagcatcgatgctttcctcttttcttttctttttcccttttctattttttcctagccttttcttcgctgtccaaatccaaagcgtagaccaggccaagtaggtctcccctccaaacaactttccaatttaatccccaaatggaagcaaaagcaaagcaatggaaatgtgatgatccgctccgctcccatggcggcatggagacatggagtggttagctcacacacctcatcacagattcacagtatccataatccatagcgttagaccgttagttaattagtagatagtagaagagtaattaaaagtggaaacaaatgatgaggagagatttggttagaccagggaggaggaggaggacgaaggagacgtagctttccatacatgtcatagccagcaataactcggagcagatgagaaggggagagagagagagagagggtgaacttggagtgggattctgaggccaatttattcgcgccctaaatacgcctacccaccctcccaattgcactactgctactatacggcgagagcggcgggtgtatgtagctttgcttcctcctcctcctcccgattcccgaatcgccgcggctcagagaagaaggcggcggcggcggcggagatgtcgtccgccgtgcgcggcggcgcgacgaggggccaggcgtggtaagattccctttcttttgtggtggttttgtttataccaccggaaattgcgttggtttcgctgggttttttttaattttttggggttttcttggtggggatgggtggcaggttctgcacgacggggttgccgagcgacgtggtgttcgaggtgcaggacatgagcttccacctccacaaggtagggtttcgtttcttcttgcgatgattgtgtgagttgtgtctgtgtgtgtgcgcgctctgttttttcttgtggtggaattcggtgaccgcccgcattgtgctcgacgaaattcccctgagggtttcgaatggcgcagttcccgctcatgtcgaagagccggaagatccaccgcatggtgatggagcacgaggcagagcaaccggcgggccagcggcggcgaaggaggaggaggaggagggggagtgagggaagcaatgctggagaggaaggtgatgagcagacggagatagaggaagcagaggaggaggaggaagacgaggaagaggaggaggaggggcaggcgttctgcattgcgttcccggacttccccggcgggccgggcacgttcgagacggcggcgaagttctgctacggcgtccgcgtcgagctcaccgcctggaacgtcgcgccgctgcggtgcgcggcggagtacctggagatgacggaggagcacgcggaggacaacctcgcggcgcgcgcggaggccttcctggagcaggccgtgctccggcaccccggcgaggccaccaaggcgctcaagtcctgcgaggagctgctgccgcacgccgaggagctcggcattgtcggccgctgcgtggaggccatcgccgcgcgctcgtcggccgcgtcgcgctcctggttcgacgacctcgccgtcctcgggctgcacatgtacaagcgggtgatggcggccatggccgcgcgcgccgacgtgaggacggaggccagggagagctgcctcgtgtcgtacgccaggggcaccatccccggcctgtcgaggtcgatgcggcggcggctcgcgtcggcgccggtgtcgtcggaggtggagcagagggacctcctggaggcggtggtcgccagcctccccgccgacaagtgctcggggcgcgtcgtcaccgccaagttcctgttcgcgctgctgcggacggcgcacatcctgcgcgcgtcggacagcggcgtgcgcggcgctcgagcggaaggcctcgacgcagatggagcacgccacgttgtaggacgtgctcatcccgagctactccggcgccacggagacgctctacgacgtggactgcgtcgagcgcgtggtcaggcacttcctcgccgaggaggaggaccacggcgaggccgaggcgtcgacctcggcggccgctgcgatcaccgaggaggcgccggcgccggcagccacgacgctgtcgcggccgtccgccgtggccatggtgcacgtcggcaagctggtcgacagctacctcgccgagatcgcgtccgacgccaacctgaagcccgccaagttctgcgagctcgcgctggcgttgccggaccacgcccgcgtctacgacgacggcgtgtaccgcgccgtggacatctacctcaaggcgcacccgcggctggcggcggaggagagggacagggtgtgcggcgtggtggactgcaggaagctgacggtggaggcgtgcacgcacgcggcgcagaacgagcgcctcccgctgcgcgcggtgctgcaggtgctcttcttcgagcagctgcagcttcgccgcgccatcaccggcacgctgctgtcatccgccggcgccggggccacgcagacgcggctccacctccaccgctaccagcagccacggccggcggcgatggcggcccggcactccgccgacgccggcggcggccgcggcgaggcggcgtggcggtcgacggcgacgcaggacagccaggtgctgcggctggacatggacagcatgaggaaccgggtgcaggacctggagcgggagtgctccagcatgaggagggccatcaagaagatcgatggccgcagcgccgcggcgtcgccgcgccacagcgacgccggagacgacgacgccgcgtcggccgacgggtcgtcgaggccggcgaactggcggtcgcggtacggctgcaagttcagcacgcaggtgtgcgactcgcacgcgcgcaacgtcgtggcgtcgagagcgtcacggatgggaatgagcccataggcgaatcgtctgaattctgaacaaaaaatcgatgctcgagatgaaaatgatttgagaaatcatccaacgttgccaatcgaagatccagccagaaatcgccccatctgtatgatttcgcacgcttacgttgcatcgttcgtgtgcacgaacgccactgccattcgacacggaacataagggatccgtgtgtgttgtatgtatgtacgaaatgccattttgtagcctgtcatctgttacgtttcatgtgtgcttgtcgacttgctgtttgtacaaaagcagtcgcgtagatttgagttgtcagggtgtacaatacacgtgcaggtgttgccggcctcagaaagcacaagctacaaagttggatttacccttcgatccgtacatgaaatggatcttgtgccgtaaatagatccagtagaaatgtacagattgttgataacttgatatcgtcgtttttttttcctctggtgttctgaagatgaaggaacaaatgactctccaccctgagaagcatgcaaactgagagctgagcaaaatgggttggagcatggtccatggatggaattgcttcattaacatgccttctgtgttagctgtgtcactctgcatggtggcattatctctaccattcgattggactaactaaattgtaaactgaatcttttggtcatcgtaaagcctgaaatgtagcagaaagtaggcactctcgatctactttgcctgcacagtccacttctctacaatattcttgtactacaagtatttggtatagtgctatacttataacttatctggcatttctggcttattttgcaccgccactgatcgtgctccaaatgcatctgccgggttggcagatgtcccaactcccaaacacactccagcaacttttattttcctctcgagtgcccaaacctttgtgactgccttttcagtgctctgccgcaatctacttttgttgaaatgcactcttcagatataaaaacatgtaaacaatagtctgttggtgctatgtggcataatatatcacgacagatgggagacataccggtaaacaacgatgctttacccaacactcatgagccctaaacagataatgttagaatacagattgactttaaacggcatcatggattcatggctgtctgcgtttgttgtcggagaagcagcagaagaagttcagcgcatgattttgttcgttatgtggcttcaaaattcgaatccatggcctgctgccggactgttggcaatgccaagcccatgggccatggctattgggctaagaagctagcttagaacttttcttttcacttgcttcggtccatcccttgtgaggcaaaaagtaatggcttgtgtagttcaattcctgttggaatcgagagagaaaatttccacattccaaaggaggcttcagttgtgtaattcaacgaagtaggggatgtgctcctgcatattccagttatcctgtatattctgaactccaaatacggggtacttggagttccctccaggccactaataatacttcctccgtttcacaatgtaagactttttaacactacccatatttatatgaatattaatgaatctagacacatatgaatatttagatttattcacatctttattcacatctttatgaatatggataattcttaaaagtcttacattgtaaaacagagggagtacgagggcgaagacgaagctgtacgtgctgctgtttcagtttgtgtgtgcaactatgcatttttttttgtctgacgaaaccaacggcagcaggaggagttcagaactttgatgacctgacctactccctccattctacaataaacctcgtactagaatgttagaatgtgacacacgctaatagagtactctctctatttcacaatataagtcattttagcatttcttacatttatattgactagcaaaagtgcccgtgcgttgcaccgggtgattacggagtgtgtacactgacaaaaagtgttgtttggtttagacaactaatctgctaaaaaaattgtttgtttttggataaactagctgggtggcccacgcaattgcgcggctagcaccgatacagaattatctatttttaatatgattttatttataatttattcaatagatatttcattgtcttagacattgaaagaccaaatcatatcatcccccatatttctaattt

SEQ ID NO: 46731 - DNA, 5973 bp, Oryza sativa
attcctgcagccctagctttacagggtcaccattcactccatatcctagcagcaagatatgaactgttaagtatgggtagctatggatggatccagacacagcaaggatctgaagtactttcagcgttttcatgtacaatgttctcagctatacagcaatgtattgcagaattcaggcatcgatattttgggatatggactggttttagcaatggtatgaacaaaaataccctagctaagagtttgcagttcacgtggacagccatggctttgcactcccagtggactgaagacttcatgatctttaacagtaagccgtcttaagaacatgaagagttttagcaagcacgttttaaaagcacaaccaagaaatctggttcgagtatagtgtacataatattttgcatgtacttgtgattttagaagattcctaccatgaccatgttgcattgatgtaaagataggtgttcgacatgcaattctggaagtgggattctaattctaaagtgggcaagtatcacagtatttttttcctctatgcacacctcaaatatagctatattttcgcgtgaaaaagggtctggcgatattcaaaagcaaaattggaaatttatagcttgtagaatacatgaactcttgctttctttccttgtgttttattcagatacagattggtctgaaatcttcaagtatatatatagccttacagcgtgacacgttgatgatgtgccccgtgctgttaacattgtaattttttttataaaaaagaaaatcttatcatcgttcataattcctcccgttttattgctattatttgagatggagattgatcactttatctgaactcgagtacgaactggtgggcagtgtttgtgctgttgctgactagtggtcatggaaaagatagggctcgggtggcctctgtgcacgctggcagggcagcaataccctggccgcgtcctctccataaaacattcagataaactcaactcctttttccccagctgttattttcaccatgtttaatttttacctttgcattttgtatggcccaagaggccaagaagcctgtgccttaggtaaatctccagtaaatgtagcgtagtttttttaatagacaaaaatgcaccttctcatgtggataatatatttttgacccccaaaaattgtaccaatgagcatacttttattcctgttatttctttaattttcttgggagaaatgtgagatgtcgctttcggagattaggtgattttttttatatacacttgctcccagtgttaggtgatggatgacaaagcgtttgtgacttgtgatctgtaagttgagtggtcaagccgctgtttcctttgcgatttggtaccctgcgtcctgattagtggtagctaatcgcagcaattatataagcaaaccatatctctaagcgcacaggatcattgtttggttcgatacattttctccagtgaagaatcttgcctgcttttgggttggtggcgatcttgaaagctaacacgcacgtaaaataaactatgctaaatggcagggcacccggttaattatttcttttcctgcctctgggaccaacatccccggatactttcagccatttgatctagtgtcattagatatgggaatataatctcgttatgcgaattttctcccttattttgctgaaacctattttgcttaaattgcaccacccattgcaatttacacaattaaaatcaagatattctttttatccgaatgtaaccgcatccataaaaaaaaaaggtactctgctatccaaaagaaaacgttgtgttgcaaaagaatagaaaaaacagaagcagaaaaaaaaacataaaaataagtaatgctagtggcaaataagaagaacgcgaaaacaaacgaccaatttacatgtctaaaatctcaaaaaaaaattggttaaagattttttaaaaaataaaccaagggttggaattttttttctttttatttaaaaaaagaagaaaataaaaataaaaggaaaaggaaaagattaagcagaggttggtgatgctgatgcgtccggtgtggtgggtgctggggctgatcactgcagataaaaacgccacgcgaatccactacctcccaaaccccgagacccccccgcctccaccaccacccgccgctcgccgctcgcccaccatggccatggcgacggcgctccgcaagctctcctccgacgccctccgccgccagccgctctcccgcatcaccccgctctactacatggttccgctcttcttcctccattttttctttaatttttttttgtttatatcgttgccctcttgagaaatggtgcttaatccgttccatggattggtttgggttcgtgcgctctcgcaggcgtccctgccggcgacggaggagagatccggagtcaccgtacgtgctctctctctctctctctctcttgactatgtgttccgttgctcgttggtgtctgtggtttgttcattcgttttttttttattattattttgtttgtgtgttggatgcagtggccgaagcagctgaacgcgccgctggaggaggtggatcccgagatcgccgacatcatcgagcacgagaaggcccgccaatggaaggtaaccagcaaccaccaaaaaaaaagtgcgtggattgttcagtgtttggtccaccgacgcattgctgaattgtggcaatctgtttggtgcagggtctggagctcatcccgtcggagaacttcacctcggtgtcagtgatgcaggcggtgggatccgtcatgaccaacaagtacagcgaggggtaccccggcgcgagatactacggtggaaacgagtacggttgattgcgttctatcggttgcctttgttcagattatttgggtgttaaaaatgtttaatctgaaagagaaatcagtgcctgatgggagtgaatgatgtgaatttctggtggctctgggttttccttgcgtgcagatacattgatatggccgagtcattgtgccagaaacgtgctttggaggccttccgcttggacccagcgaaatggggaggtaaatcattttcactctttatcttgccttgtcatgtttttatatgaactccagctttcatgcgcatcaatagcctttagtcctcttttgtttcctgctttgggcgatgtaaatgaaaaaaaaaaaggataggggcaaaaaggttcctttggataagacacagtttttatggttccatagttcacaaaaaaaaaaaaagggattttgatcagaaaatttcttctaggttcttaatttacttagcttcctcactagtacaatgaaaagattacatcgtttataaaccactcggttcttcagtaacctgaatacaaatggtacacgagtggtcctattcatttatatttttcgaattgtttgctttcattattaaccgctttgtacttaaatttatctagaatacttattctcaaaattttagttttctttctccaaaaaggtggcattctaacttgacaaccaatttctacctctgcagtgaatgtgcaacctctatcagggtcacctgccaacttccatgtttacactgccctattgaaaccacatgagagaatcatggctttggatcttcctcatggtggacatctttctcacggctaccaggtacatgggtctggacttcttcattgcctccttactactagttgtttcagttggcatgcaagcataatgcttccttccttgttgtctttctttgtcctcacaagtttttcaattctctcatcgttactatataccaatgagtttcttccccctcaattcttagttatgttcagatataatgctcttggtactctcatcctcccatggcttagttgttcaacttcttgatggttgcagactgatactaagaagatttcagcagtttcgatattctttgagacaatgccctacagattggatgaaagcactggcttgattgattatgatcaggtgcaatgtcctccttatctgttttgttttaatgccatttaacttattgaattctctatcattcttttataggtatgagttttcattggacaaaacgtgttctttttgcatctagcagattccacagctgaaaatatggtttcaagtagcattatctaggatatttttcattgcctcatatctctttcaattgtgaaattatttcaagatgaatttctgctgacatgcttgatttgctacttctgcacagatggagaaaagtgccgttctttttaggccaaagttgatcgttgcgggtgcaagtgcatatgcgcgtctttatgactatgaccgcatgcggaaggtgaattttactgctcaatagtgcatgctgaatcttcaccttctgtaatcagtcaaataattcacttgttatgcaatctgcaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggtatatacttgagcagaacaatagcaagatagtagcgtagggtgttggtactgtttcttctccatcctgtgactctgtgagcttcaaaaaaataaaaatgcctaatgaccctctaccgtctaggttatgtatgactttgaggacaagatcaatgctgctgtcttcccaggtctgcaaggtggaccacataatcataccattactggcttagctgttgcgcttaagcaggtctgtagcacttctgatccctgatgttttatattttatagatcacattgtttgcctttgtcttggactctaaaaggactttctaacttccaggcaactactccggagtacagagcttatcaagagcaagttatgagtaactgtgcaaaatttgcacaggtatgtgttcaaattttgctaggtttttttttttatctacaatatggcttgatctttctttatttcacaacacttaataatgattttgttcttcacttagttcacctcagcatgttacgaattgcaaattattggtttttcaacatgatgaattgtgctttaacatttgaaccacttccttatctggtggcaatttatcacttccagagcttgacagcaaaaggctacgaacttgtctctggtgggactgacaaccatttagtgttggtaaatctcaagagcaaggtaagacaaacatgtgggacgctttgggtgttttgagatattttagttctatctttcagtttctcttatgagtgctcaccaataaactttcagctgcttccttttaaaaaatatcgattgatgtctatttaacctcaagcttgctgtttctgtatataaatgatagctaaatgtgctttgcagataaacttgtttttttttttcaaatttttatgccatatggggacaattatcatcctcttcaaatttcatgtttagggcatagatggttcaagagtggagaaggttttagaaaacgtgcacattgcagcaaacaagaacacagttcctggtgatgtttcagctatggtaccaggaggcatcaggatgggtaaaatctgcccctatgtggttttttttttaatttacttaaaatagatttgcaaaatctcaatatcagctccatgatcatgcaggaaccccagcactgacctcaagaggatttgttgaggaggactttgctaaggttgctgatttcttcgatgcagcagtgaacttggctttgaaggttaaggctgcagcaggtctgtcaaattcctagttttttttttgtttgaaaatgttgagaatacaaaacaattgttgcatgcattgaggtgccctcatatgatacttcaccctaggatcatcgtattcatcattttgtttttcccctt

SEQ ID NO: 46732 - DNA, 3407 bp, Oryza sativa
ctgaagagataagtgcctgatcctcagaagaaatattctgcctattccttttccatggtacagaatcaggtttaggttttctcattgcatgatgccgagaggaaacatcttttaagtattcacgtctaccactgtctccaccttgctgaccctcctttggattttctttggaatgttcttctgagctgcctgcttgcccagcttttctgcctctaatggcatgtaaatgagcatgcgaaggggcagctctagatgctgacactgatgcagctaagtggcctaacgagccccatctctcaccaacaacctatattgaatagtaatagaagttaggggaataaactacctaatgtcagtcacttccaataataatatgtggcgacggacatacctcctcaagttgttttccttcacgagctgcttgctcttttgcacgcttcaaagctttgagcctccagctagcacctccatcaccaaccacagaggaagcaagcaactggttgcctgcatttgaagggctagattcatcagggtacccactgccattatccctcaggtatggattcaattcctttggattggctttcttcacctgtcagtacccaagaagttgatgtaagcaaagcaggagagatatcccagtttagagtttagaatcactaaacaaaacatttattccatacatcttatacagatccgtagatataaatatagggtgtgttcgctacagccggctcccaacgtgcacagtacgcacggaaaacggagcagcccattagaacgtgattaattaagtatttgctaaatttttttcaaaaatggatcaatatgattttttaagcaacttttgtatataaacttttttgcaaaaaaagcaccgtttagcagtttgaaaagcgtgcgagcggaaaacgaaggaggggtttggaaaagggggtgccgaacacacccataggccgtgtttagattccaacttttttcttcaaacttctaacttttccgtcaaatcaaatgtttggacacatacatggagcatcaaatgtggacaaaaaaaaaaccaattgcacagtccgactataaattgcgagacgaatcttttgagcctaattacgccatgatttgataatgtggtactacagtaaacatttgctaataacggattaattaggcttaatagattcgtctcgtagtttacatgcggaatctgtaatttgttttgttattagtctatgtttaatacttcaaatgtgtgtccgtatacttcaaaaaaaattttggcgcaccaactaaacacagccatagtattcctgcactgaacaactgaatgttccaggggtttattaaaatatgagttaacgtacaggacaaaacatactcatccatcgtcatgaagaaaattatacagcagttacttgactaaatgtcattgctaacgaaagaaaccaaatctaaatctaagtatgaacatcataactaaatagcaacggtactcactgaattgatcacaacaagcttagcattgaaccaactttcagctactatagcttagcataaaaccataagcagaatagcattctaccatgggaatattgttcataatttgagtagataggatgcaagtgcctaataccatctgaagactactgttcagctaccaacaattaaaacatggcatcttcactgcaagtggtgaatcatatacaatattaatgcagtacctagcttatggaaatattaccatcacaaacatggcctcagctccacaaagaactacaataagctaccctgaattgcaattatatggcaaaaggtagctactaggacacaagcattgaaccataagcatatctcacatgagatgtggtaatcattacctcctcgggtgcaacctcctcctcatctttgtcagccccgccagcttggctgctctccgcccgaccactgcttgccgacttgagcatccattcgaggcccatctccttcctgacaatatcactagctctcaactcctcacctccaattccctcatcctcctcctcctcatcatcatcatcacctgcggcacctccaagcttgctcttgcgactgcctgtaacaagaggtcagcaataccaggtgatcagaaacacaactcacaaaaatcctaccaaaaagcaccatcctaacctaacctaaacaagtttagggctacttgcctcttctcttatcagattcaccactggactcctcgtcatcatcatcgtcgtcatcggagaactcatggcgccgcctctgatgcttcctccggtgcttgctccggctcaaccctttctcctcctcctcttcgatcgagtctccgctatcggacccctcctcggagtccgagccgtacttgctccgcctccgccggcgcctccggtcccgcctctcctccttgtccctccccttcctgccccgcttcttccgccgccgcctatcctcggagctgtcggaccccgccgagccggcgccgcctagggcatcctcgccgatctgctcccgggggataaacttgacgccggagagcatcgccggtgggcggcgaggcgaacgcgctagggcttcgttggttgggggagagaagcggcgaacgcgagggcttcaacggcggcggaggtggcgcgccggcgacgagccgacgagagagaggaagaggtagcgagaccgcaagggggatccagccatccagggagagagagagcctttccgtgatgtgtaggctggatgggccgggccttaacaagtgacgggtaccgatacaatcggcccatcggcccgtgttgattcaattggcccaatactcaacggttttcagcccaattacaaagcaacaccagtagcctttactacttcctccgtctcataataaattctatttttttagtaatcattatttcattggagtctgtaaaagtagaaaataattatattagaagtacataaagtaagaaataattgtattagggtttgataaaataagtgtattatagtcttttgggttgtttttttatgtgtgtgggatgggagagaaataaacttattttggatggaggaagtaaatataaatcctcgccaaatattgaaggtatgaatttgtttatctctgttccaagacttgtttgttcctcggatagttgggaagaggattagaaagataatgatctcacgatgctgacaatagggtgtgtaaatatcactttgaggtcaaaaccaaatttatgtataattctgatatattatgtacgagtattctatttgatagtttgacacccgtatcccaacttttcctgtaccgaagaaaatctgcttggactcctgtttttcattttccctcctttcctgtttcctagcaaaacaattgatacggaattcaaattacatatacccat

SEQ ID NO: 46733 - DNA, 909 bp, Oryza sativa
tgtgaaatgaatataagatggattagaattaggatctagtccaagatcattgatgcaatctctttggcataccttgttcaagcgaagctgacaaaaatgttcatatatgcagcatatgatgtttaacaaaaggcacttttagctagctaggcgcacatcaaatattaaaaataatcatgtgaaaattgctcaaggtacagaaatataccttgacgggtttggctgaacctttaatctttccccatgaaactgcttcatcaggttgtgctccagaatcactgccatcaaactcttgggctgtgttgatatagactgcataatctgcaccattgcgaaacatattggcgttgcatatatgatgcttgggtagacctccaccaagaactatgatccctgtcttccttggggttgcatgaatggcttccccattcatcaatcttatatctgccacattttcgagcataatatgagaaaaaaaattgaatgcaaaagcaagaaaaccaagcacacaaacttgccttgtacaatgtcaataattaggccaggattgcggactgcatgacagaatagcatgtctccaagcgatccatcagtcaatgctgggcagtatacaggaatattgttctgatcaagttttggaaagtcagtactatctcgtttcagtcttttgattaacagatcataacattgcacttgggcataagaacttaaaacccacacaagaatatcgaatatcgatgctggtttacgtgtcgtattctccacagatgcttaaagtatatggtctattgcaacatcatgagagagaaaaaaaacaagtgtcttgaccaaatccactcaactataagtctataactcattctaaaaagtcaaataaaggttaaaatttggatatcatgtacattatat

SEQ ID NO: 46734 - DNA, 4704 bp, Oryza sativa
tggggagaaggggagccaggccggcgaggaagggaaaaaagacttgggctggaaacggcccaaaggacatggacggaattttaatttggtttttaatttaaataattgattaaatgaactttgtattattgaaattaccactcgagcactgaaaattcacgagaaatttcaaagagtactttatggccaactatgatttttaaagaaaaatttatttcccacattaattttactttataaattgcttttaattttaacataaattatagaaatgatgtactatttgatttttaacctcgaaagaaaatcaaggcataacattcattttcagaattttatagctacatgttcctagaatttgagtgacaatctatattacctggggagctagagatctttggagaagctcccataaacataacctttgtaaaactgaacaactctcgaaaagcgctcttaagcggtacctctatttctctataaaaaaccaaataccactgatgaagtatatattgctctcgtcctaaaattaaaaaaacaaagctttgttttttctaaaaaaaaagttccattttccaacttatattctctcattttttatgtgcatatttcccgaactgctaaatgatgttttttctctctctctctctatatatatatatatatagcatgtcaaaatgaaaagctatccccagaaaacaaagaaaacgaacttaggcttgattggccgaagctccatgtcatgactgaataaagcaagggagtctctgtccgtttcattacgtctttctcttactgatctaggatcaaggtagcaattctactactacgaaacaaaaaagaacttgatttttcagggaaggacagctttctttttggcaggaatgcaagcaagctaggccagaacaaggagaaaggctaaaactgtctgagccaagaaccagacgcgctcatggcttcacactcccaccacactaacacaatatgccatttgtttggcttaataaatcatctgcatcatatcaacctttccgtcaatggtttagtttatgtttgactctaagccatggcaatggattaagtaaagcacatgcaaattcaaccactctctctcagccagccactcgctgtctcactagctttctttcttcgtcttcctcttaagaaatccaataatctttaaccgaacaccacttaacccccataatgctcgccatggcgaccatccagaaataggatgagacggcggcggccacgatgctaggcaggatcatcttctgcgtggtgatcgccgcggccgtcctcgccgtcgtcctcctcgccaccgtctccccgctgccggggcgccacaagggcggcggcggcggtcgagaccatccgtggactctcaccgtgtacatccatacgacgacggcggcggcggcagcggcagcggcagctggaaccgtgtcgccgccgcagcgacaacagcaggcgagcgcgttcgtgttccggcaccggatgacggcggggccggagagcgcgtcgaggacggtgggcgcggcgacggggttcgtgctccctgccgaggccgccggctcggcgatgtcggtgttcgacacggtgcacctggcgttcgacgtgtcggggatgtccgggagcgtctgcgtccaggcggcggcgggggacggcggcggcggcgagaaggcgccacggccgacgaggcggcgcggggagtgcggtgacccggaggtgctgcgggtggtgggcggcacgggcgacttcgcgttcgccgcgggcggggatggcgtgctccgcgcgctgtgcgcgccgcggctgttcggtggcgcggccgcggcgaaggtgttgcggcttgagctgagcgttgcgcacgccaagggctagtgcgcgtgcatgggcgaatattttgctccttcttttttaccttgtgcaaaattgttgggcttttttttttccgcgttacattctccggggaaaatacaactcggctttgatgctggcagaaatgcagaatacatctgaccagtgtgcatataagtgttgagaattgggtgatttgagtgatttgaggcccttcatttttcgtgtccaagcttgaaactgagcgtatgcttcattggttcgtgggacggtggaagcgtatactgcagtctgtttgattcagcatcgggcaacgagacatgatcctttgcagtactgtatttgcagaagccaggctgataggtggacctggtcccacatgtcagcggctgctacagcagctgcagtcctgtaaacaattcccattacggataacggggcaagctactttatcgtattctatggacacattttataagctgttaaatgatacgttttatgaaaaaactccaaaacaattttttttagtttataatagttaataacttatctagttttgcgtgaaacaacttagccaaatgaattcacccattcgaacgcacccaatgatgcatcattcgaatgctaattagcaacttcggtcattgtgtgcgcgcgtgtgctttttcttgggaggggaatgcatatcgttccgtttgtccattccgattcattttggaaaaaagtacgaattacctcccgaactatcgcatcgtccgaattacacccctgaaccataaaaccggatattctttaccccaaactatgcaaaccggacgaattacccccctcaatccaatccacggtagttttggtctacgtggtgtacgcgtggcagtccagtcagcattttagttattaaaaaaatgtgggacccacctgtcatacccctataacattattccccccctctctcctctctctctctcttcatctctctcctctcactctctaaacgcgcacggcgccacagcggcaggcggcggaggaggcgaggcagcagcgaggaagggcggcgcaggtggcgacacggagcggcggcggcggcaggggatgaggcgaggcggcagcgaggaagtaggggagcttcgccgtgtcggccgccatccctgtgcgccagcgcgtcgccgtctgcatctagcggcggcggtggctgcggctgcggcgaggcaagcgcgttgcgggtgccctaaggcctgtctacttaggccctgtttagctaatgggacagggaaatcatttcccaaccactaaaagacatctttaaatcctaaccattcattctcactctttcatttaatcctaacccttcattcatttccaaatctcaatcccacctcacatttcccattatccaaacacaccctcacattacatggcaaaactttgtcctgcaggaccacattttaacccaaacaatttgacgcacggtgcaccagaagatgaagtccgtcatgcgggtgacctgggaaacattgttgccaatgctgaaggtatagccttcatgtaatcactacgaatgcatttttgatgtttctctctaaaacaatcttcttggcatacttattttatggtgtgtctgtttaattgttgtcatacagatgtagtcggccgccacgatggaggggagcttcgccgtgtcggccgccacggcggcggtcgtggctatcgaggaaggtgccgccgagacggcctccgcgtcggcgtcgccgtcgtggccaaggaggacacccatgctccgcgcctccatccccgtgcgccagcgtgtcgccgtctgcatctggcggcggcggcggctacagcgaggcggcagcgaggaagggcggcgcagggggcgggagcgagcggcgactgggtggcgagcagcggtgggtgtccctcagatccgcccgcccgcagcgcccccgcctcgctcgtcgcacgcagtggggctcgcggggatggccgtggacggcggcacgagggggcgggcgcagctgggtaggcgaggctagaacggcgggcgagcggaagcggcaccggccccgcccaccacagtcgccctggtcaccgccctcgcccccgaggtcgccggcgtgcagctcatcctcgacggcgccgacctcgccaagaaatcagtagctagtcagcctccgccagcgccgctcgtccccgtgccgccggtcgccgcccgcccctgcacgccgccattcactgccctcgcgccgccgcccacctctcgcccttgcgatgcccgtggaagagagagagagaaagagtgaagatagagagaggaaggagaggtatgacactatgacaggagggtcccacaatttttttaagaaaaaaattgctgactggactgccacgtgtacgccacgtaaacaaaaaccaccgcggattcggtcgaggggggtaattcgtccgatttgcctagttgggggtgaagaatgtccggttttatggttcaagggggtaattcggacgatcgcggtagttcgggggtgtaattcgtactttttccattcattttgcacgatccatgcctaaaatccaatgtcaaccaaggccatagtccactgtactgtggcccagggaggcccagcccacttggtgttgtaatatctcagaaggaaaaagtacaccgaaggtccctcaacttgtcatcgagatacaaaatcgtcccccaaccacaaaacatgatatgtggtacccctcaacttacaaaactattcattctaggtccttcgttggttttaacctcggttttgtccgacatgacagctgagtcagcgcgggacctgcgtgggccccacatgtcagaca

SEQ ID NO: 46735 - DNA, 5775 bp, Oryza sativa
tgagcatagtttttttttaaaaaaaaagtggtgccgttttcaactgttttttttattctggccatgtgtaaaatttgttgcaaatatcacagtgatgtactagttgttcgttgttgtggttatgtgattattgcagtgacgccctgttccacgacaattagttattactggatgaaattgtatataatttttttgagataataatgaatgcaatctgtaaaatggcaaagaaatcggaaactttacaagcaaaggtgtactgaatatatgatatatgggagttacagattatactgcaggttatcaatctcgaccaaatgataccaatgtgcagctgaaggggacagaagaaacgatcaatcgaggagaccgtagagtagagtcgctgtatcgaaagaaaaagttgagtttgatctccagccccgcacgcgaacggaaaaaggagcagaaaaccccaaactgagatgacgaaagatctccccgccgctgcgtcgtccgtccgtccgtccatctgaacgtagctcacattgttgcgttagttccagctggttcacagccgctctcctccgttcaaacagctgttttttacaaaagttttatatacgaaagttatttaaatattatgtcatttttctaaaaaataatatacacttaattaatcacatgtgaatggatcatttcgtttttcccaatccaatccagggaaacgaacgcagctgctgggatcggaatgaacgcagccgctcggaatgatcggccgcacgcgtgggcgtgtgtgacttgacgaggatgtgtagtgtagcgtcgcaggtaacaggaggcggacgtgtgcggctcccggccggcttacgccgaggccggcacggcggcgcacgtgaggcaaacaccggccgctcgttgaaggcggtgcgtgctctatgacgtcgccgtctccgcgtgtgcctctgaagttctcaactctggcacgtgtacggtgcaccctgcgtcgatcacatggtccattggctccagccgacgatttccatcagaaaactgtttgtgttctacaacgtggtaacagatcagaaccgtaggagcacgtagaatttttctttttttagaaaaatacgagtgatattacagtttttaggaggtatcgaaagttgctatattttcgaatgtaaaatttgtataaaaaaaaggtgtagctatatttatggcgccatatttttcacctaaaaatagtcggcgtgtatttacattgtaagtctctaaattacatatgtaaatttagtgtatttataatgtaagttttaaaattacatatgtaagtctcaaaattacatagtaattatatgtgtaagtgggatgtaagcggggtataaattgtgttaaagaaaaggatgcatacatgtagcatgaaattaggtgacgtttcacttggatttgcatgactttagagattagctagcaatagcatatgctttcaggtctcttcgcgaggaaaaagtcagtatggaagcacggatcttaaacacagatccaacggccagataaccgactgtaatcaacgaaaaaaatctgtcgacataattatagcaaatccgaaaaaaatggtacgtcttagtatctctcgcgaactgtaaaatttctttaaaaatattccttttcaccggtttcataggaatacgcatgtttcaaagaaattgtcacagatatatcgttatcgtatagcgagaataagaactcacgacgagttcgcacagtgagtacacaaactcgcgatgtttgcgaggaatagcgggaacgatccgcgccaccacgaactcgagagcgagatcgctgagcgaactcgtgagtactcgtgcatgctagtctcttctggtttgctgctaccacaagttcacatttttagaccattcacggtgcgccacaagaatttagtgtgcgtcacatgccacctagacctaagaacacccaagaactagatggatacatactccacggtgcgtactacttgcatactactttataaagggtcccacagtgtttcccatctcctctgtccttcttatctcttctttctcccctctttgctcttatctcttttctctcacctctctacgtctcccacagacggtgaggaatggtggcgatggggtggctggtggtgccggagacgggttgagcggaggccacggcgccgggcaacggggcgacctaaacggccgccgccgccctgctcgagtggtggcgacggctccgagccccggggcggcctgagcggagggcggcgacgactgtgccgggaggcggcgccagagacgggtcgagctcgccggctctgaaccggcgtcgacatcaagctcctatgcctctctcttctccagccggccgtgtaacatcccagcctagggcttaatagcattaatacaatactcatatcaacaagttataacttctttttcggaagccgatcaactctagggttaagcgtgcttggtctggagcaattttggatgggtgaccgaccggaaaattcttcctgggtgtgcacgagtgaggacaaagtgtgcagaacagacttgtgttggtctataagggcagcctatgacctatgaaagctgccaaatgtaagagggcctggcataggagaggcgggacgttacacggccgtccccttctcttctcctccgccggcttttactgggagttaaattttaactcatggtaacgtggacgaatatcggacatccatttctcgatccaacggtagttttcaagttaccactacatatgtggtttgtactacatattttcccgcgagacggggttgggagcagtaggacaacgcatcgcgaatgtgggccccctgtaaaactaacgaggaacgggtggctaaagttggctccacggtcttgagcaagccgcgcggattgccaacgtgccaccaatattcggtttttggggtgaggctgtatgccacatggaagcattgtgaatggccttactaaacgtttgtatccttgctccctgacgatggtatatttttaccaattctttctaaacatgtatatttttataaagccggtgaaaaaaatatattttcctatatttttcggagctactactgtgtagtgtggtacagtaatataccaccccttttttatttttacagcgaatctgtttgcgatcgactcagcgttgttgcagagcgagagaagtagcggttggcgcaccaaccattgaacctggcaaccacgtctcggcgttttctcttgccccgttaacttcagggaggctacttgtacacggatgaactgtacgtcgagctgctcctcctacttcacaagtcagcatttcgtactaccattggcagcgactactcctagttgaaaccgagtggtaacttctccctacagtagtgactgctactactcctgtgctgtgctcaacttctggacctgcaacgttaacggtgcagcttggcagatgcattcgtccaggttcagcgtgctgggcagattttttttttaagataatggaataaaatatcccggcctttgctcatcagagctatagccaattattacaaaagtaacatccaaacaccgagtgtagtttaaatgaattaaacacacccaataaaataaaagatcaaactaagataaggagagcatatttattcaagtttatttgtgaatctctatccatagtttgcaaggagttgcatgaccgttgtctcaagcctacgacatgcaaccttcaataagctcgcgatcatcttcacacatttgcaactgtgcctaaaatcggagccaatatgttgccctggaaattacctgcatatatgagatagatgttgatttgtcaaaaaccatatcattcctagtcaaccacagagcccaatatatggcagaagctcctacaagtatgagtttgctcttcttcttgtctacccccaagagccaaccatcaaatatattagatatggtagtatgaagttataaaccaagagagaactgtactgctctccaaacaaattttgcataatgacactctataaaaagatgttgaatagtctcatttttcattaaaaaacatcatcttaaactgccattccaatttcgtcttgccaaattatccttggttagcacaacccctttaagcaagtaccacataaaaatcttaatcttaagtggcatcttaagcttccaaataatcttgtttctctcaatataaccattattaattaaagttagatacatcgacctaacagaaaatattccattctgatgataattccatctaaagctatcagaggattgattcaattgaatatgtacaatagaagcacacaattcatgccaatttgcaagattctgaccaactaatgatctcctaaagaaaacattgagtggaacagatctcataacattagcaatagtagaacttttccttcggacaatagagtataaagatggatatttgtctttaaaagccaggtttcctagccatttatcttcccagaaccttatttgtttcccattatttacaatccaagaatccatatctaagaaaatatctttgaccttcatgagacctgaccaaaaatgagaatcaccctgtttcttattaacttgggttataaactgattgtagagatactctcttcaatagattttaccatacaccttcctcgttaatcaacttaaacaaccacttactcaagagacacttgttttgtatttccaagttatgaacccctaaacctccctgatccttaggttgacaaatgatatcccatctagtaagtctatacttttttttatggttatccccttgccaaaagaatagtgatctataataatcaattttttgaagaacccctttcagtatctaaaaaaagatatcataaacatagttaaacttgaaagtacagagttaatcaaaaccagtctacccccaacagataaatgttttcctttccaactaagttttttctcaattcttttctcaatcattttccaatctctattattcagttttctaacatgcattggtataccaagatatttaacagggagagagccaaacttacaaccaaagatgttagaatactcatcataatattcctttgcctgaccaaaacaaaataattcactcttatgaaaatttgttttcaagccagacaactcttcaaacacagataaaatcaatttaagattcttcgcttgttgtaagtcatgttccaaaaaaatgatggtatcatctgcatactgtaaaatagataaaccatcatccactaggtgagggactaccccattcaatgaaccaacatctttatccctcttaattaataaggtaagcatatctgttactatattaaaaagaattggagataaaggatctccttgccttagacctttgtaagtttgaaaattattaccggtctgatcatttactctaataccaacatgtcccccttgaataaaagaagttatccactcacaccatttaggagagaaacctttcattctgagcatctgttgtacaaaagaccatttaaccttgtcataggctttttcaaaatcgatcttaaaaatcacagcacttttatttttgcgatgtaattcatgcatagtttcatgcaaaataacaacacattccataatatttctcccaggtataaaagcagtttgagtagggctaatcaccttttgagcaacactcattattctattcgtagcaactttggtaaagatcttaaaactaacattaagtaagcagataggc

SEQ ID NO: 46736 - DNA, 3826 bp, Oryza sativa
ccattgctttcaaggtggagctgcaagcccatggggattcccagaagagcgccttcctaccatctccgattgtcactgacgtggatgctgcaaagagctcgttgtcctgttcatcacagggtgttggcatgccgatccatggcttgtcgggggaggtccattcataccatagccatcgcaggcgaagcgcccttcccatcttggtgagattcgagacccccagaccgtcatactttaggggcctgcaaacgcgctgtcagttcactttacactttccgccattgacttcatcgccaccgtcccagaggaattttcttcttactttgtcaatttcttgaatgatttgctttggtattttcagagctgtcatggcatagattggcatggagcttggtactgatagtactaactctcttcttcctcctgccgagaggagctttttcttccaactggctaatcgtgccttgattttgtcaattaggtattggcgatggacctttcggagcctgcttatcatgagtggcatccctaggtatcgcattgggaatgtcccgcgggggccagtaaagttgtgtagcatttcatcaaggtcaatttcaccacagctgattgggatcactgagcttttgtgaaggttaaccagaagtccagtagcactcccgaagttattcaagatcgaaatcaggctgtccacatcttgtcgtgatggtttgatgaagattgccgtgtcatcagcatatagggagcatctgaagcgtgcactgcggtccgctaggtcactgaggaggccctcatcagttgcaatcttgagtagtctatgtagggggtccatcgcaagaataaaaaggtatggggataggggatccccttgccttagccctctatggtgatcaattctttctccctcaatcccatttagtgcaaccctggaagaggaggttgagaggattaaagccacccagtctcgccatctagtactgaaccccattttttcaagcagcgttaggaggtactcccatgagaccgagtcgaaggccttggcaatatcgagcttgaagaatagggtgggctgcttggacctgtgcatcttcttagccaggttggagacatagaggaaattgtcctggatgcaccttgttatgatgaacgcactctgagcttgtgatatcactttgttaatttgtctggataggcggattgccaaaatctttgcaaggagcttcgctaaggagtgaattaagctgattggtctatagtcgcccatagtgcaagcatcattctttttggggatgaggatgagtgtcgctctgtttatactcccgaaatttcctcccgataaggagtggaatttgtcaagcaattccatgatgtctgacttgataacctcccagcaacatctgaagaaggtgcctgtgaagccgtctggcccaggtgccttctcagcaagcatccgtttgatagcttcccaaacatcctcctcggtgaagggggagtcaagatcttctggcgtcacctggggtaggtgaagctcctcccagtttagggtgcaagagcgagggagtcgctggcccatcagagaggagaagtgttcgtgtagggcacgctctttggcttcatgagtttctgggatgacgttgccacggtggagtttgtgaatgaagttcttccgatggcacgcattgactttcaagtggaaaaacttagtgtttgcatcaccctctttcagccatgttagtgtggatcgctgtcttctccttgccttctctacagcagcaagaccaagaatctgtagctttagatcttttctgagggagatctccaagggcgacaatgctctgttttcttgtgcaatgtccaaacggaggattagctcatttacgagatggaattggatgcgactgtcacttaggatgcgattgctccaggaccgtagagccttggctgtagctttcagcttggaactcaagcgcttgacagggtgagaagcgctaactggctgggaccaagccgtctggacggtgtcaaggaagcccggcggtcttggccaaaagttttcaaatctgaaagttggttttcgcagcagctggtgtgttggtgagagcaacagggggcagtggtcagagttggaggaagagagagcttgtaggttgtggttagagaagagcatatcgccatctgggttacaaaaaatccgatccaacttctcgagggttggggcatctctctcgttactccaagtgaatcgtctattttgcagtcttaattcacggagttcacatctatttatcgcagccttgaaccgccccatcaatcgacgatcaaggttgaggttattcttgtctcttgcctcataaatcaggttgaagtcccccataatcagccagggggtctgtcctgatggtgccacttcgcacatttcctggaggaagttttccttatcagcgtcatccgtcggtccatagacgttggtgaggaggaatgccgtgtttgaggaccgttgggtgagacggactgagagggagaaatttctgatgttgatatcactgtgctggaggatatcatccatcccaaaaggtagctgctcctccacggctcccatcagcaggaaggtagctgaaattattcagtcttggacccccaatttccgaacacattctttggtccatgattgccaattttgtatgttggaggcacatgatggatatgcggttggtggttgccacttcgcggattgcttctctttttgccgggtagtttagaccccgcacattccaacacatgatatgttcactaatcattgcacaacgagacaaccattctaaaaaggcagcgtcttataatctcagcatttgaaccaatacattgccacagcagtagccaaatactagttactatcctgagcctcacacagactagaggaatgcactgcttatttcttattagcccgggggcttaaggcccgagccggctaatagagcaactactaggggggagcaaagggtgtgaagcacccctgacagcccagcgctaatctcttacaacacggacagtgactgactaatatggggatggtcgcgctcctgcatggtgatggtgagacgcacgcctaagccgtgccggtggtgatgccatcctgtccggcgaagtccgacggaatggaagctgggtcgtcgaggcgggtgaggcagcggaggccggcgatgacatgtggcggcagtggcttgtcgaaagccttgacgaacgccgcaatcgcctcgtcgttgaggtcctcctctttgtcaatgaaccccatctccttgaggaggcggccttcggtgtgcttggagacgggcaccgagaaggggcgtgctgcctgtctcgcactgtgcctagagggcaccatcttcaccttggagcggccacggcgtgctggagcggggggcggcggctgagggagaagcggctcgggtagaggctcgaacaggcgaggtggcgcaggtgcgcctggaggggcgatgtgggccaggccgtcgccctcgtccaggtagcccaccacgtcgggcaccacctccttgctggcttgggccgccatctcctcctgtgccgccagctcctcctgggcctcaaacccggactgggcctccagcagaggatgggccgtaggggcgctgagtgggattggaggaagcttctgggtagcttcctctaccccaatcgccacctccatcgtcatcgggtcaatgctgcccaggcgcatgccatccatcgccgcagtagtctctgccaacatctgtgagcaaagttgcagcgagaggtcagagagcacagagagggttagggttagtgg

SEQ ID NO: 46737 - DNA, 1090 bp, Oryza sativa
tatatatatatatatatatatatatatatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataattaggtatatactcacaatttaaaaattttgaaaaatttgagtgattttgtgcattagataccatggtgcccgggcaccatggtgccccatatgagtgtcatatatatatatatatatatatatatatatatatatatatatatatatatatatatatataaaagttttatttataaattatttttcgtttggcttcttccggataggtctctaggtttacgtgggatttttctggagggagacaccacaaattgcaacattagtactgttggattggatggatacttgtttggcatcgatcaggttggccacttggccacagtgacatgaaaaaggtgtactaatgacggacaaggacgtgacgtggacgcctggggggtcgtcattaactcgaggttaaagctcggaatagcatcgttgggtgacgaggcgatggacctctccgcgctgttcatgatatatttcaccgtcgctgactagtggccccccccccacccacagtctcgttccccttcgcctccggtctccatcccacccgcccgtgtgggggaccgtgtgcagtgcgacccattgggttcggactcgggctcgacatgattttggccggctgcggcgtcgatcgtccatcatcgcccatgccgtcgcgcggtatttgcgagatttgcccctcaacatgtggtaggatttgctccccggaatccggctaaaacctcccattaattg

SEQ ID NO: 46738 - DNA, 1608 bp, Oryza sativa
gcccccacctcaccttccgccgcctttgcctcccgctttctccaagcgcggcagcgccgccgccgccgccgccccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggaggagggggagtgcgcgacatggacgcgctggagggcgtgcgctcaatcgtgttgaagccctcggagtccctcgacgaggggcggttcacgaggatcgccggcgccgacttcaacgacgccggcctcggcctccccgggctgctcgcgtcgctcgccaccaccggattccaggcctccaacctcggcgacgccgtcgacgtcgtcaaccagatggtacgttactaattactgcaccctttgcagccttcctgccttttgcatgcccgtgagggaggcgaagcggatttgggggttactgtagcttgaaattgttgtgtttctagatccttggagtttcttaggaattgcaatttagacgaggcccattgctgtagctgtgttggtgtaattggagctgaagaggtgaagtcatgtgctgaatgatgcgatagatgtggttgctataaaatcggaaacttgcagcttattattcatgctagggttgacactctactgatgattatctcgataattcctgtcagatgaaacagttagcaaatttgaaatggtgtaggtgtataaaaaatgctaccaaatttacttatttacattgtgaatttattggacaactccaaatgtacacttgaacttcctcgtaagtgatctggaggtaatccagatgaaaaattatgaaaaaaaactctctgttaccatcttacatgtgtgttccacgattttccactttaacatttccatgatattttttaacacctttaagatgttctgatactccctaaccctttctattctgttcttgaatgcactgaagttagattggaggctgtctcacgagaagccacgtgaggactgtgatgaagctgagcttgatcctacatatagagaatctgtaaagtgcaaaatattcctgggattcacttcaaaccttgtctcttctggcattcgagatgtagtccgttttctagttcagcatcacatggtgagaatcgcgttgctgtaatttccttttatgacctggtttggtagagatggttttacatgcttttggtaacatactagcattatcaaaagcattgatatcttatccctatgatgtagctaatcccccttgaaaaatgtgttatttaggtggatgttattgttacaactgctggtggtatagaggaggatctcatcaaatgtcttgctcccacttatagaggagaattttctttacctggaacactgttgcggtcaaagggattgaatcggattggaaatcttttggttcccaatgataactattgcaagtttgagaactggatcatgccactttttg

SEQ ID NO: 46739 - DNA, 997 bp, Oryza sativa
tgcaccttttatgtgcatatgctgttcagacttccactgagaatcccattgtaatattaaggctggtatattgatatgtgttacttgtacattcccagatggccagaactgaggaatgcttgacaccattagtgtattcggattactagaaattgtttttttttcttctgaggaaaaacttttcttttgatgtttgacaggcaaacacaattttacttccactcgaagcctcattgtctgctgatttagctgttatgtctgaagcaatctcaaaggaaagagagaagaataataccagcatgcctcttattcatggaaaggcattataccaatcttacattattagaatacgggatgcttacaaaaatttagaacctctggtgcccccacttgctgacgatgcgaaggagttgcactccttgatgactaagcttggacgcctttctagtattcatgcagggagccttcataaggtacttaactaagacccagttactctgagttgccgttaattatttagagaaatcttttttaattatttgcatttcaatagcaatactccctccattccataatataaggcacaaccactttttttagatgttccgtaatataaggcatgcatgcatatagaccattaactatgacctcttctccattaaattattacttttttaaatcctccactctcatgttctctaattctattggatgtatgtattgtatttattaggatgatccaaactacaagatgataataattattttcttggtctttgggttaggggtgtgtcggtgacatgggaccgggagtattatgacttagagacttgaggcagacacgatcacccacgtggcctaaccccctcgggggggggggggggggcgggcccgagggtgatacggccgcccttctctttgtctccccgaggggtcggaccgctcccgtctcggccccgagggccgaggcgccccgaccccttgtgggttttgcgcc

SEQ ID NO: 46740 - DNA, 13756 bp, Oryza sativa
ccccttgagatataaaaggaggaccttgcccacttaaagaaggaggagaaaaaaggatcccagaacgattgggggctggctcgcactttgtagcttcttcaacacagatcccccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcatctggcgcgccaggtagggggctctgcgagtgatcttctgagctctcgcactctttcgtgtgcgccaagctttttctgttcagcccaatggccgaacaagcaaaggcgcacaacctctctccgagcgttagcggtgacgatggggagccaaacccacgccgtcgagctcgtactccaccgccccctccacgccaaagtcctaggcgggaggaggcgctcgagagggtcgaaggatctgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcttccgccaccaagacctctggcgctgctaccaccggctccgtgtcgtcaaggcggagggcgcggcgagcggcggctgttgctcgccattcggccaccactccttcgtcagcgcctccgacccaggaagatctgcgtggggggccggatgcccgcatcgatatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgatgggagcgtcaaccccgccgagtttctccaggtctacacgaccgggatcgaggccgccgggggtgacgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacctgcatgcagtccagcgaagggatgatgagtcacttcgctcatacattcagcggttctgtcaagtccgcaacaccataccatgcatccctgcacacgcggtgatttacgcgttcagggggggggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgggcgacaaaaaggaggccgacgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccctggcggttccttccggcaatcggcgaagtgaggccaagcagaaggcccccgccgaggacattgatgacggcgatgatgacctaggtttccaagagcctggggccaccattgccactgtcgatgggggagcgtgtgctcacgtttctcgcaggagcctcaaggccatgaagcgagagcttctggccgcggcccctactcatgaggcgacacgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcgttgatggaggagcagccctcaacatcctttcccccgcagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaactttgatgtggcggacctcagtctgccctacaacgcggtcttggggaggcccgcgttggtgaagttcatggcggcggtccactacgcctacctccagatgaagatgccgggccccggtggccccatctctgtacatggcgacctcaaagtcgcgcttgcttgtatggagcagtgcgcggaccacctcgccgccgcgtccaagcccgagggtggcgacgagaggcttggcacatccgcccccgccgccccgaggcagcggatagtcacatgcgacgaggtcctggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgacttcaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactaaaccccgataagtgcgtgttcggtgtacctgcgggcaagcttctcgggtttttggtctctgcccgaggcatcgaggccaaccccgagaagatacaagctatagagcggatgcgcccccccagcaagcttagggatgtgcaatgcgtcactggttgcatggccgccctaagtcggttcatatcgaggctgggagagaaggcgctacccttatttaagctcctcaaacgctccgggccgtttacttggacggaggaagctgaacgtaccctcactcagttgaaggcgtatctcagctctcccccagttctggtcgccccggagccaaatgaacccttgctactctatttagcggcgaccccgcaagtggttagtgcggcattggttgtggagcgcgatgaggacaatcctcattccgcgcacccccaccctgtgctggcttggcccgggagagagcagggaggagaggcccccgagccgaacggtggcctaaggcccccgacgaccggagcaggccctctgcccgcttgtcagacggtgccaggtgtccccgacccccaggatggcccgagggccactgcgggaaggccgcacctatcgccctctgaccccgaggctaaccctgtgccggttcggccggggagagagcagggagaagaggcccccgagccgaacggtggcctaaggcccctgacgaccggagttggccctttgcccgcttgtccaacgacgccaggagcccccgacccccaggacggccccgaggccactgtgggaaggccgcccctgtcgtcctccgaccccgaggtcgtcggcacagaagacaagtacgccccgcgaggccgcttggatgaagagtgccccagggacgtggcccctagcgaagaggatcggccccaccgaaaggtgcagcggcccgtctactttgttagtgaggccctccgggatgccaagacccgataccctcaggcccagaaaatgctttacgctattctgatggcctcgaggaaactgcgccattatttccaggcgcatcgggttacggtggttacgtcttaccccctcggccaaatcttgcataatcgagagggtactggacgggtggtgaaatgggcaatcgaactttctgagttcgatttacactttcaaccatgccacgctatcaagagccaggccctcgccgactttgtggcagagtggaccccggctcccgagcccgtctcagtccccgaagccagctcgggcccctcgcagctgcctcacaccgcccactgggtgatgcagttcgacggttccctgtctcttcagggcgccggtgcgggggtcacgttgacctcgccgagcggagacgtcctcagatatttggttcgccttgactttcgggcgaccaataatatggcagagtacgagggactccttgtgggactcagggtggcagctggactggggatccgccgcctcctggtgttaggcgactcccagctggtcgttaaccaagtctgtaaaggagtaccggtgctttgacccgcagatggacgcttacgtgcgccaagtacggcgtatggagcgtcattttgacgggatagagcttcggcacgtgcccagacgggataacacggttgccgacgaactcacggctcgcttcctcgcgagcccagaccccaccgggcgcctttgaagaaaggcttgcccagccgtcggcgcgacccgaccccttaggggagacgggcgcgcatgacaggcccccgatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatcaaggcaaatgcggatcccactccgcctcacgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatatcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcacctcacctgcccaccccagaagcaacggccaagtggagcgcgccaatgcggaaatcctcagaggccttaaaaccaagaccttcaacatcctcaagaagaacgacgattcgtggatcgaggagttgccagcggtgctctgggcgaaccgaaccacgccaagccgagcaaccggggaaacgcctttcttcctcgtctacggcgcggaagtggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgtatattcttatttctcttatatctgtatttcaataaaagtattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagaccatcctcgtctcatacacaacaaatagaattgacacaaaaaatttttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccactccgacgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgctccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgccgctgcgcgccctcgcgtccagctccttctcccgcgcctcgagctcagcggcccgctggttcagcgcggccctctcggcgcgggcaccttccagattacagcgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcggcacaggcggcttcgtgcaccgctagtgtgacctcccgaatagcaacggcggcctcgcgatccgccaggtccctctccacggcgcaggcacactcttccagcgccatggcacgggcctcaagggcttcttcgcgccgccgggatgccacctcggtctccgccgcccgccgttctcgggcagcggcagcgtcaaggaccccccgggcggcgtcgagctttttccctagctccgcctcccagctcccgtattgaaggcggagggtgtcctgcgcctcgttcatcacagtggtggcgatgagggcagccccccgctcctcctccacctccttggcgatctcccccagcaccttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgtttgcgacggccaaggcctgcagaaggggttctgcgctcagtggaccagcggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcgcgagctgcttcggaagtcgtcatcgcctcggcctggcgaagtctagcctcctcccgagcggcttcctcggtctggcgagcccgggcggcctcccgagcggcctcctcggcttcccgaaggtgatccgcggcttctcgctggtcagattcccgcctccgggcctctgcggtcgccgggtcctcggcctcggactggccggacttggaatggcgggagggacgcgacgggatctcgctgaaacagaagaaagatcagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggggccatttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccctgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgactccctggtgggtcctcatacagtcctcggacccggtgtactcccaggcgccccgggcgcgccgctggagtggcgcgatccggcgacgaagatagtcaccgaacaccatggcccctgtgagcccttgggatcgcaggcccgccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccaccgacggcggcgacaccggctgtgcggtgaagaaccaccggaacagccgaagggatgggcgcaccccgatgaacatctcgcacaggtgcgcgaagatggccaatgtcattaccgcgttgggggtgaggtgcgccatctggagattgtaaaactccagaacatccatgaagaaagaagaaaatggcggaaccagccctgccatagcaaaagggaggaagaagacggaccgccccgagtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcaaaggtagggcacaggaaacaaggagttagggcacaagcggcgaagacaaggggaataatggcgagaggaaggaagcaaatctcttcctcggcgactttatacccttgccaacgctaagcccggctcctcgtttcttgcgcccactatctgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggcaaaacgaaccagctcgtcccgattcgcgtgttactcgagtaatgtggcagtcttgaagagactgctcattattgacagccgagtaaccattgccgatgtgcgtgatttgcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtattatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgaagtgcagcgcgctcgtttatccggtctgtgatcagtcacagaccggtcagatcatgggttaggtggcgacaggcggtctgacgcacgcctcgccccatcccgtcaggacaagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagggaagtaagaaagagagggagagatggtgcatgtggtatccccttgagatataaaaggaggaccttgcccacttagagaaggaggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggctgcgcggtctcccggtgaggagccccacgctccgtcagggtggttatgccttatattttggaatggagggagtaatatattttcagatgcttgatctgatttgagtattttagtcaattttcacatttctttgtgacaacagcaattaactttgtggatttacggagcttccttgcttggggacagagccttgaggatatgggtcatagtaccctttgaaatccttaccactttctggaatacatgtccacctgtaggatatttaatttggaaaagattgaaatttttataatactctaaacgaaataataacgataatttcgatgtaaaatatgattcaaataattcaaagatatattgattatcagattgaactgcatgatacttgagaatttcgtcaactcaagattcaaacactgttgctttttcttggctatgctgaactgctgcagaatcaaccatggaatgaattttatgtttttctattccctccatcccaaaatatgattttcgcggggattaaggtgagggatgacagtaaatgggggatggttgtgattggttgagatgaggaagtagctggagaaattaaatgagagatgattgtgatcggttaaatgagggagtatgtagagaagttgctatattctgagacaaaatttgaacgatacaaggtgctatattttgggacagagggagtacttgattctttgtttaggattaaaattccaatttaacaaaatgtctccagaagttcattcatcttctcttttccgcaggctctagaagttcttggtgaaagtgaaactgtgaagtcacaggatatgccttcaacacatgcagatattttgcagagtgattcatcaattgagaaggataaaggttcttctgggagcagggaaggtggatctcaggatttagtaacgaccactgatctttctttacaagatgaatgctggatttctcctcccgaacactcatatacaagcagttctggatataccacagagttaacccagattacttcttctgagaacatagagaatatggatcccttattggttgacaggcctgtgatagaagctcctggtgctaatgatcaggaaagaggggctgattcggaatcagattcaagtagcaataagcagttgttcataaacaatgttacattgacgaatgttaatagtgttgatgaggttgaaatctcattgtcaaaggagaggaaatctgaaaatgagaatacaaatttgccattcaaacagattagaggacaagaatgtgataacagtgatcctaaatcctatccagattctgtgactcgattgacaagaggtaaaatgaacaatagtaggtagttagatatatggtgctagatgttgctatttatttttctaaattattttgtacttcatagtaggctgccgtaaaacttcctttaagtaatatatcatgtttcaaacacttcctttgagatttacagcattgccgttttgatctaattgtgtctgtcagcaccatgttaacaccgtacagattatcctccaagaagggagaattgcatatactgcagaacttgattatcaatcttttttgcctagtatgtaatctaagtatctattagattttcatgagaagatcaatgcaagaaattaatttaatgtttcacactaaaatcttcacaaattgaaactgaatattgtaatcattttaagactatgttttcatagtgctttgtctctgaacctctcgtgaagtgttaggattccgaagccaagacaaactttgtagctaatgctcgcttgttctttttgatggccaca

SEQ ID NO: 46741 - DNA, 720 bp, Oryza sativa
cagccgggaggaaggggttagggtgatcaccgacgcgccgctcacatcgctcgtcgacgcgtcgatcaccatagttgacaccgatcctggggatccgcggaaccgacgggtgaaccaattcaaggttgacttcttggttgccatcagcaacctgcttggccgcctcaccagcgtcagaaatctcgacctgactgggctcaatgcaacggttcgttctctccgacctttctctgcaaagtatatcacagtataatccttcatttggcacaacaaatacatacctggaaacataacaaatttaattttacagttaagtattactaattatttcgccgattgctaagtctctcttcaatggcaaaaacttctgttcacccataacaggagagtagcatgaaaactgctgctcattactctgaagtttgaaactgcagcctaatcttgtatactctgtctatgtagctgaaagcctgaaattatctcctggtttcatatgtttcaggcactgctggataataaatcccaggaattcccgatgttcccctacttgacaaccttgctcctcaacgagtgtgacattggatacaagtaccacgtgttgaggagcatccttcagaacgccccaaatctggagcagcttagactacacaattgcaaggtatcatttggcgaagttaagcatatggttcatttagctcttataccgtcatggttcggcat

SEQ ID NO: 46742 - DNA, 16518 bp, Oryza sativa
tattcgttccatgccacccattagatctgctggtacctcaaggacttcaggtctcatcactagagaggctcctgatgcattaagaactcaaccttatgctggcaagtctaccatttctattgatacaactcagccagcaaatggagttgcttcatctgctacagtgatgcctacagctcctgtgatggtttgtattttgtacttcctcttgtatatttaatttagtcatgagtctgagtaaaaagcaaaacttagctaaattagtttcattatttattcttggcatttggaattattttgaaccatgtgttctgttttatatttattattgaataaaaagttaccttaagaaagatatatctgtaataataaggttcatcttgtagtcgtttgttactactgcattggaaccagaagacctttagtcacattgtttaagcatgatcttttgcatttacttgctggtacagatcatacagtacaacttccatttgtgacaacggacaacactctgcttccattcaatatgatatgataactttagttatccgtataagagctcaactagttatgcttgtaactagctgaggtgctctactaattttattagcgagtttctgattttgtgttttcttaactatcatttgttcttgcaattctctgacattgctgtatgcaattttgcagccagaagtaccgctaacagttactgggttgctgaattcactaggacttgagaagtatgtcttcctcttccatgctgaagaggtgattgaccattactgattcatttccaaccttaaacctaattatggttctaatatgattgctatatttatggtgttcttttttgtggataatcatttctgttaaccatggagtaccttactggctcatgtattagtatttgaatgccttttgtatttgaccttttgcttgctacgggttatttggtttctactttctgaaaaaagctcttgtgttctttcctgtaagctattcattagcagctttgtttatactcacgcacacaattattcactacatgctgcatgttccaagtgtatgtgggtcaccaccataagcatttttttaggtcatgcaatatccagtaagcatatgcctgttttagtgagtacttatgcatgtgttcaagctaatagtaagttttttgagtgttcactggcgatgccaatgtttctttccttattgtttattatttgtttgcccacaggtggatatggctgcattgagtcagatgggagacagtgacctgaaggaaataggggtaccaatggtaagatgtactttttattcatactagcatctttacatatatgtactctctccatttcatattataagtcgtttgacttagtcaatattctttaagtttgatcaattttgtagaaaaatatattaacattttcaatacaaaacaaacatatttggtattgtaaatgttagtattttttttctataaacttggtcaaacctaaagagctttgactaagaaaaaagtcgaacgacttatagtatgaaatagagggagtagaaatgttctagttctgagtattttgttactgaagtactattgttcttatcattggtttgaattattatctggatactgcataatggactgtgaatctgtgattagagttagtttgaatcgtcaagtcaaaaggacctgcaaactatatcaatcactcatttagtacataacagattagtgcaccagcctaccagagcttgtctcgatgagagtagattattgtgtctcactaaaagtttccactccaagaatccaattcattcaagctggtcacgtttgctcaactttcgaacataatgggttacacagggctgtggcatgcagtgctgcctaatatttgtgctagcaacttgccatctcatcacatgccagcaagtataacattttaatgtcaagcctgatttgtaaaactatgattctgtttgtgtatttagacatgtgttgtaacacaatccatgttataggtccaccatctcatttaactactattgcaaggatgtgttgcactatatgctgtgttttcctgaagtctgctagcatgcttaattaattgaaccccacgaaatgggaggtctcctttcacctagagcatctagcagagattatcagcatctcaaacatgctagtgttatttgcagtaattttgactcgtggaatattatttgatggatcagggtcctagaaagaagattctccaggcagtggcaccttattcaaaacggcgtagatgaacagcatgctcaggaacttggggcgttcgtgggcaatgacaatttattggtgtaagctgcttcattgcagatcttgtatatcccaatggtctagtgctctagtcaatccgtttcattgctgatagatcaacgcatcgcttttcttggcatgcataatcttatctgtcagctgatgatcccaatcctgttattcacgacctgccccttgtgtagcaggatctgaaacatggatatgtagctttgctacactaaccagtcagttttttcttcctctttgggaattgggaacatcgatgacctgtaatcgaaatcccatgctttatgaccttgggagcgttggcaattgagtttactggaacatactagtgttaagattgtgtacagaatgcgaaacagaccgttgtgttttttgttaagtattttcggtgttaatacccttcctgtttacctcggttgctagtttgtacgcgtaagtccgtcatggtctataattgtgtgctgaagctataatggtataattctcctgtagaatgataatctttggtcactgtacaaaaaaatgcactgacggatggttgcatgtgtctcgtttatatacataggccaaaccccgtgcacatctgtcaattgggagccaccagctctaatgggcgttcagtacgagcaaattagtacggagtactataccttaagctcggtcctaatttggcaaattattgcgcatttacgccaactgttccctcgaggcgaccatgaacatcgtacctaattactgctaatccagattataacaagaaaggagtgggatctactattgctgcagcacccagatgcttcctgtccctgccgaattaatcatcaggataggatgcttcatgcttcggctctttaacggcgctacctggccttcgttgtcagccgatcaacaacgcaaccaaaagctcccacccgacaagtaccggccttgcactgtttcatcggtctagagcagcagagcaacccacaggttggccgatttattatgccccgtgctggtgctgcgcttcaaccgctcggtgggaagagtacgaagcaaatgccgcctttcgcctccatgtgcgcagcgggcggctatcccgcttgttgtggtggattggtgttttttacagcacgagaggcaatccaccgtttgttttttctgctcgcagctggggctcggtggcgtggcttttcacgcgagattaagcttttttttctaataagcgcgtaattgagccggtttggacaacgacatcgacatgaacatctttcctattgtaggatgtagggacgtacatggttaacgataatgacatgtagtaacagcaaagctgagaacaccaacgttgagtcccggccttgttcaccctccctcaccttccactgcgtgtagagtatcatcacaatttcgacgtaaacacatcacaaattcagacaaagctcgttgaatccaaaatcctaataagttgccagattttggccgcaccattacacacgaggagaccgaatcagatgatcagaggacgtcgcagtgccgcctgacgacgccctggcggccagtcttgacgccgacggcgccgagcttctgcatcgccgcggcgaagtcctcgaagaaggccgtccggttgtcggcgtagcgctggacgaacaccctcgtcgccgggtactcccacagcgcggcgtcggaggcgagcaggccgagcccgcgcggcaggttcttgaagtagacctcgtcgaacttgcccggtgtcatgatgtcgttgaagatggagatggtcgggtcgctcctgtagttggcgcaggagctctgcagcgcgcgcgcgaacgccgggttcagcgacgggtcgtacccgtcggcgctcctgaagctgtacagcctgtgcgcgaactcgccgcagtgggagaaccccacggtgtgcgcgccggcgagcgccacgagctcccgcggcgtgaccccttgcgcgcgaacagcaccgccatggcgcgcgcggacatgttggtgcgcgggaggttcccctcgacgtcgcgcgcgtcggaccggcgcgcgtcgcggcggcccagcgcgacggggaaccggggcccgccgaggatgcccacgaggtcgcgcgccgccagcgcgaggatgtcggcgcaggagacggtccccgggcaggccacctcgagcgcgaccttggcgcgcgccaccacgtcgaaggagtcgcccgggagggagaggttgatctccgcggcgcgctcgggcgaccggtcggcggagagcggggagacgaggaccgaggcgtcgcaccccccgacgaagcagtcgtggaagaagaggcggagcgtgcccgccgccgtggacgggttggcgcgctgcttggcggcgacgacgtccgcgacgatccgctccacgcgcgggcagctgtggcggtagtagttgggggacagcctccccgccgcccccgcgccgccgccgcctccgccgcgcgcggcgacgaggccggcggcgagggctaggagggcgcagcggaggagaagcgcgcccattggcggcggcggcggcggtgattcttggctcgatttgggggaggagagagaggggggaaaggtggtggagagagagagatagaaagagaggaggtgagggggattagtggagagtgggagtgtagtggagagtgaattaattgctggggtttaaggggtggaggcggtagtacgcggtggattgtaaagacgggagagcagctcgaggccgggaacggacggatgttcctcctctgcttgcggcgccatttcagcatatacagtttttctttacttttaccaacggaaacagtctcaaattactactagtacttacttttagtacttgcagactgttaaaatgactcatcatcatggtagtagtatacatgatccgtcttactcgagcagataatgatgatgggaagaagaacgatagctccaatattaattggtgcgaaacgtagccagcggccacatagcacgctgcacgccatatatactttgtgtggcctggccatacgcatctggtgcatgggatgggaagccctgcacatgcactagactaaactgaaagctacccccaacgtgtcctggagattttacgctcccatcctagcttcagtagcctgtgtgggctgtggtgtggacctgatcgttacgtgcaaatttctttgtccggatatgccttcgtttcgttttgactcttataattttaaccttccaacaaaactccccagattagagcatctccaagagactagccaaatgactctacaagctaaaatttggctaacttggacaaaaaaatctactccaacagactagccaaataactctccaagctatccggctggctaaattcccctcctcactggccaaagttggccagccaggacggcttgccatctggtgtgcatcccaccctctatcctatctctccccctttccccatccgccccatccgcgcaacgccgccgccggacgtcctcctagcactccatctgcccagcgccgccgccccatcctcccggccccggcgccgcgtcgatgttctcccggctcatgctcttctcgtcaccggcgtcgtctccgccaactcggcccccatcgtcggcaccgccgcccgcctcggcaaagcagttagcggtggcggcggccaaatcctcgtcaaagctgcaacccccatcaccgtctcgaccaccgccgatctcgtgtggcgaccccctccgtggctccgtcgaactcctcccgcggccgcctcatccgcatgcacgcgggctcatgtgtgaaaggaaagaagtagtagagactgacgtgtgggacccaccgttaaattggagaatgggatggagagactgttgaagtaaaaggtaattataactagctactttttttgatagttggctaaatagacatatgaagagtctaaaatagctaatctgttagagatactctaacgttacgcttcagtggagtagcgatctagcagcggtaggtaactagcctagcgcggtactgttgcttcactgatcgacaacggcaggctgcatttgcgctgctgtacgtagtgctgttatgtgtggccagtacggcagcaccgttgctggtgtgggtgcgttccacggagaaaaaaaaagaagtgcgctcttcacgggcagcaccgaagaagatcgttgttgcgacatggcaaagccgcagacaaagactccgagagaggagcacgaggagcagtagcgcggaagccgccgccccggtcacccggccgcgcgcgcgcgcgcgcccctctctgcgcgcatcacgtataaccgcgcgcgcgatcgacgcggccgccggaaacggatggatgcaggcaaactggctgcgagaggtgcttggggttcacaccgggcccggtcgcagcttgttttggtggtctccagctgtgtggttttagtgcgtcttctttcggccgtggaggccgggtagcgtagcgtaggctaggtatggacaaacgggagagaatcatcacaaggggagcagagcactagccctaaggccatcaccaatgtatatggcaaattgatccatatagatgggactcacataaataatttatccctatagtaatctctacaatgtatatagatataatgtatcattagaagaagagagaggagcagagatagataatataatttatttcatatgggtagtccatatgcatatgggtatcttttgctattttttttatatggactagttgcacaatagtaataggtgtaataggtggctgaatggaatattctattgcttatggactacttttacaccacattgtgatgccctaatggtttactactgctttggagtttgaagccatacttagcgcacacgcctcagggttcacatgactactccctccgtcccaaaaaagacaaacactaatttccgtgcccaacatttgaccgtccgtcttatttgaaaaaattatgaaaaaagttaaaaagacaagtcacgcataaaatattaatcatgttttatcatctaacaacaatgaaaatacgaattataaaaaaattcatataagacgaacagttaaagttggacacggaaacctagggtttgccttttttcaggacggagggagtatacattactccatccgtccaaaatacaagagattttaggtagataaaacatattacctttgttttttaaatagataacgctattgatttttttctcacatgtttgaccattcgtcttattcaaaaaatttacgcaattataatttattctgttatgagttgttttatcactcatagtactttaagtgtgatttatatcttatacatttgcataaaatttttgaataagatgaatgatcaaatatataagaaaaaagttaacgacgtcatctattaaaaaaagagggagtacatcctccgtctaaaaaaattaatctcatactaaaataggatacattctaggaggcataaattgttcaggggaccgaccagccaacccggctctcgtatgcacgcacggcagcatgtgccaacaaaacgtctcatctgtggatgtaaattaatttgcccgtgtttcacagcggtacaacacctccactgtcaatgccagctgttcgttaacataacatcaacaagagaaagagagagagagggaaaaaaaaacgtgccccgacgagaagctgcgacctgggaatgcccaaaaccgaagtgcgaccgagcagacgacgcatcgcagcacccaccaccagaacgcggcggcccaacgacagctttgctgtgctactgcagcgatccgcggcttcagttccagaccgggacgactccgtcttgacgcgtcccctctcgcggttgggtgggacgatgtgcggactgtgaggcgtacgcgggtgggtgggaggacatgcggcgaccgtggggcgcatgggcctggattccgcaccgcgtccaaaacaaatttttggaccaccaacgccgtggcctgtagtgtttctcgcgaggattcaggccttcagcctgatacggcccgcgcaacgtagtgggctttcaacatgtcaactaccagacttaacgaagcaaactcactgctcccaatggccaggacacgcgagattgcgagtaggcgagttgcaatggccgggacaccgcattcccaatggctggtcagctggtgcgtcgtacttctgctgcgcatgagcagtggtcactggtcaatggagacacattcagccgaaaatggttggtgtcacgactaccggtgtttgcatccacgaatcgtacgtgacacattgtgtttgcaaccaaccacgatgaacgttctggatcttgggctaagcaaccacagcagcacaaacggacatggcaccagtgacaaaacttggtggaagttggtagcgttactccccccgtgcctcctctttttactcccatagtattccacgacttttagcttaaagatagtactcctccactactacactgtagtacatggacaagcatatccgcggtcctggcaacacgacaacgcatgcgacacaaggactgacagagtgtatgtacatggtgataatgcagacggtacgtgcagcatttgcagtgtgtgctatggatggattggtggaggcttggagctgggaccggaggctaaagtttttctttttcttcgagtttttctttgctttggatgcatcatgcatgtttatcctccgtgaagattcctctcgcgctttctcgttaattgctcatgatctcagttgacaacttggcatgcctcctgtctccacgatcttgtggagtttgtccctatcacaacttcgtagtggcacggtgggttttggtgaacaacgcgtgcaagatttgtattactctcttcctttccaatttgttataaatggtagtgagaacaagattgcatcgtttcttttacaattaaacctcattgatcatttttatttaaaattaaacctcaccggtcaaagttttatattaaccataccacgatatcatttattcatacacagataaacgaacagatcatatatatctataaagttcatacccactaagtatagttaatgctaattctctcttctctaatgatgtcacattatcctaattgtttttagttttttgatgattcgtcaagggtgtaaattgcttctcttcacatcacctcaatttaagcttttagatgattcataaagggtataaattacatctcttccatccaaaagacacaccatacaatccaattatttataatctatggataattgataaaggtaaaaaaaatggggtaccatctagtatatagtacaacaatgactcttgcacacgtaaacaacaaagatgtcatggacttgaacacgaatagatatcggttaaatgatgattaatttaaaataatctcaaaaatatttagagatgattaaattgggacggagacatgatcaaattgattaggatggagggtagtacatcggttattcggtttcacgtgaacatcgagaaaagttttttttttccaggctaattccgaccagaagtctctgtttttccaccaacagctcatgctgttatggaaaaagcatttcctctaccccaacatgttaacccatcgtccccatcccagagttactgaccagaaaagggcgcagatatcgcagagcattgtctcgagcaagaacactccttcgaacatgtgaagcaagcgagaccaaaatatatcaagcgtgattcaagccgagatggatttcactagtccttttttacacaacaaaacatactagaggtccagaatactaacagtaacagctcgtcaacaccctctcttctctcaggaagaaaaaaaaagaaaaagaaaaaaggataactctggaaagacagaaacccaacggacaacaccaactactcaactaggagcaatgcaaagctaaattaagctagatctaggcaggcagacggatcgtattcgtgcgcgcttagctcacgggcacttggtcatgttgttgtgcgagacccagtcggtgtagcacctgccgcaggtctcccggttgccggccgtgcccgccgggacgcagcggcacgcgctgcagcacgtgaggcaggagcggctgcaccgcttcttgtgcgagtgctcgctgcaccgcgcgtcgcacgcccccacgcagtctgccaccaaaccaaccaaccaagcgcgccaggttatcatcagtagcacaatgaaatgagctgcctcgggttgttcaggcaaatgtgggcaccgtgcagtacatacctttgccggggtctacgatcttgtggggaggcggcccaaggggaggagccggagggtagtctgcggcctacaaaatacaagcaaccatgcattcggccaactattagagcacaagaagagaacacatgaatgtgtgtgtttatgcagctagttgtgcatttgtgtgtgcttttaccttgatggtgttgaggaggaggagagacgccaggagggcgaacaccgcgagcttgccgggagccatggcgacggcggccggccggcgggcgaggacgggccgaggtagagcttctcttgatggagagaggaggaggggccttgagtgattgatgagtggctggctggctggcagtgtgctgggagggcagtgaggcgggttaaatagagtgagcagctagcaaagcaggggagtgaaggaggctggagagtggcagtggcacagtgtgtgggaagtgtcagggtaggggtgaacgtggccgtggtcaagggctcaaggcgccaggttggctccggtcggagtgaatgcatgcatgcagtcagtccgtcagtcactcgccagtactccctccgtcaaaaaaaaaaaaaaaaaaaagacaaatcctagtttccgtgatcaacgtttgaccgtccgtcttatttaaaaaaattataaaaaaattaaaaagacaagtcacacataaaatattaatcatgttttatcatctaacaaaaatgaaaatatgaattataaaaattttttatataagacggacagttaaatttagacacgaaaattcagggtttgcctttttttacagagggagtagctttgacacgtacggaaaaggtgagtaaacaacgttcactgggcggcatatgttaaaacatatcatactttacgtgtgaccgtttttttaaaaaaattatataaatttttaaataaagcggatggttaaacgttggaaaaaaacctaaaattatgtttttttaacagagagagtatattgactagaaatgtgacaagttataataaaaaaattacgactatgttatatagagatataagttaaaagaaaatatggcatgttataagtgtggcgataaaccaaaatatcaagatgcctagccatccttgtagtgacatcgcaagcaaacaagctgctactgctcctcttgcttgaggaggaaatgctacgtgtcctcgtctctattagagacacgactagcgactagcacgatgagttgaccggcaatgtgctatcaaaaactaagaagtggagatgacaattgaaggatggggatggagagaaattgtgagggagtgatacggttctaactttaaaatattacaatagcatctaacagattttctaaatagtaatattatttttctaatataatatatttacgatgatatagatctaattaatccttagtttttatagtatttgttggctataagtatgatgtgtcatggcaaaagtttgtaagtactttgctttagaaaaaatgtgatgttacaaatgtgacaacaaatcaaacactagttttacttgatgaaaaagcctagccataagtttagcaaattgtagcatctaaacaaaacaccccggtatcgtagggcaccacactcttctgtgcaaagctagtagtccttcagttttaactttagaacaaatagcagaggacaaatcactctaccacatccaaccgtccgttacaagaaaaaaacaggcatatgaacacggtagcgttgagggggtgtttagacaataggcgtaaagttttgacgtgtcccatcatgtattatatagagtgttgtatagggtgctcggacactaataaaaaaactaattacagtatttattagtaaaccacgagacgaatttagtaagcataattaatcaatcgttagcacatatttactgtagcactatattattaaatcataaagcaattaaagcaattaagtttaaaagatttgtctcataaatagttgtaatatgtacaattaattattctttaagtctatatttaatacttcatgaagatctttaaatgttcgatttgagggtgtaaaattttagagtgtcattggctcgcgcgccgtgcaacgcgacacgcggggaagacagacacacagcgtacggtagggggtttggtgagtggcacgccggtgagcgtacgagaggagagaaggcgcgagagggctgggcgatccgtgcgcagtgggtgcaggtgctgagctgcattccaccgagagccgagagggagagagggagagggaaggggccaggggagcatgttgcatgtgcgagcgtgcgatgcactgcactgctctgggcgagcgcccaggcgagaggctctggagcctgggccatgtcgtacaacaaggctactcctacatggagtacatcgcgtgctggggcacgtcacgccgccccaggctttgtcggatcggcttggaaaaaatcagcgccccagcaagcagctggaggccttgagtactccctgcaccatccattcttaaaaaaaaaatataaaatcaaactctaaaaataaacctgaacatatgttcctacaaattcatcccaaaaattaatttattatgatacagagtgagtacgttttaaaataaataaatctaatatagaatatgatacaccctaacactatttagattcgtagaactataatgtgtcacgttttgtattagattgatttattttaaaacggatagaatagacttgagcattttcgtctcttctttattttagtcttttcccctctttcttggcataagttggtctgactgattgcgtcgtgtaacaaacattatattattctaatatattgacgtgtaatccttttgcacgttcgagaaaaaaatagactagaggagaacagaaagtaaatcttaaggacttaaaaagtgaattatgtttttcttacaaacccaagaatgtgttcaaaccttggtaactcattctaaatagctcattagtgtataattaattaaggaagctgctatatcataaggtcccgtctggacacgatgatgccgtataggtatcgaatcctaatacttctgatacctatgatgtatcatggatatatcatgtgatacttcacggtatcaaacgacaacacataggtatcgactaattatccgttgatatcgtgcctaataacgatcagtatcaggccctgaccataccggttggtatcaagtatcaacccgattcttagataccatgatgtattgtaccatgcctctgcccctctctctctctcctccttcaatccacctgtacatcctacttctcttccgtctttaacaccaaacaaactcctccctaaatttactccctttctcctgtataaagaacaagaaagagataaaatagtttgtggttgaatatatgaatccgtggatggaaaatatcccacttttatctcacgcgggagaatcaactgcgctagcaacaacattttgttgcaaatcggctggcgtccttccgccgggccaggttaataatactccctccgtttcaaaatatttaacgccgttgactttttagcacatgtttgaccgttcgtcttattcaaaaaatttaagtaattattaattcttttcctatcatttgattcattgttaaatatatttttatgtaggcatataattttacatatttcataaaagtttttgaataagacgaacggtcaaatatgtgctaaaaaatcaacggtgtcaaacattttgaaacggagggagtattttgttgcgcgcgttgccgcttctctaatccaatttccacccatatcaagctcacctgagtcaacgatgacaagggagtactgcatcaccagatgcccaggcggccaggccgacgactctgcaggacagctcatgtttttgggaaaggctaactcgcgcgtacgcgttgcccgcgcgcacgccggcccattaagacccatgcacacacgcgtttccgtttctctctttttttttcttttttttacgccgcagtttcttctttttttcgatgtttgttattcctcccgtacggatagattagttccatatttttactagtgattagtttactagtaatttttaaatcttaacttcgaaattttcaaatctcgagttgaaagtttttaaatttctaagttgaaagttttcaaaattttcaaatctggacttgaaagtttttgaatcgagttgaaagttttcaaaattttcaaatctggacctgaaagttttcaaatctcgagttgaaagttttcaaatctgagttcaaagttttcaaatcttaagttgaaagttttctaaactttcaaatttggacttgaaagttttcgaatctgagttgaaagttttcaaatctcgagttaaaagtttttaaaatttgactttaaaatttaaatcttaaatcaaaagttttcaaatctgacttaaaatttttcaatctgttagtaaaaaaatctcccgaaaattttttccctaattactcgtcattagtgttaagtgggtgttaactaatattagttagggaggtaatactactctatagagtagttagggaggtgctcgctgctggcgcgcacgcgccagctagcagccccctatgttttttccaagggaacagcggacagctcgccatcgggtaggcccaagcatggcccaccagccatcgggccggcatggcccggtcggcactttgtgccaggccatgccggcccatgggctgcacctccgacccaggcacgacccaccagcagtcaggccgtgccgtaccggcccgaaggcacgggtggcctatagtacctcttttaaaataagtctattttccctccctcccttttgggctgtgacacacatatatagctaaaataagtctattttacgtccctattctttggaccatggcatataatatgtctatttttactccctattgtgtgtcgggcctggctggcgacccatccatcgtgccgtgccggcccaacgtgcccgggggggggggcaggcacagcccggcggtcgggcccggcccccgtcgggccgtgccgtgcttgggtggagccaaaatggcatgccatgggccaggtcgtcgggccttatggccatctatatcttcaggtccgtgcatatgggccagcctgcaggcccgtctatccttagaccatttactgcactcctatgtgacgtataaactcgtccagccatgtaaagacactgggctgtcatggaaggaaaaataggtgggcccatgtgttaacgaccaaattgcttctcatgtcttatgttggctacaagatcctcgcctgcaagcatctgacacagggcccaagtcggcggggaggggagaaggggaagtgacggcgctacacgtcggggttgtcgtcaccgagggccgtcgtggtcgtcgtcgccgagggttgtcagggtcactgtcgatgaagaccatcgggccgccaacagatcagtcgccaactccgccgtccaagaagatccaacggtgatgccgccactgcaatcaaatcggttggcgagaggaggatgaggcgaacgtcctcatggagcgccagcaccgcgagcagtcgtgccatccacgtcggcgcaggcgccatcagagctcgatccacggcctccgagctcggtttgcgccaccagaactcgatccgccgccactggagctcaactcgcggagagaaagagggctttgccaccttcgcctccgaccgccctttccgccttcgtttgctaggccgccggcggggtggggagagagaggaacgatggcaatggagaggagagaagccggcggaggggagaagaggtggcagtggagaggagaaacaccggtgaaggggagaagcagcgccagtggagggggaaagagatggcaccatttgagtttgagcgaagggggggggggggggggg

SEQ ID NO: 46743 - DNA, 1809 bp, Oryza sativa
agggagggaggagaaaaaggtatagggaggaactgacatatgggtccgtctcagggcttcacagatgcctcatgccatgttagatctagaaggagaaggagaggaagtaggagcggtttataggttttggagtcaccgccgagcagggggagcatggccgctggtgagtagaaccgccatggccaccgtcgagcaccgcgagctagctccttcacgccgctccgctgagatgcacgaggtgaggattgaggaggggccgcgagctcaccgctgtcaagatccagatccgacacctccactgagctccatccactatgagctagcttctcaccgtttgtcttgtcatgtgaggctgtcgtcaggatagacaagggagagcggagaggcggcaccattgagctcgtgggtgtgccgaccaggagcaggaggataggcaatggtctcggcatggattcctctacaaccacggaggccacctagagtcatcgaggtgcccaatgtctaacaatggtgaccttgtcgtgcggaagaggaggcagcgaagtcggtgatgcggatctggtgccatctctgagctccacacgccagtgcgtcactagggagagcaaaccttggcggcgttagaccttgctagcctcagagtccgccaaaccgcatggtggcgccgtcccttctactcgtcagctgattgaccagagtgtagtcagctgattccacctatactattagggtatagaatcggagagagaaggattagcacggacttaatatcggacatgatttaggtggtgtttggattcagagactaaacttaaactttagtccctgtcacatcggatgtttggacattaatttagagtattaaacatagactacttatataaaactaattacataaatgagtgctaattcgcgtgacaatttttttaagtctaattaatccataattagcatatgtttaccgtagcatcacataggctaatcatagattaattaggctcaatagattcgtctcgcaaattagtccagggttatggaataagttttgttaatagtctacgtttaatacttctaattagtgtcaaacatccaatatgtgagagactaaggtcctgtttctttcagtttgggattattataatctagattattgagtcagattactataagctagattgttataatctgtagtacaataagcggttagttgtttctttcctagattattagagcctagattattgggtttgcaagtctaaagagggagtggggtggcatggtgggtaatttttcacccaataatttagaaaaagctcacataaatgagcttatcagattataataagctgggctccagattataataagctactttaataagttgtctatttctttaaaccttacgacttttttttttgttctagtgttttaatcgtagacttatgaataagttctagagttacatttctctctttatccaaaatttatcttggttgcggcctagacgtttacatttggttgcatccttttgattttatgaaaaccgtagttttgttgttccgaacgatttattggtttctccgttaacgctttattcttcatccataagtttaaatattttatgaaaacatttctagttttctcccttgacgctctattttccaacctccgtttaaacattatgcttttattggatttatttattttcgaaagttttcttgtattaatgcttttgacatgctacatttttaatccataactttttgattttatgaaaaccgtagtttacttgttccgaacgatttattg

SEQ ID NO: 46744 - DNA, 9325 bp, Oryza sativa
cattttattgaaagtttattttcattaccgagcatgtttaattgttttggttcttttatcaatctaaatcttaaaaatatcatgcggataataacaacacatttaggaattataaatttttatgtgtaataataattacatatcattatacatcaggctagatcaattttgcttgtgtggatcgttttggcctaggttcacacggactagccaaattattgtaccgaaatgagcaatttgcaagttgttgtatctatttgcacccaccacacaagtttatgtaccgtgagcgtaatttactctttcttcaacaacaaactttctctttttagaaattctctttgcactttaaagctttattttagttctgaaatctatatttcctaaattttgtgtgaacttatgcttactagtttgtgaaaagaaaatagttgctttcatttaaaacttgcagctcttctgcccgctgacgttttaatagtagatttggaactaagttctagagttttgtttctttgtttattgaaaaaaatatcttggttacggactagacatctacatttggttgcatcctattgattttgtgaaaccatagtttcgttgttccgaaggatttattggtttatccattgacacttcatttttcatccaaaagtataaattttgtacttttttttggatttcttgattttgcaatgttcttcttgcatcgaccttcaaatatactttttggagttttctcccttgacccttctttttttgtcctgtcgtttaaactttatgcttttgagctttacaaagtttccttttttttttctctttggactttaaacctttagtttagttttgaaatgttaatttcctaaattttgtttgaacctatgcttactagtttgtgaaaagaaatatttgcttgcatttaaaccttgcgtctttattgtgctctgacgttttaattttggacatataatttagttctagggttatgtctccctgtttatcgaaaaaagtatcttggttgtgggctagacaactatatttttgatcgcatcttattgattttatgaaaattgtagtttggttgtaccaaacgatatcttggtttcaccgttgaggctttatttttcatccaggagtttatattatatactttttgttggattccttgattttgaaatgttcttccttgcattgattcttccaacactccttttttggagtttccaattttttttggtcgtaatagttcgtcttccttaaatttgtttgaactttgatttctggtttattaaaaacccaaaatattcttttgcactgaagcttgaccgctttattttgctctaaagttaatattgaacttattagttgagttgtagaggttggtctccctatttattgaaaacaaataactttgtgttgatgtgaaacacgacggcctgggagatctgcttaactccagtgcaggtctaaggctagcctcgagtgtgttaaaagcgtgccagctgatttgatcctacaattagcaagaaagtcaaaagcagagttagtcagccaatagcgtatcggtagtagtctcagccgatgtggttagaccaaatcggctattgactggatagatcaaggaataaaagaccctaaacaatgcctcatcggttacaataatgtctatttggtttgataaagaagttcaagacaatactatgacaataaccgatggagcagtatttagagcagaatgtatagataatgataaagtactagctaatactctagtacaaacttatataaacaaatcatgatcaattagtgtttcagatagcccagtcaatactgatctaacttgatatggttatatagaatgatttgtctatataagtggcaaatatagataaaaccagttaagaagcatgtatattaggtaagatcagctgaaactttgatgttatctccatgttagttcttagggttctaaataatcagagaaacctaaggtctaaataatcaaggaattaatcacttttcaagatggtagatggcttagctaagctaatctagtaaggcaatttagccgataccagcaggaaccctaaagcgagaaccaaccgatagtgctaaattgagatattaaggctagattaactaagacatatgataacatatggtcatcataaaaggactaaaacaactaaaacgacataataacccccaatagcacaagccatcgagacgggttacctcttgtcgagagaactcaccgaaaagaagaacaaaaatggtggcaatgtgcagaagttgtattgaattgtctctcagattataatgctatgtggttcatatttataccccaagtacagacttcgtctattatggacacgactcaaacctttctaaaaataaaatacaaacaagaccatatacggtggtctatgtccaaatccaacaaaatttaggcccaaaccgagcccaagttatatcgtatcggctacttgccatatcggctaagttaagcctatatcctgttttcagccgatacgacgctggccaatgcgcagtccgacttcaattttaacttggttcaacaccaaatccgcttcgatctttcttcttcttctccgaatctgatgcaaaattccgctattaacactttgttatgaactggttccatgcattttggtgcaccttaaaacttttacgaaaattgcaatatctttataccgaacgtttttaggtttgtctcttgacacttcgtgttccgtcctttcgttcaaactttacactttttgttggatttctttgtttctaacattctcttgtactactgcttttgatcttctcttaggactctaaagctttattttacttatgaaatgccaatttccgtaattttgtttgaacttatgcttactagtttgtgaaaagaaaatatatttgtgtacatttcaaccttgcggcttttttgtgctcaatatattcattttcgacttataactaagttgtagagatttgtctccttgtttatcgaaaaaaatatgttggttgcgggctagacgtctccatttggttgcatcttattgattttacggaaatcgaagattgcttgtcacgaacattttcttggtttctccgttgacgtttcacttttattccataagtttaaattttgtacattaagttggattccttgatttttgaaatgttctttgtaataccccgagtttcgaattagtgtatttcgggatatattaaaacaaacgcgcaaaagttcaacttttaaaccgttgtttgaataggcgatcagggaccgtggatgcatagagctcgctgaatagtgcaaaatagactaagtttgtggtaatcggagtcccaaggtatttccggtgatcgaattaatgtgggctgttcgattttctttaacctctctctatataaccaacagaaaaaaaaaaaagggtcctgcgccccagccgccaccactcctgcgccccagccgcctctgcgccaccgctgccggtgcagccgtcgccggttgccgcagccctcgtcgtccttcgctgccaatttgatctgttcttggtgagctgctgctactttccctgctgctgcgtttcctgctgctgctcctgctaatgcgtggcctgctgattctttggctgctgtgcgttgggctccaacttttgttgcagctgctgctgctggtgggtggtttgctgctgttgcttctacaacgaccagggaagcagagaaaaacaggaaggaggagagaaggggaaattagatagaagagggaaatttggggaattaggtggatatctccaaattcattgtttttctctcaaattagtactgctaggtaatccgttttagtccctagttgtttctaatttatatatataagacgatctgttaccggtagttcgaatttcgaacgctaggctgaaaccgtattttcaaatctggtgttaaaccatcggtattcaggtcagttgtcctaaataaagtttgtagtcatcgttgatatttttttaacgccgctagttttgctcgaatccgataaacggtttaggagaaacagcaaaaacagtactgctgccggtctgaaaatagggacagaaatttgtttttcttatctgagacctacattggcttaatctgatttttttgccaacatgaaagttgtagacaattttttctagatatctgaagttgtattatttgctagtttccgttaaacggtttgcgagttacgtataaaatagtaatggaactgctataggttgtttaatacaaatcggtaaaagtttatatgttctaggttacgattttagtaaatatcctttgtggagagtgttacgtcaggttaccatcaaggttaaagtcaaatgctaggatgtattcacaattgtccgggatagaaattactatttcaattcatgtctgcccggaatgggaactactattttctttgacttggtgtttgaaattgtgtttcttatcaaagaaaggaagctttctattcgtgctctattgcccatgatgtgtatatgtgctttctagttacatactgtacttgctgagtatttctgtactcactcttatgtttatttgttttttaggtatacattgagattggcatgcatgggcagaaagtagcacccttatatacatatctatttgcacactatcaaactatactgcttaggtccataatgacatttaaactatatcttggttttgtcttgtaataatctattaaatatctattggtttctttccatggattatatggatgggtagcactatgggaacgatgtcattattagtttaatctataactgcctgacgtggatgtctatatttataggagagactctaccaaaatttctaattattttgggagttagtagttttgagagtattttgatgtggcactctaggtacgtggttacctggggcgttacattcttcttgtatcaattcttcaaatatcttttttttgtcacggtttgtttttcttaagtttgtttgaactttgttttctcatttataaaaacaaaatattcttttgcattaaggcctaactgatttattttgcaccgacattaattttcagcttagagttgagttgtagagttgggtccccctgtttacagaaaacaaataactttgttttgagctgcactgttgatattacgatcacagataaaatcatattcaagttattgatttccacgcggaacatgtaactcttctccaggttaatccaaggacataatataaaaatgtagacaaagggtagagataatttctagtgagtatagggtctatagaaagcttaagtttaatcatattgcaatactgttaatccaagaacataatataaaaatgtaggcaaaaggtagagataatttctagtgaggtatagggtctatagaaagcttatgtttaatcatattgcaatacttcaggcactggcttgctcgctgctaccagatcgtgctctactccgtattcggataaggagaacttaagtgatctcgagggcggtcaccgcctctacatctacctctaacgaactgtgggatgcgctgcaaatacatgtattaaataatatatagaaaccaagtctacactatttagatactactctaatattcctaatgtcgatcaaacactaaagtaaacattatttctagtgcacaatattccagtatgctaataggaactaagagacctctggccagctcccctgacggtggcttttttcttgggccttggcaaaagactccttgggccattggtgtattgattgggcctaatttgtggtatttcgatgagtttgtgggcccaaactcaatgggtgaaattctcctccagttttatgtgtatttcgtctcaactttggtagtttgtcaccggtatacaaatatataccaacactcgtggaaattgtttgaattaaaccctaccaccatattggatgtttcatacttttccgatttacgtaagtattggcggcataaaattggcatttaacagtcgccaacatgcacccaggtgttttgttgcaccttgaagattgttttttttttatcaatccggagggagtagcagacatgatatctgaaaggattgtttgtctatttattataaattttgtttttggtactcatacatattataagactagcaataatgtccgtgcgttgcaacgggttctaaataatattcattgacataaattaaaatcctaaactatatattatagttggacataaatgatgaaggaaataaaaacgtataaataacaatatgaaactacaaataactttgtccggaacgataattcaatattagaaaagttataagttagctaaatataagttacaataatttttagtggatcaaatagtgctaaaactaataatgtaaatgaaaaaacaactgaaattagttaagaattgaaaaaacttttttagcccacatatgaaaatctgattcattaatcctaaatggatgtctgtttcattgatataaattagaatttttcatgttatagtaatgttataaatgccattatatttatcgattttgattgcacatgttttctctgttcacacctagtcgatgagaatcacggatgcatgcacgaatggaaaatcgcctcaaacatttatggattatcgataaatgctttttcgatagatgtacaaattagtgtgcagattatgcatatcgtttgttatgttgttatatgtattggctatttagatggtagatttgttctcttcttgctgagacatacaaaactcctcgtgcattaaaatggttaaaaagaaaaagtccattgtgtttttttttacagagtagtaggtcgatttttttaaaaccgacacctatatttatattagaagtgccaattttattaaaaaaataacacctattaaaaaaaccggttatagagccaactgagcctctttcccttatcctttcttggctatagagccgactgagccaccgagacagaccacgccggcggatttataacgtgcccactccataatggagtacacctaattttggtaccgctttaccacagccgcggtaagggaggtcaggaggtttcactggctgcgcctgggggaggggtcgccgaccgtggccgtgcgtgcgggggatgtgtcggtgagctcggcacgagcggggcaggagctcgacggcggcagcgggtggcagggcgagaaggagaaggaggaggggaaggggaaggcccccgcttcggctgtcgagctcacgctaagtgtccgctgaggagcagggcgaaggcgttgagtgtccgtgccgatagtcggtgtttgcggtggtggggatggggatgccggcgtcatggtcagagacatggaggacctccgccgtgtccatgtcgaccagcacggtgaggccctcgatggggtgcatgtagaagttggcggtgccctcggttgagaagcactggctcttgatgagtcaccagttttcctccactgggccctactagccgaaggagatgggcaggcaagcgacgtcggaggccctgacgccgcggcggatgctggcgttgaacgccacgtctttgaatagcgcgaagctgaggctggtctgctcgtccatgctcatcatcgggtaaccggaggcagggacatgcagaggagtcaccacaccgttgccctcgccgaggactcgggacttgccacggaaccggatgacgaccacggtgcagcgaggcgggagtgggttggcgcccttccgccagctcttgacgacggacttttccggctcatcgagcttcagcgagtgcatgaataggttcgccccgctcctcagcgcgagccagtgcttcctcacccgccctactgctgccgttgagctcgcgctcaccccgctcacgccgacctcgccccaccacgcgcattcctgacgaaggagaaaacgatggaactcggaaataataaaataattcgaccagtgttctatagccaattacacaaattttgtagtggccatcaaccatgtcacgttttttggtgtctcccagctaattacatattttttgcgtgttctgtagcaaattttgccaagaaaatatggcatgttataactatggcgataaaccaaacactagtctaacttgatcaagataccgccatcgttgtagtgacattgctcgtggacaagagccttctaagctgctgctcctcctcttggttgaggaggaaacgctacgcatcctcgttgttgttagagacacgactagcgactagcacgatgagttgaccggcgttgtgctattagagacacgactagcgactagcatgatgagtcgaccggcatcgtgctatcaaagacgaagaagtggaggtggcaattgagggatggggatggagagaaatcgtgagggagtgatacggttctaactttaaaatattgcagtagcatgcaaccgattcatgaatagtaatgttatttttctagtgcgatatatttgcaatgacatagatctaattaaccctttgtttttatagcgtctgttggccacaggtgtgatgtgttatggtaaaagtttttaagtactttgcgtaagaaaaggtgtgatgcatgttacaaatgtgacaacaaatcaaacactagttttacttgatgaaaatgcctagccataagtttagcaaattgtagcatctaaacaaaacacccggtatcgtagggcacgggcaccacactctcctgtgcaaagctagtatccttcagttttgacttttgaacaagagagcagaggacaaatcactccaccatccaaccgtccgttacaagaaaaaaaaaacaggcacgagcacgggcaagcgttgagtgtcattggctcgcgcaccgtgcaacgcgacacgcggggaagacagacacacagcgtacgggtagggggtttggtgagtggcacgccggtgagcgtacgagaggggagaaggggcgagagggctgggcgatccgtgcgcagcgggtgcaggtgctgagctgcattccaccgagaggcgagagggagagggaaggcgccagggggactggggagcatgttgcatgtgcgagcgtgcgatgcactgcactgctgaactgctctgggagagcggctctggagcctgggccatgtcgtacaaggctacatactcccgtccgttcttaaaaaaaaaatcaattcgtgggtttcagtgtctaacattttgaaaaaattataaaaaaatttaaaaaggtaagttatgcataaagtattattcatgtgatttatgtgctaattaggatactg

SEQ ID NO: 46745 - DNA, 6864 bp, Oryza sativa
aggtcaaaggagcaccacccaaggaaaagaaatggaaaaacaatagcgtccaccattgcgacgaactgaattttcttgcagagacctctaacttgattaaaagagatccatataacagaatttcaaatacagtactgtttaaggctccattagtaaaaattctaacttttcgacaatactgtctatcttaccctgttcagcgttcactactccagtagctaacatgccaacaaagcacagaatgaagctgaacgtgtcgtgaaatttcacttttgcacagatttatgtataaaagtaaatttattttaggattgagggtgtaatgatcaagtatgtcccttgcaagcgagcaagtactggcaacataggtgttcctggatacttttatagcttgaaatttaagcaagtctgcacagatctatggcctatggggactggagtcagcactgtgagatctcaatacgctgatagaaatttcacatggattcggtctccaagactgaaaacatctaggtgggtactataaaatagccgttttgattgattcctaagtgatccaaagcttgaattcatcttatattctatctaccacaccatcgaacatggtgtagctcacggtagtcccaataagtgtaggagtatcagtcaactttacaatggtgcaaattttcatacctgggcacctcttgcccccgtttcccttctacaaataggtgatgatgcaaactggtttaccatgatgcagtataagctctactatgctcatggctaagggaaaaaattctccaccaaatctccatggcccaaattacattcgaaatgcaagcgatgtatttccctgcggaagaaaaacactaggaatgatgctgctctcagtgctacttgtgcttgttctctcagcatattctcctgagcagattttcctttaccctccaatgccagcacacaactctcatcagacggccatcaacagtatgctctctcagtcttcatattttttttcggggggggaggggggggttaaaaaactgccattatagttacattttgtgtgccatttttctaccatcagttgattctttggaaagctattgttcatcaacatatggagtatttatgtgtcagattaaattttttttcctacactttccacctgtacatttggaacatgaacgaaagggcagcataataagatactagttcactctacacatcaacttaaatttcagttctagggaagttaaatagtactagtgttgtgaatcttgtggtttaaaatgcttaccaagcctagctgtctatgtagtttcgaattctttcttacctttcagataatctacatattatatttcagaagtgtatcagattaataattgggaaaagatgcaagcaccaaaataaatgaacaaaaggaaacataacttctaactctgcaaaatccacccccaaagagttatggcatatttccgatgtcgacaaataagatatgtattgatagcatatcagttcttttttctttttttttttgcggggagcatatcagttctaatataatcaaaagcagcaagcttgcctatccaagaaattcaagtgtgattttgtctttgtttaggtcctcatgacaatgcaaaagcctgcaatctgttcaatggaacatgggttagggattttggaggcccgatttacactaacacaacatgcccaacgataccagaggcaaggaactgtgcaaagtacggaaagcaaatggattatgtaaactggatgtggaaaccgcatggttgtgccatggaaaaattcgaaccccatctattcttgactattgtcagagggaagacattggcttttgctggggattcgattgcacggaaccagatggaatcattgctctgtttactgtctcaggtaaacaccttgtgttttagttcttctaaatgtgtaaccaaaggaagacttgcttttaacttgcgtaaacctatatcaccagtgacacaattacagtaacttgcttttaggttcattttggttctttaccctaccaaattgttggtagtgtaaaaatttaggcaagttttgccactaccaacaaattggtagagtatcacattggtttggcaaaaaaatagcttcaatccgaactctagccaagtactattgggttgccaattaattggtagggcacattttggtagcaatccaaaatggcctataattcttttgagtttttagcacaactatagacaggtattactccatatttgacaagttaagatagaaatggactggaagaagaaaatttgagctcttcccctttccactgaataataaaaaatatatatactggtgtaatataaagaataccttaaacaggcatcacacctgcaggaggccctatagatctttgcatagattcatgtattttctagaaagaaattttttaggttacaattatgaaataattttctccaaagaaatttgtaggtcacaattatgaaatatggaccaagcagctccaggcctggattttatttacattgctaacccggaatcaataatgtttataagttataacagagtgctttcatattttatgccaaaaatggggcataaaatttacactaagttcttccatctgctgatttatcacagcaattctacttcatgtacctttgtttctagaaattttatcagatagctgtgattaaagaccttgacacaactctacaagcttttccaggtagaagcaccaatcagagttagtagtgacaccaaagataaatttgtcacctggaacttcaggtctcataactttactcatggttctttggaccaaattcatagtagaagattctcaaagacaaatcaatggtacagtagttgaagagcatgacatacacttggataaacttgatccaagattagctacaaacttacaccagatcaatattttagtcatatccacctcgcgttggttcttcagaagaaactatctttacgaaggtgaggagctcattggatgcatatactgctcagaggataacatcacaagcttcagtgtccctatggctattcagagggtatttcgaacagcgctaaaaaatttgaaagagagccaggagtgcagattgcaattgacagtggtaagaacagcaacatcagcacattttgaaaatggtttgtggaatactggaggatcttgcaatagaactgaaccactgagagaggaagcaatgattgatcaaactgaatgggcaataagaaatgcacaggttgaagaggctgatagaacaaaaaagaacaacggcaagggaggggtgaaaatagagattatagatataaccaaagctatgtcaatgaggcctgatgcacacccaggtatccattggaataaccagtggatgaggggttacagtgattgttcgcattggtgtctgccaggaccaattgatatgtggaatgagctactgcttgctgtgcttaacaaatataagaacagcttggaagatcaatgacacaaggccctttgccaatccatcacatccacaataagagttactttttaccatgacaacaccaggcacctatttttctcatttgcaggaacttttgttagattcagacaataggacatacgaaatatgatcactgtgatgacctagacataaaactattagagttctctatgtcgaaggcaaaagcaaaggacccatctggggtcagtttttgaacaagcagagttttgcagtttgaaatcacttctgattagcgagagcctatgggctacaacattttagtggtttccataaccattttgtgctgggctgatggccacttgatcagcattagctagttttatcataaagatattcaacagaaaaaatatacacatgaaaatattagtggtgaaatagaaacatagagctatacagaaaattcaatcttatgaatacctgatggttctctaccatgctcagcttgtcaatttgttatcatcaaaatctttggctgtactcctgctgctaacagaagtttgcagtaattccttgctcatcaagtgcttgcgtttttggaggctcagccaaaccaaaatactgtcagtctggacaatgttatatcctgctttcctgtacatattgaatggaacttggtcgattatcctacagtgcagatatacgtgccttttggcatccatcttgataatcagatcctcgcatgccttaagaagttgttttccaattcctctcctaatgggaagaaacaaggcacaataaaaactttataaagcacataatcaaaacattatatagattaacaaattaatcctgatggcataaaaccataggtttcacaacttactcatctatctctgatcgaaaagagaatgagttcaaccattagatgtcacgtgcaagagccatgggccctagaactaggccacatgggtaactctcatgcatttttcctttttcaggaatctggttcataatgaacaatacttccaatcttctccaaacaaatactctctttcaagtaaaattaaatcatggccattgcattttatataagcaaagtatgacaatttgtatagtaaaaacccttctacactggttctcgatttaccatgtccacagaacaactttggttgctacttggagcctcaaattatttagtgcatatgcaataatcagcgaaaatgggaaaatgcttgatccaacgcaaccatatgctgctatgctaaggaagctcaattggcaactcagctctcgcctcaaaatctatcagcatagcatactccattttgatttgcagacaaagtggaaatggccctgatggtgtaatccattacctcctcaacgacgtcttgacagtcatgttgcaaatgtacgggaagtcaagcggcggcgtgggcgtgggcggggcaccgggcgcgcccaccgcgtccagcgacacctccgccgtgcacgccatctccccgtagtcgtcgtcgtcctcgttgccctcgccctcctcctcatccccgtctcccgtggcggcggggcggtagtaccccacgagcacggcggcgtgcggggcgaggccgcggcgctcgaagaggtagcggcggatgacgaacgcgaggagctgctcgtaccgctgcgcgggtgcccacctgacgttctcggcgaaggacgacgcgaggaggcggacgagcgcgtcggactcgtcgtcgtcgcccgccggggtgagcgcccgcacggtgaggcggccgtgcgggaaggagtgcgcgtagcggaaggcggcgagctcgtcgcgctgcgacagcgcgcgcggcgagaggaagacgcctccccctccccccgctggccccgtgacgatgccgccgtcgccctcgccatcggacgacgaccgagaggccgcgaggcgtgcccggtggcgaggccgcgagcggtagggggggcaggagaagaggaggcgcgggtgggtcggggcggctggggagacggccgggaggaggaggaggaaggccgcggacgcggcggccatggccggcgcggcggagcggaagcggaggtgggtgtagagattagaagcgatttctttttctttccttttttttttgaaacgggtccacgtggataaacgccaactgtgcgtcgcttagataccaaccctgaaatctgaatcttctgaaccttctctgtgctccacacaacgttctgaacggaacctctctatctgatcacccgttgccatctccgtcgcttcaaccacctgcaagctgcaaccgagataccaactctgaatattctgaaccttcctgccatgcgtagcacaccattttacatcattgattcaggtcctgtttagttcgtgaaaaagaaaatttcgaagtgccacaccggatgtttgatcaaatgttgtaagagatttttggacacgaatgaaaaaattaatttcataactcgcctggaattatgctcaaaagattcgtctcgcgatttctcttttaagtgtacaattagcttttttaatttatatttaatgctccatacatgtgtccagagatttaatacgatgtttttttagaaaaaagttttaggaactaaactaccctcagccaagcaagctagaaagcttatgccaattcacttggtatacggaagagagatggagaaatgcaaatcatggaattgagttcagctggttagttcagacagttactagaaggagtacttccgatcactgttacccgcatcactgttgccaacggcaaaccgaacaggcattattacccgcattttcagatcaagaatcccagtatcgcaccagcacaatcagtatcactctcactctcacactaccattaacgtactccctcattccaaccaacgttgttttattttgggacaggagtacccgttaacagtaataagtctctggctctctgcaccggccaacacgttcccggtctatcgttacctattcttgtaccacatcaatctgcaccgacgccataaattgtgtgctgcgataggtagctggatctcgccggagtgcatcaatggccagcagcggtagtagctccccacaatcaaagcagctgaccgtggctatataataaggctctaacgccatggccacacaacaaagaactcaagaagcaattaacattcgcattcatcagctggtaggtagtgtgagctagagattaagggagagagagagatcatggcgtccaaggttgagctggtggtggaggtgaagtcgccggcggacaagctgtggacggcgctgcgcgactcgacggagctgttccccaagatcttccccgagcagtacaagagcatcgagaccgtcgagggcgacggcaagtccgccggcacc

SEQ ID NO: 46746 - DNA, 2036 bp, Oryza sativa
gaaggtggaggtggcggacgacgagaagaaggtggtgtcgtacagcgtggtggacggcgagctggtcagcttctacaagaacttcagggtgacgctgcaggtgacccccaagggcggcgccgccgcccccgccgccgacggcgcggtggtgagctggaccatggacttcgacaaggccagcgaggaggtgcccgacccggacgtcatcaaggagaccgccgccaagaccttccacgacctcgacgactacctcctcaagaactagccagacagccagatcgagcgccgccgtgcgggtgcgtggcttatgtgttagagtccactatagcgtcctcgccgtcagtcgtcgtcgcacacggtcgcagtatcggggtgttgcatttgctagctctccggctagccactgtctcccacgaattagtgtacgtatcggtgcatgagtgaataataaagtgttcaggttaaaccgtttatcgtctctccggctctccgtttactgtttccttgtattgattttcggtctatccgactctctcactctcctttggttaggcctaaacatgtttaggttgagaaaatttttagatttggttgtcatattggatatacagatacatatttaaagtattaaatatagtctaataacaaaataaattacagattctatcaggaaactgcgagacgaatttattaagcctaattaaactgccattagcaaatgcgagttgaatttattaagcctaattaatccaccattagcaaatgtttattgtaacaccacattgttaaatcatgacgcaattaagcttaaaagattcgtctcacaatttacacgcaatatgtgtaaatggttttttttactatatttaatactccatgcatgtgtcagcgtgaaaatttttgttttgaaaactaaacagagccttattttgattcacagggttggtctttggttgtgactttctgttggaagttcccagatattttttaaaagaaattcactaaaacttatacagatagtatatagtttgttataaacatttttttctgaaaaagttggtagattagttttcgcaattgattggttgtattcaatatgtcttagccatataggagggcagtttttttctcgtatctgtatggaaattcctttaaattcagccttaaatatatgtaaaaccgacctaaactttttttagaaatcgcagtgtgaatttaaaaccaggagtttttaatccaacgcgaaaatcctgagtgcaactctctgtctcgaatatcaaatcggaagttccgttatgagttcatgtttgtccataaattttggacttaatgttcataaattttgggtgctaaattttgatctacgtgatatgaaaaaaaaatatagaaagacaaaaggacttcatctatagaaaaaaacatcatcttattccgataaaaagatggaaaagtttccacaaggaaactttcaactgtaataaaaactttctataataaaacttatttataaagaaactttaataacgacatttttcatcgtagattatatattacgaattattgggcctaactaactataaataaacctacttccaaatggcgcacaatagagaaatggcgcacaatagagaaaaaaataaatatgtcatgcacgtacgtaaaaataccgcgtaaaacaaaaaaaaattaacatatttctttacttacaaggaagatatacacaccacactcacatgtctaacgattatgttcctaacgtacgcttaaatagacgataccattagcctcataaatagagaaatgtatccacgagacatctctaattgtagcgcccgttccgtcgtggcgcctagcgggaaaactatctcttaaaaaccctatttgcaaaatccgtttctttgcttgttgtctagtgtccgtgccatctcagatctcaaatcctcgatctatcgtcgagttcaatcccgaatccaaatccttcccaaatcaaatccctccgcaaaagtctattttgcctccctcgggttcgatgggcc

SEQ ID NO: 46747 - DNA, 3947 bp, Oryza sativa
ctccccgccggcgtcatccgcctctgtcgccgttttggccgcgagcgctgagcgccagctcgcgccttgaccgcccaaggtcggtttccaaaccgacatcgtcgtcctataaaccaaggcgccctccatcgattcctcctcccgtttcgctcgctgccaccgcgccattgccgcccctctgtctcgcctccgccgttcatcgccaagcaccgggagagccggtgtgttcgtggacgcggaaggggactccgggcgcttgccttcttcctcttccccggcccgaggccggagagatcactcctgtgccgtcggcctctcgtcacagcgccccacctcatctcggtagtgcatctccccgttctccctcctcaatccatctcttccccttagttttcggtagtagcatgtgtagcccccccatagctagccggcgccgccccgactactgccgtcgctcgccgtgtgctcgccgccgtcgccgcccgagctcggaagcgcctctcgtcgcgggcctccctcgatgcgattcctcctaatccggcgcaaggggtagattcccgtagccgcttagatgctcccaccgccgggaatcggcccctcgtgacctcgtcgtcgtttcccccttttctctccgccggttgccgccgccgcaatccgccgccgtcgagcatcccccggcgaatccgagccattggctcgtctcccctcgtcctgcgcaacatcccggtgtgctcgccttcgcctgtatcgccatggtttgctccgccgctcgccgctgtcgaccgccgtccgttccggccggcgtcgtcgtctacctcccgccggcccgcgtggcagccacgtaggcgccacgtcggcgccacctcggccgcgaccaggtcaagtagaccccggtccgccgcttccctccgcccctcgcgcgcgcggtccaccgcgagccgtgaggctgcgcgtgggcccgccgcaccgcgtcctccgcgaaccgcgcgcatgcgccgcgcctccctccccaaaccctagcacgccccgcgtgcacctcgctcacggtgagccgagtcgccgacaagcgggtcccacccgggaccacgagggatggacccggcccaccggctctctctctcccctccccgctcgcgcgcgcgccttgggccgccttcataggccagccagcccattaaggtcggccgagccgccccattctctcgggccgtgccctagccgcccgagggaagtctaatttccctccctccttcttttcttttcttttctttttcaaaaaggatttaaataaatccttttcctttagaccaaaaatccaataatcttagaaattcaatatctccccaaccgtaagtccgtttgactccgttcaacttccaaaattcctcaaatctcgagatctatctaatggcacgcttagaggtcaataataaggctttattttcgccgtttgctgagttgtcccgtttcgcgtgtagtttcggagcccgaagacccgtagtacgaggatttcgaggatcaagctcaagatctcgagcgaggcaagccacctttgaacatcttgagcctatatttgaacttaattatattgcttgaaaaatattatgcattgataggatcgcacttaatctgcttgtcccctctgcaaggcagattggcggacctacctattttgttgcatttgacccttccattgtaattgttacaccatgttcccttgtatccacctagttgcgcctcggtaatcgtgcactctgcacgggtatcgacggtcgccttcaaacttaaaatctgagaaacttcttgggtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcattcgaacataagacaagtacgaccacatgggtggaatgggacacccctggctgagtaactagcttatcgggggagccatgatgccaagagacatgtggattcgccggggtggtgtcggggaggacccctgggcttcctggcacagtatggtctgggacataatctggtgttggtctgggatccctctcgttggcatatggtgaacctgtgtcggctttcgaaatgccttgtcatgaaagccttaaggtctctagtcgtggccgttctgcacgggctggatgatccgggttagtaatgtcgtgtgggaaaagtgtaccccctctgcagaggttattaaaacttttcgaacagccgtgcccacggtcatgggcggatgtgaggtgattcctatcgtagtttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaatcattgcacatactccgaccggacgagacgcactgtctcatccgtgtcgtttgagaagcactcccttagttgtttcagaaaagagtttaaataaaatcaatcgtaaaaacaacagcctttctttgaagcctgcattaaacacttgtttcccatggcttgctgagtactcctgtactcacccttgctctatataaataattccccccagttgctgaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgctgcccagcatgactgtactcctactctataataaagagacctctgttgttgtgatattccgtcttcctgtgataccagcactgtttcctgggactggtatcggttaacaggttaatttggagcatcacgggctagttccgctcgggactagttcggggcgtgacactaatgctacactgtatcatatgctttccacacacaaatatttactcgcaagtcgtgcgtatttggaatttagatttttcaaaagaaagttcaaaccatttgcatacttgagatacaaaactcaaaacgaaaattgagatcgagttgtagagtttgacatatatatattataaaattcgacaaagatcaatgatcctctgggcttttcacgtgcaggcgcccccggttccggaatttctgccacgccgctttcgactgacaccgtgacacgaacccacaaaagccgtcagcgtcacaaaccccacttttttcaggtgcatcgccgcaaaaaccccaaccgggctgtgacctcgccggagtccccaaacctcccataccgctatgccgacggcggcggcggcggccacggcgtcgctgcgggtatccaacatcccgccatcggccgtcgccgcggagctgctcgccttcttcgactccgccgtcgccgtcgccggcggcgcgttcgcctgcgagatcgcggcggcccaccgcgggtggctcagccggggccacggcaccgtccagttcggctccgccgcggcggccgctgccgccgcgggcctcgcctcctccggccgcctcccccgcttcctcggcgccctcctctccgtctccccttcccccgtcgacctcctcccgcgcgcgtccgacctctccctccgcgcggccggcgcgggcctcgtggtgggcgaccgcgtcgccgagcgcgtgttcgaggccgccgacgcgtgggacggcgtgcgcgccgaggtcatcccggggaagcggcgggtggacctgtacctggagcacgattcccagaggtacaagctcgaggtgctcttcgaggacatgaaggattgcctcgggtgcaccctg

SEQ ID NO: 46748 - DNA, 8843 bp, Oryza sativa
atggcatgaagataatacgttgatgtgcattttttttcccgtatgtgtcaccttgattttgcgctcagtagtaaggccgcaatagtagattagtagttcatatgatgtgcttgaagtcatggttcaatctacagctgttactccctctgggctgataatacttgtcgttttggataagggtgaggtcaaactttagaatctttgattatgaattatttttaaaatatttgtctttcaaatatggtgactacatgtataaattagtcttaaaaagtactttaataatatcatatatttgttaacacttttatacatattataatagaaaataatggtcaaaattgttttttggagaccgtgcccttgtccaaaacgacaagtattatcaacccggagggagtagttctcaacttttttcaaagattatgttgatttagatcttactcgttttattaaatgtgacctagctacccaaatgatcgcaagagcttttttacaatataagatttagttaatttttacttctttacgcttacaaaatcatgaaacttttatttacttgacatatttgagtagattttacaaatggtggagtaaaacaatctaaaaaaagagtagcattcctatgccaaacaacattaccattagcggctaaattgttgtactataacctcttggactacgatttcagatgcaccattctttcctttttgtatacaatttttatctgacaaatatactgtttacttctaatttttgtttcagctcaattatgcaccaagaatacacactgcaatttctgggcctgcagttaattcaaggtttatggatgaccgctttcatgcatgcaaggaggatgctaaattttcctgggtcagggcacttgattttacacccaattattcttttgggaggtgctctactcttgtccttaaactgggtaaaagtgcattggtgtctgatattctcaaaagtttacctttctcaggaaatttaggggaattgactatgaattcaatggatggtgttggtgcctcctccaatgtggttccccttgttcattgtccgagggactattcagtgccttatgaagttctgtttcgtctgaactctctcatgcatatggggaagatagtcgccaagcatgttaatgccgatctgtttaaagcccttcaagaactaccggttgatgtctcaaggagaatttttgagaaaatgcacaaattagagtctacctgctacgggcctttacaatttatccaacaggaggcttatagcatgaagagaagccataatgttttgctctccaatgaaggtgaaggtgaaggtgaaagaaaattgatgaagtgttatagagttaacataactccctccaaaatattctgctttggacctgaagaagaggttacaaattatgtggttaagcatcattctgcatatgcttctgactttgtgagagttacttttgttgatgaagattggagtaagctttcttctaatgcaatctcagctagaattgaacaaggtttcttttctaagcctttcaaaactggtctatattatcggattctctccattctaaaaaaaggattttccattggtccaaagaactttgaatttttggccttctcagcaagtcaacttcggggaaattctgtttggatgtttgcttctaatgcttccttgaatgctggaggtataagaagatggatgggccactttgagaatatccgttcagtttctaaatgtgcagctagaatgggtcagctgttcagctcctccaggcaaacatttgaagtcttacgatgggatgtggaagtgattccagatattgagatcacaactgatggctccaaatacatattttctgatggtattgggaagatatctttgagatttgccaagcgagttgcacaccacgttggattagatcctactaaccttccttcagcttttcaaataaggtatggtggctacaaaggagtcattgccattgatcctatgtcctctattgatctttctctgcgtcctagtatgaagaaatttgagtctgagagcaggatgttgaacattacaagttggagcaagtctcagccatgctatgtgaatcgtgaaattatttctcttctctcaacattgggtataagggatgaaatttttgttgcaatgcaacaagatgagatgcgtgaaacagaagaaatgctaaccaacaaagaagttgctttgtcagtcctagggaaacttggtggttctgaaacaaagacagcagtgaagatgttgctgcaaggttatgagcctagttcagagccttacctgtcaatgattcttaaggcccatcaggagaataggcttactgacattagaactagatgtaaaatacatgttccaaaaggccgtgttcttattggttgtttggatgaaacaggtgtattagaatatggtcaggtttacattcgaattacaaagaacagcaaagaacaaaaggacagtaatcaatcatatttttataatgatgacgggaaaacagccacagttgttggaaaagttgcaatcacaaaaaatccgtgtctccatcctggtgatatccgagtacttgaagccatctatgaccctgatttggtgggcatggttgattgtcttgtcttccctcaaagaggagaaaggtttgtgatactgaaactgaatttatctcttaccttaatgttttttaaagtttgtattgctttgcccatggcttcaatggaaggaaaggagtccatcacttctctattgaattgaatcacacgttgtccagcattatcttccttgctaggttccttttttattgtcaaccttatgaatgaatgctgccaatgatttgcttgtatttgatgttgatcaggcctcatccaaacgaatgctcggggggagatttggacggcgacctctattttattacttgggatgacaaacttattccagagaaagttgatacacctatggactacacagcaacaaggccgcgcataatggatcatgttgttacactcgaggtaatgcctgactaattgttccttttcccctttttgctaggctgttgtttctcatttactgaaggatttctttttgttctttactaattcaatcttgatagttgcaaaatgtcaccaattatggactgtagcattatagtcatatatatgggcctgaggcaccttttaaaaatgtatgcttgcggttaagggcatgaataaatgcattaggacaatatgtgcatatgttccatgaaacatgtgatgctaataaggttatgcaaaccagaaagtacaagcttggagtgagtttctaactcaactagtcaactcactcaggatggtttaacaattaacagaaaaactggtggtcattgatctaaaagtaatatatctacgtgaacaccaatcattgaaaagttttgaataatttcaaacaagtatgcactgaccatacacatttaacaatagtatttagaaattttgagagctttattcagaaaagaaaacagcatccccaaaaaaaagaaaaggaaacagcaaatacttgcttctgtgaaaaaagaaaggcctctggaacataaatggcaaatcttattgagtttatgagtatagacttttcaaagttgcctcatgggtgaacaaatgcatatctcctctcaaccatggtgttatactcacctgagtgaaatgttttttaaaaaaatgtctgtaactgcaggaaattcagaagcactttgttgattacatgataaatgactcgcttggtgccatctcaactgcccacttgattcacgcggaccgttcgccactgaaagctcggagtcccgagtgcctccagctggcaactctgcattccatggcagttgacttcgccaagacgggagctccagctgaaatgccgcgaacattgaggccgagggagtaccccgacttcatggaacggtgggagaagccgatgtacatctccaatggtgttcttggcaagctctaccgatcagcgatgggtcacatggagaaatcaggagattcaggagctctctcatcatcctcagcacaaccaagccccacatacgatcctgacctcgaggtccctggctctgacgaattcctgcaagctgcagaggagtactacgagctgtacgaggagaaactgaccacgctgatgaactactaccgtgcggagctcgaggacgagatcctgacgggcaacatccggaacaagatgctgtacctgaagagggacaacaagaggtacttcgagatgaaggaccggatcgtcgccgccgtcgacgccctgcacagggaggcgaggggctggctgctgagctccaggaaggaagaggacgcgtcgcggatggcgtcggcgtggtaccgcgtgacgtaccacccagaccgccgccgcgggaagcggttctggagcttcccgtggatcgcctgcgacaacctgctggcgatcaaggcgtcgagccagctcaggcggcggcggcagaaggacgatgactccaccgcggtggtgcagatggactgcagcgcctgatgtggcagaggattctctgactttgagtgactgacatgtgggcctgctggataagggatccatgggtcagtgacaagttagagggaaataaattagaggttctctgacgcgccgtcctaagtgaactttcaactgcacagttcattgctgtgcgcctgtgcctgtacgctgtacaaatctggttcgactaatcttagctgagctgaacagcagagctccggctcgcaacttggaagaggaaagagtttgatgatgaacacctacgtagagtaaaagttcctcttcctaataaaagagtcttagtgctgatctaccggtaaggtggaggcttccatttcttgttttctgcgaaggaaagaaacttagggtgtgtttagttcacacaaaaattgaaagtttaattgaaagtgaacgatgtaacgaaaaagttggaagttcatgtgtgtaggaaagttttaatgtgatgaaaaggttactccctccgtcccataacataagggattttgagtttttgtttgcactctttgatccctcgtcttattcaaaaaaatttaaaattattatttattttttttgtgacttgctttattatccaaagtactttaaacacaagttttcgttttttatatttgcacaaaatttttgaataagacgagtgtcaaacgttacaagaaaaacttaaaatcccttatattatgaaacggatggagtagtttgaagaaaaagttggaaattaaaccagaccttacagggcaatcagtagtacaaccagcatatagtggaacctggaactttgcactccagatttccaatatgaaatgcagaaatgcaccgagcaggtagcagcgtttagctcagcctctaggtaattggacacccacgggtgacgatccccactgttcgttttgtttaggcaggtggtctgcttacttgcttacatatctttttctcgaaagagcgctgcttgactagctgactgttcttacaagtgacatcagtcgagcgagcttttgagcggatttcatatatcgaaatccttccaaactttcgaatgacttcgaaggtttgtcgtgattatcgacgctgcgaatcagtaaaatttggtagaatttgatactaatactcggagtatcgaaccagattggttttgtactagtcgaaaccgaaaccacctgcacctttggcggtaaaaccgcacgagaaaagcaagcgacgccgaggaggagcaaacaaacggcaacctacctaccatatacgagtcggacacggagcgagcaagtcgccggagttcttggtccaactccccataagagcagccggccggaagttggaccacacgctccactccaatccaactcgtcgtcgtacgtctccctcctctcgcaccgaaccaaatccccatcgcgccgcggcggtggcgaggcgtgcgtacgtacgtgatgccgggaccgggggcgcacctgctgtacgcgctgtcgggcggggcggcgctgtcgcggctggccggggcggcgcggttcgggccgcaccactgcgccgtctacgccgccaacgccttcctcggcccggacctcggctccttcgccgagtggctcgcctcgttcctcccctcctcgtcctcggccgccgccgccgtgggggacctcgccatgggcgtcgtccaccacccgttctactacccgctcctcctcggcttcccgctcgcctgcctctacgcctggctctcccggcggctgctcctcgccggcgtcctcgacgagccctctcgggtgggggcaccgcctcttctcctaatcccctcctggatttgctttcctattaattaaaccatttttttaatcgcttcggtcgccaaattgatatctagtattaattaaaccatttttttaatcgcttcggtcgccaaattgatatctagtattaattaaagagcaatgctacacgtattaaatttttcttactaaacttttactaacaatcatctcaaccgtttgatttaagtaaatggaagttacctagatgcactcatagcatgacacatcagtgttggtaagaatttagtaagaaaaagttagtacgtatagccttttccttaattaaaccatttttttaatcgcttcggtcgccaaattgatatctagaagcagccttgggattgtttgttcgaattaactaaagctggaacatccgctacctatgccagtagtacataccttctgttgtctcatttggatcaattaaacaattagcacggcagcattgctcagtagaatcccaacctgcaatttttgcaaatggaaggaacatatctgctacctgtgccagtagtacattccttatgttgtctcatttggattaattaaacaattagcacggcaacattgctcagtactagaataccaacctgcaattgcaaatggaaggacacagatataagcagcacattgtagatctagctctagtgtccaggcgcctctgctgattatttgggttattcttccatgtttgaatttgtactgatatcgacgttgatgcaggtggcactaagcaggagacaatgcttctaccttatcacggcaggctcgctctcccatttctttttggatcacttgtttgaggtgagaatgtgctccaatgtctctgtgccccatttagtagcactttatccatccaaaaaggcgtcgcatgcttattaggctaatttttttcgtcgtgttttcctctgcaggagaatgggcactctacgatgtatacttggattctgagcactggttggtgggtaggccgtgctcctatcaattcggatgcagtggttattgtaggccttctttgtatttgcctcgtgctggggtttgtgtacattaacaggtgtgaactctgcttcatagatgcactatgtgtttttacattattattaataaacatccctggcctcggcatcatggatgcacacagccaacaagtaggctatgtacatagctgtaaaggagatctagacacttgactagaaaacttggatccttgctgatgctttagaaattaaaagtttcttactagtaccagaattttgaatatcactctttctaccaactagtaagtatactgatcatgttgctaacaacatcttgttctatgttttggcagagtgaagcatgaaaaatcagccactcaaaaatcaaaccaatctttcttcctcatcgtggtgatagctatcttgtactgtatgtggtgtgccactcagatatacctgcgaaatccacctcaaccagccataggtgaagaggctgatcttggagtgataatatttgttgccatttacctttttctcccccatggcttgtgtgccctgtcaatgaaccagaatgattatgctgaactggaagggatccaacttcgataatgtgccatatggtggtgtacttttatcctaatctacaaagaacatcattttttgaagtctgctcgctcctccatgttgtaatcatatttattttctaataataattggctaattgccagggatttatgttttctctagtgcaaaaatacttctagcgaagacttaggagttaggattatggagttcaggatgatactggcactgtattatcagttgtgatagcaataaacttctattggcagtggtgttcaaaacatcccagcaagttctgttttccactttagaatatacatttcaaagttatgatatgatttgaaaaagcttaccctggacattatctttcctaatatgaggcatgatttcttcttattaggtcatactatttgcttagctgcaattattgtggtaaactgtgaatctagatttactgtctctagatctaacatatattaattctttctttttttaatgcaaaatctatttactcttgcatagatgaaaagtatatcagttaattagtatatttcctggtgtgtatctcaaacacagctgaattatgctcacataaatgcacgcaaatgtttaaacatgttagtggaaacactaagttgcagcctgaactcctgaaggattgcacagggtactatgaatgggactcgatgatgctaatgctgttatgcttatcgtcatctctcatggagatctttagggccttctcaagatgtgacacaacttgctccatggacggacgctgcttcttgtgtccagtgcatgaaagggcaagcttcaaactgagatcaaatgcctctgtcgagtactctccgttcagcctaggatcagcaaactccaacacgttgccttctctgatgagcatggaagcctgaggaacgaa

SEQ ID NO: 46749 - DNA, 7284 bp, Oryza sativa
ctgttaaaattatcactagcaaatagctggaaaatttaaaagcccttgcctctaagaacttcttgcaatattttgtgcccagcttctcatgcggttttccataagccatagttctctcctgacccatgcatgctacatatcatacacatctcatgtcatgctgacattttctttcagataaatctcgagcacaggatagcatggatggaacctccaggaaacagctagctgacagtcgcctgatgatcatatcaactagcaagatgcaaattcagattgcgttacaagcctcggttgaaatgagcggcaagtgttcactgcgcagcctgggatgcagactcgacaaagacaatacgccccaaaggttttctcccttcgccttttgtgatgcaacagcacatctgccaattatgggtatgaacaatctcaccttcaacgggagatggatagcagcatcatgcttagggactaagcatgtacgtacggactactaaaacagcgtaagtaaaggtgaggatatacatatgtctaatttcagatcgatgattattggcaaaacctgttctgcaattgggcttgttaatttattttaatttaacaaaacgatcgattcttgtgcatgctaaaagtagtagtagtattatttgcacagcttcgtatagtcacttcgtttgtaaagcccaagaaaacaaagctgcccttttcttttccttttcaaaactcttgcccacagttggtcactacttgccaactactttgggggcagaaaaaggaaaacctgaaacaagagaatagtacagcatactagccttgattttttttttcgctattaccttcagctgttcagctggtatctactcctacgtaccgagttagattcatcaatagcctccttctattgggctattggctacagattttgtgaagttattatcggcttgtgccatatacaaattttgaccaaatatttgttgttcctcaaagcacggttaccttgtacacaggaacctacaccgaagttcgtcgttccgattataatttttttctaagaaccaattaaaatttttgaacatagtaacgggatcagggcatggagcagttcatgcttgagatatcctgcttttgataccaatgtgatgataagccagaaatgtttaatttatactgggtaaacaatgagaaatgctagctgatgaaaggtatccactaatccacacctttaattgactgctcttattgaaagtggagcaagctaaccttgcatggctcatatgtggggcagcatatatagtgcaccaaagtaccaaacataatgtcagtgtatatacatacatgattaattccttcgatgtaagccaaatgagaggggtgacttagttatgtgcatataattaatacgatctacataattgtgaaaaaaatataatttattttgacaatacagattattctttaatttatcactgcaaaaatgaatggctaaactcaatcgacacatgcaagggaaagataaatcaaatccagctttttagaattctccaatatacgcaaccaaaaattaacttggttagatgaatttggccttacatgcatgtttgtagagttacaccattacatacttttctgcaggcatgcacctctaacattttctaaccatttggatgtatgcataaaattaaggaggacacatacatgccactaagttgtaaaatgattttcccttcctaaatcgtaatatattttaattaactactttataacaggaaaacaattttctaaaagaggtcttacccgttatacacaattaacagagtgtttttaccgtgataaagaagatatcatattttaagaagaagaagaagaagaagaagaagaagaagtgtatagtttttaaacttatctaataacaaggtactaagaggtggcaccacagattaatactacaaattataatagctccttaaagaccataaaatcactccacatatataatacaagctcaccacgaacaaatcgttgtcttcaagaattatgcatacatattctaatgatgaataaatgtgtagtgaggcaaatgaacaacatgaatttccaagtaaaagagtgtcaatttttttaaacgaaccggcgcgagactataccaatttcattgaatataatatagaagagttttatatcccctatgctagggtgaaactagaaaaaaaaactatacatatgtaagaaggttaattaacttagaaaggtgctttgccccagcaagagccaaagctttccttcctctttgatcatatagctaggagacctattttcgtcgagagctctttgtgttgaaatgattttttttttgtttcgttcgtttcaaacttcccaggaaactagcagggttagagtgtagactccttttctcgatgtatgttggccataaattccggctactaagccgccagcgctaaacagctctgatgcatgcatccatgttgctattaatgtccaaatttttatacagtaaaaaatatcaaattggttgagctactatttataaacgaaagcagtagtaaaaaatgttctttttaacgtcaaacttttatacttctacttttagccgcttctttgttcctcgatctgtccttaaaaaaaaagagtcgacataggatcgaggcctcctagtacaacgaatctaaatataggagatgtcacatcctctcgtaggctgcccttttttaagtcatagggagtaaaatcactaacaaagaagcggcgaataaaccctctaccttaataatattaaaatacttaaatttagccgtggcttataatagctgaaggcctaccgcgcgccctaccgatagcagaacacttaattaagttcatgcatcttatctagatgcacggtgcaccgtaccaccccaagatatttcacgatattttcacgcatatgaccacacccggtgtggacacatctcacatgatgaggatgagtcgtcgtcgtttgcaattgcaatatgaccagctatgcatgttagtgtgaccaccaaaggtagtacgtctcgtgggggactcgcattgacagtgctgtgttgagagatacacaacactatagctatctacatagcctgcaggaccaaaccccccaaaccccggtcgatcgtcaaaaaaacgcgaaaaagccacccaaaaccgcgagcgctttgctgctgctgctgctgccgcaaaccctttttccccacacgaacacggtcgatcgtttcgatcaccaaaaccatcgtggtcgtgcgctccagatgatggaacatctacacgctaccccacgtcggctttagcatcttatcccatcggtagatccgggccgttcgatctcggcttttatcccgatcgcgcgatcggcgccgtccgatgccgatctccccgatcgggcgcctttagctcttgtatctggaccggaagaaccctagctgtctggctaaggtagctcgcaactaccggcctaaagcatagctctactgtgtgtgtgtgtgtgtgtgttcactactggatagtacacaatgcaagagctaagctgcagctgcaagcagccatgcaagagggagcctggagcacagctgagctagcttcctctataaattgaggtgaggcctctcctcaccttcctaaacaccaagagctagagacagcaactcaccaaccactagctataagcttattgccctagattaacatagctaatttcaactaatctcaatcagtgacaacttttattaagtagcttaattagttagttagttagaagaaaagggaaggggagaaagctagtatatgggagggaggtcgttcctgtgcatcttcagcttctcgaggaggtcgaggcggtactacgccgacgacgaggcggcggcggtgagcgactgggagcggccggcggcgacgaggctgcggaaggtccggtcgagcgacgaggacaacgggtggtggatcggcgagcgcgacgtcgaccagaaggcctccgacttcatcgccaggttccaccaccaccagaccagcctcgtcgtctgaactactccatcgatatagctagctaactcgcgatacaggaccgcagctagctagctagatgtagtattattatatatattattacatgtatagtatatatgttgtaatgtgtgtgtgcaatatatatatatatatatatatatatatgcagctggctagctagctagggcatgcatgacatgagatgagggccggaactgctatgtatgaatgtacaaatatagttttaattgtttaattagcactgctgatgatatataataataataataataatgaataaatatgtatgatattgtttatagtatgtctcccatgcatgcatggccttgtggagttgtggtcacccctctctgatctctcgatctccatgcatgtatatggacatatagattgtaaccatgcatgcatgtcacggtatttggtggcaattaattaaactaaacgcagattgaagttaattattaaacgccgggtttgtttagcccttacatcttatagtttgcacatgtgtgccagagaaagaccaaattacaaatcagaagtttatctctaaaacattattaaaacattcaaaatatctgagttacgtcaggaaggatcaaatatctcgatcagcttctgaaacaggatatgcctatttgctgatcagtactcaaacgttctgaactagcctattcatgaataaagtttgcaccgtttcaataacaagatgctagcctgtcaatgtttgtctactcacacaactagtcattctacattttacaaagaaataatttgagtagttacctcctttattatctcaacgtatacatatacaagaaaaacacacggggctttaagataaatataattagtataaacaattgtaccataagaaattatcgtcatcaaagatatatatgctaatttaaagctactccatataatcacatacttattcaatttaattattttctgaaaattccataacaaaagctagctacttccttattccaaaatctaagcatttctagctctttagcaaaacctaacttagagagaaaatatcatcttttagtcacttcggtgatatcaaattttaaattttgaattgcttagattccctttccaactatatgaaaatgtatagctttctatgcattggaaccggtgccccatatattatggtataaattttgaattctagaaatatttatattttaaaatggagggagtagtatattagctagattgataggcacaccttaattataactgatattacatgatacaaccacacatgcatgtttaattaagcagatgtgcatctggattaatccaacgtaaaattaaccatgagtagtcaaatacccccccccccaatttttaaatgtatgacacagttgaatttcggacataaaatttgattattcatttcatttaagttttagtgtaaatatggaaaaaaaatataagtcatgcttaaaataactttagtgatataaccacaatagaataaaagtacatagtaactttaatatgacaaacgttcaaatatgatgtaaaaaatcaactatcatacatttaaaagaatactactctctccattttcttttaattgatactttcaactatacacgcaaaattaggctatatatccattattatattttctagatatgaccattttacccttaggatatttcttaatgttgtggatagcatgtggatagatgtggaagtttctagaatataaagtactgtagctacttcctccatttaagaatataagcattttcaagatttaaaatttatacgaccatgatattaaatttctccgtagtatgaggtatgattacatattgatcaataggtttttttaggtactctcgaatgattgtgagtcatccattttctttaattagatgcaatgaatattattttattatactatatccgataatatgtgtagtagaaattttgtaaggttaaaactaaaaatcaaatatataacactgtgatcaattcacatgttatatatatggcacattaaaatggatgaattggtaaggataccttaccaaagttttgaataaaatattcctgtactcatgaaaatcgatctatagttagatttaaattaattctaccactactacaacaaacaagtaatagtaatataatttggctgatgatcgatgcactagactgtttttgtttagttgagaacattatatacccagctaatttttctcatatatacgtcggcagtagtgctggcattacgctgttctttcgacggtcaggagatattaacgccacagtaattaattaaccgaataccgaggacgtttttttttttttacagtgtgcgatgcatgcttcatgcttaagcacacagttaaaacgtaaagtacatatgcatgagcttacttgtaattgcatgcaaccaacaggatgtgacgaagaaaagctttgcactgcacttgaaatggcttctacagaggaatgagctttttgttgggaaagcaactcaactggaagcctagaagaactattcggctcagagctctaggtctttagcaactgaaagtcactcatcagtgctgctttgttcttgcttttctcttcttgtctactacaagattattctccatcatcatatatcacttgtcttctctctcctgttctcatcaatctcatctctgataccgtacatatgcgcatccatggttcagtacgtacttgaatttatacgcacactgtacatcaataattccgatatcagttagcatctgatataaatcttccttctgatattgacaagtatctttttgttatgagaaacaatgggataacagttgcatatattgtaaggttaggcaaaaattgctgtctggaattttctatccttaacacctacatataccctgaattttctatccttaacacacctactccctctgcccaagaatagcacatatgaagcctgaaatttatccaataatataaacacatcccggcttactttcttaccccaactaacttctatgtaattttcgcatctactttcacactcacttcaacctcaacatatactcttttaaagaccccaatgattatggtgagaagtgaatctaccatcaccaccatcattcacatgtgaatcttccaaatagtaaggcaccataagctatcaaataagataaaaaattataaaaattattatatgaacatttttacaatgaa

SEQ ID NO: 46750 - DNA, 960 bp, Oryza sativa
gttaggaaaaaacaggaatattatttgtggaaaatgattcaggctctgaataccatggtgtgtgggtaaaagagctacctggaattctactacaatcaattgacaaagccccctcagtaacaaaggtctgctataggttatttatccagtatagagttggaatactcagattgggcattaatgaaaccttttcaataaatagtgtactttatgatcatatgaattatcataggttgttttggagctacttctaagaattggacagtacttccccacaatggagtttggaaatctgcgttccttcattaagttatttggtgttaaatgtaagtataaaattactggttgaagatcttttttatcctctatgatttatcgctttatgtgtaattccatttttcttggactaatgacattttgctaatagcatcatcaggaaccatagagcttggtccattcgttaaccttccacgtgattgccaagaacttgccatttcatgcctttattacttctccaacctgcttcccgacacaatggagctgttggcttcttgttgcttaagtatgcatttttgcttctctgttctgcgtttagtgtcgttatattctttcctttaaggattacaggtggtacataatttatggaatgcaggtgatgtgctggaacccaccatattgtttagaattattgaggttctacagtcaacatacaaggctgggaatttacatataacagagcaactcagtttcttgtcattgctaatggcacgattcagagttcatcctggtgagtacttttttttttggaaggcaaacttttcttagtttaagtggcttactttaggtgaaaatttcatactatgtgttttgctctttaagttttatccttaatggttattttatctgacatttttttctaacagctttccttttgttttgttaaactagggtctttctcta

SEQ ID NO: 46751 - DNA, 1400 bp, Oryza sativa
gatgctcagtcaagtgaagcattattatcagctcttcactgtctggatctaatatgtaacatatgtattcaagaggtaaagaaacctcagatgaaatttggaagatccaaaattcaggttggacctgaatggttgaaaagttccgtgttagtatatgcaaagaaattgtggggagtaaaccgttcattccacgaaaaggtttcaatttcttccccttttcatttctacctccatactactggtatgataatatttaaaacgtttcgtgaccaattaatagataaaatatgctactaatatgatcaaccaatagataaagcatgccatttttgtgttctctactcatagtgatatctgactctctgtggtatcaaaacttttggaaccctggctggagattaatttcagattttgttctattccagactgttaattgtgttcttcagaaagcctggttatagcatatcttttgctgacaatctcagtgatttcttatggaactcttttcatggcagggagatgacagatattatgttttcaatctgaagattgctgaaatatttttgtgcttgagtgcatgtatggacaacaccatatttccagctgatgaattttgccagtttgtatcttctctacttgcaaaggttgtctgtggctgccagtttcaaggactgatttctatcactggctagttgaaagttctttagtccgcttgtgcatgttgttctatagctatcgtcttatagacagctattaattattcatttattttgtcaggcaaaaacacttcgcaataaggataccatggaaaagcatttgagcccacttataactttcataccagatcttgtatccaatgccccagatgactcaaaaggatatttattagaggtatgactaattttccttttactgatctctagaaagtatttgggttactttttaacgttacgaaaaatgagagactatattcaactgcaggcatttacagatgcattctgggattgcaaggtggattgcaagctgattttcccatatttggatgcagtgggaaaaatgctgtttcctgtaggttccttctatgggatacatactaaacttcctttgctacataacttcttctctctttttttcttttttttttttttgtgggtgacgtgttcaggttattaagaaataggacttgatgaagagcatgcctagtgaaaattgcctacttggtgctaacacacaaatatcttttagggagaaatgcatctccacatgtacatgcattacatgcactattataactgtaagtgcttgaagatttgggtgatggtatgaagatctgtaggttgatttgaattttcagtgttcgaatctggattctggaaccacatttgatggtgatgttagtt

SEQ ID NO: 46752 - DNA, 13061 bp, Oryza sativa
  unsure (1)..(13061): unsure at all n locations
catgaacgaagatgctataaaaattatagctggctacttgattgatgctgctatggtgtgtactcttctgaattctaaagctctggactctggtatttgcagtcagtaatttggtaaatttgtacgctaattcaggagaacgtagtcgaaaatggcagattagtcgaaaatggcagattggcgtattttgatgttagaaaacctattgcctatagatctgatataatcggatctaacattattttatgcatattctttgaaaactatgagagttcactaacagagcatatttacgtggtagcatagggagagtatcgtgagtaataagctcttcacatcacctggtgaagcgcagagtgtcagattgaatgcattacggcataaacgtttttttcagttacactagcttatggatggtaattatgagtttgacacctgcaaagcttttggcaaacaggtgcattaattcattgtcatataaattagaagcgcatctccttgattagttcataagcattgctttatcgctgtacttttttgggttttgatgagaattgatttcacccaattttattgtgtacatgcaggatttgtctaaaaccattgagcttggctttcaatctgataggacaagactatttcaatactttataaagccttgcataatcatattttgccagaacgagaaggttctttgctgcgcattggagatgcttaaatctttcgcaacaggagatgaccacgtgctttcatctgcatccaagttaaactacccaggagagctttcacatcgaatttgtgttgtcacaactatactcatattcttatgcaatgatggaaaactccataaaaacctttctttgggcaaatgtgttattaaaggtatcctgcaacatacaaggcatctcatggtaagtggtgataacataaatgcctttgtttggtagccatattaactgatgagatttcagtttcctacattttagtcatttttcatattaatcttaaattcagggaggtcagaatatcaagggcaaaattgaacatttgtgcatgtgaatcgtatgtagactagtttgttgaatttgttcctactatgagagaatatttgtcctgtgctgtacctagatcactatcactagcttgctctattatgcctaaatgtcgttgttgtgaaactggccttcctaatgagtttgctctattcaatacttgctgcaggattctaatgttcttgatgtaacatatgaggacaagcagaagttaagatttgcatttgagcaactaaagacgaaagcattgcagttgaactgctgggacagaagtgagctggaagggttttcaagcaccacgtaaatagtaccaaatactaatggtatgtgggctccttcgtcattgtttgctaattatgttgatttattgtttttttttaaaaaaacgaatgaacttacttccatcccatatgataggtactgccgtaatgtgaaaccttactctgcacgggatgaaaattttgacgaactgaaggtgaagatggagagtggacatggtgactggtgaggggcagaaggatatgtgccatccgacctgcgtcagactccagtatacacctctgctgttcagctgttaccaacactttacgaaggtctgtactttacccaaagattaatttcacacttcgattctatcttaatcctatgtttcccaaacggtctacgatttgccataaacacacgagtttctcaggagcactaggtagatttgtcatgtttgacaacaacgtgcctgacagtaatatcttgctattgcaggtggccggaaaatgcattgttcacatgttgggaacgaggtggtccactggtccatgtatcattgtggtacagcgcttggttttgatgcaacagaattgcagtttagactgctcaatagaccataggttatttcaccgaaaggtttacatttcaacctacatgtccatgtaagaatcccgatgtaaatgtagaaattttgttttggaagttcatttcgggcctctcatgtcattgtttccacttcctgcatatatacttgtttcaccgagacagcctcaaagccattttcatttccattcgcctggtcaacgttggcaaaggccataaggcagtttccaacgtgcttacactactgcaacttacaaccatatccatcacgctggtgcaaccacatcccctacacacaagctcacaaatcacaatgtttgtctgcggccttattctatcaactcattcatttggttttgggtaatctatcaattcattcatttggttttgggtaatcaatggtgtatgatcgggtcgccattttgggtagcaaatgatgtagcttatcacgaattcacgatagggcatggctgctatagtgccatctactccctggacatatagtactacgaatctggactagtcccatgtccaaattcataatactatatacgcagtatcatctacgacgggcgtacaggctgctgctgcgtgatgcagtgtatgtttccccctgccagcacgatctctcttgcgccttccaccatcaccacctgaaattcacgggttccgtcagaacacccagcacagttttgagttctgacgtcgtagccattgccgagtaacaaccaacagccactgcttgcttgagctgtggtcgctgacagacagaaatcacagcatcgctggataaagtttcgaagtgaaatgggtcagtgaagatcacctcatgatcaggaaatgccttctgaagaacagcacacgcttcttcgtcccacttgtcgccaaaagctggtgctacaattccgccattggctatgtagaagtttacgtacgaggcagccaatctcgtgcctggttccctcggtatagcatgctcctagaaaaaaaaaggactattcattcttagaaagggatgaacacgctcattttcaatggattgaagttagtaatgaatatgacagaaatactgactgtttttacaacaccctctgactcttcctttgtcatgtacagaggccctgggacgtggattttcacaacttctatctgccgtcctttcgcatcaacggacttggagagagttgagagtgcatcaacggacctttggtactgtgggtcgttctcatcatcggtccatgacaagaggaccaccccaggtttaatgaagcagcatagattgtcaacatgaccatttgtatcatcatcacctagagaaaccattgcaggcctatttatcagtagaatggttgaagaagcagggaacagaactattatggttttaccctttatgtgacagaatgtttttggtggttaccataaagcccatgaggtatccagatgacctttgcgactccaagaaaatccttcagctcattctctatctctagtttggtcatgttggggtttctgttaggattcaacaagcattcttctgttgtgatgcatgacctgttggaatatggcaattcattagcaagataccaacaaatatactgaaactatatgcttgtcagcaaagattcaacacatgaacaaccttctccatctacatgaatgcttccaccttcaagaaccatcgtgtgtggaatctagggatcctctcaatctcactatctgaaatcaatgtccaaaacagaactagttctcagaccagatggagactagcaaaagatctttttgaccttgaaagatgtcaaattttctttaagaaggttattctcttcttactttcttggcaacatagctgtcaaggctccaatcaacatagcaaccatcagtggctcctgcaggcattagcagcacaattcactgaatcttcatacggagcaggtgcaaagaaactagcatgtcttgataatgtacgcttttcacactgttaataacagacacaagcacaaagatttaatttgtgaagaaaaatgtttcatcacacaaacaatctaattgaaataaatagcatgagaaagaactgaataaacatattactcaatataagaacaacatacctccccaggcgttaaattcccaatcaattcctgctatatttttttctgtgattcctaaccctggtgcacctttacgaacaataaactaaaaaacagggatactgttagcaacccaaacactggagagcaaatttggaataagaaggcttgaagtagcatacagtgggaccaatatcacggaaccagcaatcattcatgctcatctcgaccaccctgatgtttggttgatgtagcattagctcatggacatagggatactgcatgaaacaaaagtatgaattggtaccactgtgcaatcagacatgatcgtgcaacaattcacaacacagatcataggaggcaatgtggagaaaatctgttacctgcttggcacttgcacatatagtaacagactcaaactttgaaatggcaatagcagttcttgcaaatacttttcgagctggaccagcaagctctcgccaattgtctcgacgctcctgggattcaaagtaaaaagaacaatgctcactgttaaccaaatgctcactgtagtatagaacaaggattggggaagaagatagatgaaatggatacagtctgcttttcatattcaagaccacagtccaaaatgacaattattgatattgtcaagtggatattccacctaaccactccctttcggagttacatatactaaacagcgattagacaagacaaaatagggcatgtacagggtagagtagtccacagatgtcactgcaatgatcaaacgatcattcatgattataaaatacatatatgtagaaaatgtcaatgtgccagtgtttaagcaatgtgccacagcaacgtgaaccaagacaagacaggtaaatatctctagaatcgtacatcagaaaaatcagacagcaaagaaaatgatggtcatgacttatagattgagtcaatcagggatagggaacagtagagctttaatagcgtgatggtcccaaaattacaactttatttatgcgtgaggggaaatgattcattcatttgtactaaaaaaatgaaaaaaaaaatcattcttgaatagttttaagacaaaaatgatactgtcgtttggacaaccaatgtagccgcctacttaaaaagtaatccatgtgcttacaaatcaagagtaataaagttgtggatgttccggtgaggcggtgatagaatccagcctaaaatatgctcgtaagctagtaccgattcagagattccaacttgacgagaaataaacaataccccaaattgctctgtgcactttagatgggatggattgatccgagaccgcggcgcgcggccatccatcaaatccattcacttgggaggaaaccaaattctacacgacgcggtaggatttacttgtttcttctttctttttttttttggttggcgataaaaatcgcgaggatggatccatcggaattcagaatccaaacggagaagcgaagaacaattaaacagaaaaaaaaaagatgaggaaccagagggagagagatgagggagaagtacgtacaggccagcccatccagcactgctcgtgcggctcccactccgccggcatccggaaccccatcttcgccgggcgcccctccatcgtcgtcgccttcgccatcctccttctcctcttctacctgatgaaccacctctcctcttcctcctccctaaacctaaatatccaaaatacccgcctgattagcgcccaattggcgaaggatctgcgctcagcaaaagcaaaagcgatgggaaaaatggggcgtcccacgactcccacccgcatcagttgctttatatacgtaggcggcggggctaggcgccacgtggctggaggagagaggggagtggggacccttcccaacagcttcgcgtgaccaagtttggccacacgaacctcagcaacttttgtcagaaaaaaaaaaaagcaactccacgagaaacaagaaagcgagaagccgtcagggagctcgccgtcgctgcgtggggctcgccggagtagggggcgctcggggagcctcccgagatccgccgctcggcgccgccgccgtcctccgggcggagctcccgaagctcgcccccctcgcgcgccggtggcgttggcggggcccgcggccgggcagctccggtgctgcgcctccaccgtcgacgacggcgtcgtcgccgcagccgtcttccgccgcgccgctggacgccgccggatctgccgctcgtcgccgcgtgggcccctccacccggttggaggaggacggagagaccgacgaggaagaaggaaggtcgcgatgcgctgccgcgggggccacatgtcattggtggggcctacctcctcagatgcgctttggtgctgtgcaaatgtaaccactagatatttttttacactttggtctctataaaactttattttgtaaataaactcctacttaaacttaggttatgttcggatacgatggttacttaaaacaggacgagctattagcatatgattaaataagtaattaaaataaaattgaaaaatgggttatatgattttttttaaacaacttactagcactttggtaagcgtgtgtttgaaaaaacgagaaagtataagttaggaattggtatatctgagcacaaccttactaagtgggcatttttctcgatgctaccggggtgaaacatttcatcgttaatgatactagcgcagacaccctcgcttccttagcaaccaagcgttcgagatgtagagccgtagagggatcagtgttagcctctttagcaccgatcctctccatgtcaatgaaatggctaccacggaggataaaggggtgtcggtgccagtgttattagtgacccaataatgttggcactgaggaaaatagtctattttaaaattagtttatccacagatctactctctctatttctatttcatgttataagtcatttcatttttttctagtcaaaattctttagatttgattaaattatataaaaatttagtaacaaccacaacaccaaattatttacattatatataacattgaatatattttgacaatatatttattttgtgttaacaatattattatactatcttttataaatctgatcaaatttaaataagtttgactaaaaaaatcaaaataacctactatttgtaataagttttcaagcagagctaaaatgtaaaaaaaaaacccacacaggaaactggggattggggaaagacggcgttgctggtttgatggtttctgttgcactgacctcccacccttggggtgggggcggggaggttgtcagtatcggtgtgtggggtggttgggggggggggggggggcggtatgnntgtggcnagcganaatgccgccngcctcgaagacttcgatccgtgaggacggaaggaaggaaaatgaattgtgatcgagaccgtgtcgttgagaaaactggatgtgtctccacgtgacgcggaccaaatcattggcttgaaagaaacagggcgctataattcctccaagtcatctacacaatgtacagcaacatatatacttgcaacgtaatactctctctctctccgtttcaaaatgtttgacaccactttttttaagtacgtgtttgaccatttgtcttatttaaaaaaaactaagtaattatttatttttttatattatttgattcattgttaaatatactttcatgtacacatatagttttatatatttcacaatttttttaataagacgaacggtcaaacatatgctaaaaagtcaacggtgtcaaatattttgaaacggagggagtatgtgtaatggaggagggttgctcttacttaatttactttactttagatcaagtttaagttgatgcgtgtgcgtaagtttgtattgaggggatatacacatggtgaaaatcgatgagttataactaaaaaattttcttgaccgggttcctgggtacccctcccatactctacctccacgctctgctaaggaatgggatatactacatgtatggcattaagcatatctattacggagtagtaatcaaccaatattattattctctctcctctgtctcttactagttatttcatccgttcaacaaagaatcaactagtattggatgtgccacatctagattcattttttatgggagagggagtaccacttcatcattaaaaattccgtgtggcactttttaatagattatgatgttacatcatttttttattgtcagatatatagagagaaaagtataatactatttagtactacgcactccctccgtagaaaatatgcacgggacccattcatcattcacacgaaaataatgtgggacccacatgtctatcctctttccttcttccttctccctttctctcacttctctctctctttctctcctctttctccttgtctgcacgccgaggcagttggctgagggccagagcgacggcagcgagcaggagggcgggcgccgccttgagacggagcggcgacaacgcggcatcgaggcggagctacctctcgtcgtcctcaaggcggagccacaacacgtcttgcccttgagacggtggcgcgaagcgaggagtggtctccagcgacgccttccactgacgaagtggagcgataacgacgagcttcagcgtggagcgttatccccatcttacttgacgcccgacgccttccaccaagccatcatagacgagggggacctgctcatcccgctggtctatgtctggaacaacaccaccttcgatgattccatgtcttctagatcatcttggctgccccaataccccgtcgtcacagctgtccgcaagggcgacaaggagcatctccgtcccaaggttgatgtagccatcggctgcgacatcgatgtcgagattggccacattgaggtggatgtcttgcgcctcacctcctagctccaccaccgcgccctcacccttccatccccaccgctagggtggagctcgccactaacgccgctggggaggaacccgctaccaccgccgttggggaggagaccgccgccaccgctgctgggctaagaaacgaggtgagaggaataaagggagtggtaggtgaaggacctgtggacccacatggcagtggattccatattttttttgtgtgaatgacaaatgggtctcgtacatatttttttaattctaatacacataagcgtcacgtcaacttcacgtggaacggagaccgattcaacattgccacataggcgccacatcagcgaaaccgttacccacaactgctgatggagtcaaattgcgctggttttaatagttgggggttgaaatatcggtattgcggtttagggatacgaagaagattcgttcactagtaaagaaagtcaaagtgaactaatcctcccatccggcatccccaaggccccgaaggagcttgggccaaggccacaagcacaaggctaaaccgagcctgtagccgcaatagggcccagcacagcaccgcagcccatccagtaacatcaggaaggcccccataacctccaactcgtggataaaaatgaaaaacaaaacaaaaaaaatattttcccctctaatcttcctcaccattcgcgcatcacccagcagacgtcgcggtcgctcaagcctcaagtgcgcaatccaatcaccgcagccgctgcaatcctcctctcttctccgtaggtaattccttcgaacacctcgcgcgcgcgcgtcctctccgatcgaatggcgtagcggctgggttttcccgaagagagcttgattgattggcatggctgccgtggtggcggcggcggcggcttgcttgtcccccgtgtgcgctgccgctgcctccgtcccgcgcgctcgggtttgcttcgtgagcccccccggttcttggagctgcctcgccgcgagcaatggccgcgggttgcttcgcggtgggaatgggatgcggttgcggtggagggcaccggtgcgcgccaaggtggacgaggacaaggaggccgggctggggttccgcgagccggaacggaggaggatgcggctgcggctccggccgcggctgcgcctgctgtggtggcggctccggcggcggtcgccgcgggacctccccggggacgccgcggccgcgctgcggcgcgccgctcgacgcgtgccgcccgccgcggccgcgcccatcgtcctcgcggtcctcctcctcgccgcccgcctcgcgctgcccaagaacgcggccaaggaggtggcctactcggacctcctggctggcctccgcgcgggcgccgtcaccgccgtcgcgttcgaggaggactcccgccgcatctacttccgcagggccgcggacgacgggggcggcagcgacgacgccggcgcgggcgcgggcgaggcccgcagaggcgccgcggcggcggcgaggtggccgtgctacgcgaggagggtgccgcacgacgaggggttcttgctggggctgatgcgggacggcggggtggactaccggtcggcgccgcggccggcggggaggctgctggtggacatgctgagcacgctgctcacgctgtgggtgtcgctgctgccgatgatgtggttcatacagcggcagatgtccgccggtggcggcgcagagaagcggcgccggccgaggaagcagcgagtggggttcgacgatgtccagggcgtcgatgaggccaaggaggaactcgtcgaggtgaatctggattctctggctactgatttactcatgattttgatgagtgtgcatagataacaatcagtagacatgatacaatgtgggggatgaatgggaatgcaaattatttatacccaaatgttgggactgcttatctttgcttgacttattgaatggcttgctattgataatgcagatatctaggttgataatcgaggtagctatggtttgctcatgattcattattatacatgctaatgctactgtatctacctcagtagtgccatctgaactagcttctctcttgtggggtggatgggaaatagaaaaatgggtttgggatccatgtcatgttgttctactgatgagaggaagttgtggagtgtaggacataggaatgtgtcaacaaggtgttttgaaagcttaaatgtagattcaagaatcattttgttgattgtgctgcaaattttacattgtttttgttgtaggaaccatatatctgctccattccattatctgaaaatatatctgctccatatttgttttgtggatcctcagttgaaaacaaaaatactgggactgggaggatatctgaaatataaatacatatatatgatagaaagtggaagtataaaacagtaatatacagttggatagataactagtacttccattttttaactctcaactctgaagttcgtgatgattgcgggaatgttaataactaatgcatcagtttcaattaatatccatgttcttaattttcctcgctagaaataattgagtatgtattaaatgtgacagattgcaattttctaacgcaggtagtgagttgcttgcatggttcactgaactacaagaagctcggagctaaattacccaggggtgttctgcttgttgggcctccaggaactgggaaaactcttctggcaagggcagttgcaggagaggctggaattccctttttctctgtttctgctagtgaatttgttgaagttttcgttggaagaggagcagcccgtgtaagggatttattcaaggaggccaaagaagctgccccatctataattttcattgatgaacttgatgctgtgggtggaagtcgaggtagaagttttaatgatgagagggaccaaactttaaaccaggtaggattctagcaccttgattttatctatcctctgattcaaatgatactactgaatgaagaactgcttgctttctctatcaacagctgcttactgagatggatggttttgactcggacatgaaagttattgtcatggctgctactaataggcctaaagcactggaccctgctctgtgtcgccctggtcggttctcaagaaaagttttggttggtgtgcctgatttggaggggcgaaggaatattttggctgttcatttaagggacgttcctttggaagaggatcctgaaataatttgtgatctggttgctagtttaacaccaggattggttggtgcggatctagcaaacattgtgaatgaggctgcgttactagctgctcgaaggggtaggttaaaatttatgttgtacatttgtacttcacttatcaccttaatgcaagtaatattattgctacattgaacagctctttgagttacaaggtttagaaagctagaccatatatgccttctttattcttctcagagactacaactgaaatgttttccctttaggtgccttgacttaattcaccatattttgatattttactggagaaatcataataaacatgctattgacttttatctactttcttgttgttttaaggatggttaattcattctgatggaaaaatctgctattgaatatactgatcttggatttttacaggtggcaatactgtggctcgggaggatattatggatgcaattgagagggagaaatatggggtcaatggtagacaagagaatgctgattctgaaaggcaaggcctcactaaattgtttccatggttacctaaacctggaaatagaccaacaaacccagatgatattggaggagttatgggatatcatacattaagctaactggaggctttgcaaggtatcatttgagatgttcatcaaacttatatttagtaggctttgcttaatcccccatcagttgaatctactccgaattctttaattgaacatgaaatatgtcttgttagtttctttagcaagtccttactccttagtagagaccagcataggtttgcaaacattacatttgatggatcacaaacaggtgtaaagtgcactcatctttagcttgtgaaattagagatagaatagatgggagttgaaaaccttacgttctggtcatttggctactatatagccaatctagtttcaaagtttaagttcaggatttatct

SEQ ID NO: 46753 - DNA, 1268 bp, Oryza sativa
  unsure (1)..(1268): unsure at all n locations
tatttaaactgcaacatccttatgtggccttttgtttctgttgggcaggaagaaagaagttaagctgcaatcaaaatggtgtttgaattgccaacgtacatgggaacatgtcggttatagtctgtaggagcaaatatgcgtctctactgtacatgtgaaggatactgcactcttctgagttttggggctgcaaatttaggtgcttggaggagaaaactgccaccaaatcagaagaaatcaagcttctgaatgtgaaacacggaggtccaaggatttcacttgacaacaatcttgcgctctgtagtctttgctagaagcactacatctggttttgttccatagacaaattgttaatagaacaattagaattagattacaggataaggtcgctccagtgttctgctgtatacataccatcagccattcagctcattcgtgcaaaccagaagttatgctgctgctgggtccgcgacaatatgtaagtttgcaaatcacaattagagacgagcactccttaccatttcaaattgtgcatcgctttgctttacctaagcactagtctcttcacgttgttcatcatttttcttcaactgaactttctcctactgctaaaattttataaatctgcaggtatcaaagtatgaatagattatacacctttcaactttcaaatttgaacttctcggtagtactcattgtcctgtgttatctatgtgccattttcttctgcatntgcttggtaaactctgatgtgtctgcatgacttcagcattactgctaaacctgatcacaaacaggggattactggtggattgccaagtgggttccatgacagttagtcggagaacgacccggcggcttgacccagaaaaaaggccatctgctgtcagagacacacatcccgtcctgaagacgacatgaccttaataattgggaagccatgcaatggctgcagaatcaggacatatacccttgagacaaagatgaagcttctcccagcaagaaaaaatgttgtgtaaagggcagagctttggcatgtagacctcgacctgtcatacaccggaatgaagggtgtggtttggctttttgtgttctttcttctgggctgcttaaccaaccatgcttatctctgcaggatcaggtcacagggatcaaaggggggaataaaatggaaactgatgggaataaaatggaaactgatttgtagctttcaatgtttcgttctcagctttgctattagctttctcctgatgatttagaggccatgg

SEQ ID NO: 46754 - DNA, 1402 bp, Oryza sativa
attaagcaaaagttacaagaaaacatctgctgagcctttctaatttcttgtcctctctttttattttcagtcattcaagtatgtttcatttcatagatgtgtatattagcaacgtaatcacatcaaaatccacattggcgcgcactcatcatcccatccaactatgcacccatcacaacaattactatccctggactaaatagctactctaactgcaatagatcgagagactcctctcctaaactaaaactcataaatttcagattggattatccatacacctcatgtttgttcacgcttttcacctatagaattatcaacttttttttccaacacatctagcgataccttccgcacattgtgaaatcgtaatctcaaaaaacagcacctgattttagacttcaacaatcaatcaacacagagcagaactgcatccagcgtcctatcctcgatctacggcaccaaacaccttaatcgaagcaaatatcagcgaaccattgcgactatcgattccccacatatgccacagctacatttactaaaaagcgaagcaaagcggtcgcacctcgattccatcgatgggatcattcggatttcgtcgctaatcgaatccacgaccggggcatcaaaacgcagtatattaattagagagaatcggatccgacgtgacgtcttctcacctgaccgctgcggccgagggtgatggtgacctggtgcctggatgacgacgccgaggaggccatcgccgccacccgccggtgagagggacgacgacggcggcgctgctgggagggaggagcgggaggcggcgcggcgcgtggaggagaggcgccggttagggtttcggggggaatggattgcgaattggcgattggccgattggaggcgtggagtttaccggcgctcgagacgggagggggagggactcgctttggtggcggagagtttttttttttcccttttcttttgatctcttttggattttgggcctatttcactcgattttcaaatttttttcgttcattttatggtctctttttgcgatttttttctcgtcttcaaaatatacagtgctgttttttattttcaaaatcagggggtcttaagcaatgacaacgagattgggggttccatcgagtgaatatggttaagaatccaaatcctgaaattgatttatccagggaaactgtcgtgacaaatttcgtcttttttatgccctggtcttagcttacgtatgtttttacagtataatctctctgataaaaagttactcctatttgacattcagaaacaaaaatgggttaaactttttaaattctatcaatcagttttatatattaaaatagatttgtagtggttttttttatcaaaagcataaactatttatatggccaaagcaata

SEQ ID NO: 46755 - DNA, 11919 bp, Oryza sativa
gtaattgcattgtcaaatgtcaagccatgtttgaatgttggaggacatgctttgttgctactgcacattgtaacaccttgtgaattgaatatcatcgataacagggcttattaaggtgttggtgccatgatctatcttacatgtgtttactctctgcatctttgctaccttaagagggggatttgttgaccctagggatgaaaacggatcaaatacggtcggaaactagctctatcatattcgttttcattttttttctctcggaatcagaatcggaaacccagatacaaaaacggaatcaaatattatcgaatatagatatggagcgaatatgaatcgaaacgaatacggtgacgaataattattgaaatatcaagacccctcaaagtaagcttcttaaatcgaggaagagatgtagccattagttttcaaaaacaaaacatcaacattttcaaattttatctctatttgtaagggcagggggagatagaaaatgttgtgtttactttccatacaaatttatgttatcatgaaacaaataaattaatgtgtatcactgaaattttcgcaggcacattaaaattttgaaaaatggttgaatgttttaaattttgggttgaacatttcaattagagttgagagtttcgaaattgaattaaacgttctagaatttgagttgaattttttaaatctgagttaagagttttgaattcgaactaaaacttttcaatttttgaattaaaagtttttaaaattttcagaattgaattgaaagtttttggaaatttgagtggttatttttcagaattgaatatttccatttgtttgtatgtgaattgctattccttgttattttttcatatggtttgtttttgttccacctaagtagagaaaagaaaaacatgtttttgcataagaacaccatatatctgatgggaaataacggacagtatccgaccactatccaattccgacgtatatcacctatatcatattcattttcatttctgaaaaaaaaccgaattcgtttccgatttcgaaaatttccagatatatgcgaccgaaactatccgaatccaaaaagaggtccggtcggacggaaactatccgaatcactttcaaccctagttgaccccgcctaaactccatgaatcagttgggctttcctcactccactgaacattttttgaagacccatatttttattagaaatagtggttggaaacaagtatatgggtgagggagaattcacacccagttagaaaaaaaaaacatatcatgacaaataggggtgggcaaattttgactaaatgactgatcgaatattttggttagatattcgacaaaacatttttcccccacccatgcttcatggaaccctttcttttggctgctgggagtatttgaaaggagcgaaataatctagtttttaatggagtccaaccttaggtccttgcatggaagagaaatctgaaagctaatttgagtcaacatttacctagactcaaggaaatgtatatgactttagtgcaatcgtggatttatcttttgtaatgttgccctttctccttcttatttgtaaattttcttaaaagttaatatatttattgtgctttcttcattaaaaaaaggccaataacaacatgtataccttagcccagcccaacaccgaggaaaatccaaaccaatccccaccccctcccccttcccaacacccacactcgagttggtactccccctttgcaataacctagtcgactccttgtcacatgccttccttccctcaatatacacaaggtggatcgagagatcggcgatggagatccaaatcgactatattgtggatgtcaacattgtgtgccctaaccgatgccctctcctcccttggggcgacgagagtggattgagggactagtgagagagagctagagttggcatgagcacggcttgtcctagcggctagcgcggatgtcaatggtaagtgttggccccgcgcgctctccgcccctcatggacgaacgtgacactgccatattctacctttttttatgatttctttgatttttttccatcgtttaaatttgttgatgattatagtaatgagaccaaaccgaaatacctaaacctaatatctctgtcttcattatttttgcaatgtatttcgatctccacttttagattaccagatttttcacataaaaaaatgagagaccaaacctcaatccgactgaatgcccatcaacaaatagtgtgatgataaagactgacaaactcatgtttaagttcacattgcatattcttctaaaacgagcttcgtgtgctagcttgtcttctatcccaagccacacctcaagtgagattgtggtgttagttgcgagatccggagatcatgagaagtagccgagaaaatctacaaagcttctagctagctattagtttgtttatgaaaactgtatctaatgggactcgaaatctggagtagagattatggtagcaactatagccatgagaagctcaccccaacacaagaaatgcaaaccccattgttagtacgttacacatgctacctctattgatgaacgaagattcctatgcactatcgattatttgtattatttctttctaccacggaaaaatagtttttgaattaattgtttggcctcaactttttccaaaatgttaaggcttatgaaagtgatggaataatccttaggctcacgttgactacttggctcttagttatgttgaagatgaacactgaacactgctctatgtgagggaatatttggtttagtgttaaaagcatacatgtaaatgtattttcaataggaatttagtgagattgaggatttgttggtaatatccatctcttttgagttaagaggatgcgctcgtgggtgtgtgatagtttagagtttggttgtgagtagtggggtgtgtgcatgtgcaacattgatttaatcgaaaataataagcattacaaattttaacgtcaccacattttaagtgaggcaaagaggcatgctctaagcctccagctagcacaatcctcaatggtatctatatatgctactgtaaagggggagcgtatcctatgtacacaggccctcacgtgtatacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgtaaccttaaaactgtcagattttttgtttttttttgttatggctaaaatataatgaatttgacgttaagattttaaccctaggtgtaatacaattgaaagtatgtgtatgattttttctagattttttggtgacattttttagttggtgtgcacgtgtgtacacgtgagggcctgtgtgcatatgatatgttgccctgtaaaggagaatcgttctccgcttcactttcccggggccacatgtatgcgaaaaatcagtgaggaaatagatcttgcacccccatctcctcttaagaaaacaaaatattttttttctagaaaaccggccatcaggaaaaatatatataaaaaagtccgaataaaaaccaaaacgctcggttttatttttatcccatgggatatgggtaatttgctactacatccatcttatattattctacccttcaaacttgtcccacaatataacagatattgatgttgtggtgcactgtactatttatcacatcaaccaactataatttaactttcttcatatcttatccccaactacaactcacccacaacaaactctcacttaacaggggcattatagtccttttattcttaatctttcaaaaagaaggaataatcctagtattatagaatgaatgcaatactatttgtaaatataaactcgacggtatgaaaccaatttttctttgtttagatgggctcaaatattggtcatcaacgcaaaacaaaaaattgtaattaacatatgattaattaaatattaattattaaaacttagaaattttatttatttgatttttttaataaataatttctatgtagaattgttttagtaaaaatacacaccgtttaacagtttgaaaatcgagaaaacagacaagttgaaacggagtttagagcgcaccctcagtttaatttcctggtatgggccaggattttgcatccgtttcactttcacacacggtatcttcccccggcgacggaatccacctattactccagtccagattgagaacgcgcgcggcccacggccgtcgcgcttaaacccggacaaggtggcgagtcctagtagtagaagtatttacggagcggcgcgacgcgatctcccaatggcgtcggcggcggcggcggcggcgtccgacgagcccccgcgcaagcgcgcccgaagcgccggcgcggaggaccggctgagcgagctgccggactgcctcctgcacgacatcctcgcgctggtcgggtcccggcaggcagtgcggacgagcgtcctgtcgcggcggtggcggggcctgtggcgctcggcgccgcgcgtcgacatcgaccagcgggagttccgccgcgcgtgcgggggcgaggagggagagccggtggtggactgcgacggcttcgaggacttcgccgacggcatactgtcgccgacgctcctgggcggcaccggcacgccgccgctggacgcgttccggctgcacctgctctacgaggggaggttcatcaccttcgggaggtgggtccgccgcgcgctcacgcgccgccccgcgtcggtcgacatccacgtcgagtacggcggcacggtcgactggccgccggcgctcaccctcggcgacggcgccggcaccggccgcctcaagcggctgcacctcttcggcgtgcacctgggcttcatctccggcgacggggggcggctcgccgagctcctcccggtcctcgaggacctgcgcatggagagctgcacgttcgggcacgagccatcatcacccaccaccaccatcgccatccccacgctcaggagcctcgccctcgccgtcgtgccccgccgcaccgcgaggccctacgcgctgaccgtcgcgtctccccgcgtcgcctccctgcgcctcttcctcccgttcagccgcacgcgcgcggccgcggtgcgcgtcgcccccgcggaggagggcgaggcgctcgcgtcgctcgtcaccgcgtcgatcactgtcctcgagacggaccaagagttgaatcggcgcatgaacaaacacaagctcgacttcctggcatccacccgcaacatgctcgaccgattccccaatgtcagaaacctagatttgtcagggttccccacaattgtgcgtaactgcgtatcccccattgctctctctctatttgaatctttcaacagttcagagcacacgtcgtttgcttttattttttttttaatttctagtttataagtattttcaacacaaaacaagcatattattaaaatatatttaatgttagatttaataaaactaatttaatattttatactctatgttgctaaactttttttaagaaatttggtcaaaattaacatagtttgattaggaaaaaaaatcaaataacttataatataaaacggatggtgcatttaagattgccatcattcactgcagtttgcagcgcatgggtccgagggacagaaattcagtaacctgcgtataactgcaaatgatttactggttcttttgtttcaggcactgctagacaaggcatcccaagaattcccaacgctccctagcttgacaaccttgcttctcagcgaatgcgatgttggagccaactgctacgtgctgaagagcgtcctccggaacgccccaaacttggagcatcttagattgcaccgttgcaaggtaatatgaaccatctgcgtcgtatcaatatcacatacgcattgtcagagtttcaaacacgatacgtttgaattcttgtgcctttggtgtttagcctctgaaattggatcactagtgcagttcttaggtacgccgaagaggaagcggggaaactccaggtcgaaggggaaatcttcttccacatgccttgactcgctatcttccaagtgcaagagcttgcagtcagtggagatcaagtttcggccaattgataatgctcgtcaccacgaccttgtagggttattgaaagaatgttaggtgaaacaaaacgtcagcactgcaagaaatcgatcagcgaaggcacggtaactatattaatacctattacatagaacatctcttgcatgactgcaaaggaagcattctcatgaagccacagcatcagtgatttgttatatattctagcccttctgtcacactcgagagtgtctattacatgcatatgatgtaattaatcataaactctttttactgacaaactgaagagattagtacaccaaagtcaattagaatcttgcattgctccttcactggggaatttcgcaatatagatgttggcagatgctaacaaggagggggggggggggggggacttttgatgtcatcctttcaactctgttgacttagtctactactacatctggcagcttaaagaaagtgaaaaatgtttctgttggcagaaaaatgactctttgtaagagcttcaccgcaacatggtttgtccctcaccacgattagttttgcaagtgttgtaattttaattttcagatttacaagtttttatttgaaatatttcaatcagtgttaagatctttccaattaaagaacctcaggtttcaattcaaatgttttgtttgagttcattgaggatggttcaaagcttagagcgcctgttgaagggcattgcctatcaccgtttcccgtcctgcacaccctttgcgtctacgatggtgtgacaacagaaaaggtttgcacgaagagtcagtcaggttctttcgacaccaaggtgatcctagcaattcctatgctcttgtaagaacatagttaaattctttcaggatgaatgtagaacgaataaacggagctagatttttttttaaggaatgagtggagtgcttacatttctcgggacaaatatagaacattagagataaaaattacatgaagagttgcggtcatagagctccttatgcgtcatagcttattgttttaatgttttaagttaaggcaacgtttggctaatgggaaagggccgaaaatgatttcccacccatcaaaaaacatctttaaatcctaactgttcattctcactctttcatttaatcataaccctacattcatttccaatctcaatcccaccttccattttccattatccaaacacaccaaggttgatgcgataaccatgtgtccacgttaacattattgttcttaataaaacaagacaatacattgtccaccgctatatagttagtatttaataagtccagagttcaagacaaagaaatgtatcatcagactttccatgcttcctattactcaccccgttctattttaagcacaatcataagtttccgtgtcgaactttgatcgtttgtcttatttgaaatttttttatggttaatattttattattattaaatgataaaacatgaacaatactttatttgtgacttatgtttttttattttttttctaaaaaaaataaataagatagacgattaaagttgaacacggaaactcattactgcgcttaaaatgagacgaatgcagtagaatcttaagagggattacgatgacttgcttaagggatatttgttctaggctattgatggctcaagcccgaattgctttaagcttctgtaccagttacgactgcctacatgatatttgtgtgtacaatgtattaacgaaactgtaatatatatatatatatatatatatatatatatatatatatatatatatatatatatctcattgataaatatctaatccaataataaaaatattttgacataaaaaaactggcaactcactatagcagtatcccctacacttggcggcatcagtcagcagcacgaatcttagagcaccacacattctccttcgtctacctccgtccgcccaacgccttatcctctactactacgagctctgctagttaaaccccgacttctccctcccaccacgcgcctcccgcgctcgcgctactaccctcacctcccccacacccaaatgctcctcctcttcctcccccacccttccccacctctcctcccccccgccgcctcgagaacccgacccccgccgcgcctcctcctccctcccatccacgcctccccctcgccggagctcctcgccaagtcggctctccgccgcatctccgacaagctccgcagcctcggctacctcgaggccgaccacccggaggcggcccccggtccggcggcgccggaggcgggcgccggcgcgtcccccggcgagatattcgttcccacgccggcccagctcccgcgccaccgcgtcggctccaccctagacccgagctgggccacgggcgatggggagggggccgccgcgtctcgccgcaggaggcgcggcgggagggatagtagcgccgcggcgtcggcgccgccgtccgccgcggagctggcgctgccgagggacgagctgcggcggcttcagggggccgggattcggctgcggaacaggctcaaggtcgggaaggccggggtgacggaggggatcgtgaacgggatacacgagcggtggcgcaacgcggagctcgtgaagatcaggtgcgacgacgtctccgccatgaacatgaagcgcacgcacgagattctcgaggtgagcgctgccccgcgcatatgataatcgagtccagcgtaggtttgtagctgtgcgcctgtgcctcgcctagtaagtaaaacgttcagaaaatttggatgccggaaggcatcggagtgctactatatgttgaaattgcacagagtattagttgtatgttaattctgaatttcatcgcacaatgtgacagggtaagatgctgagtatagtaatatagtgctagcatatgattgtgcccacttcggaagtccctgttagcatggaaatggcagcatgtttattcaaaagggatacaactttgaagtgatcaaggattcaagatagggatattttatttttaattgtttgaaatgaatccatttagcagtgtactggcatgcacataatcattccttcttcgaagcattttattataccaaattccaaggcatttcttggattttctcttaaagtaatctatctcaatttttgttttagggcatttctatctcaacgcttttcagtttgcaattgacatgctcaatgtgtttttttatagagaaaaactggaggcttagtcatttggagatctggaagcaccatcatattatatagaggaactgactataagtatccttacttccatgatagagaaatgaagaatgacatggatgagtcatcagagcatacaagttctgatgacgaggacgcggatcttgctataatagcttccgaacaaagtggcagtgaagaggattctgataatcctgcagaacatggtagcaatcatactgaggagggcgatgatcttactagacggtttggtgttgatgcgcttgagggaaatttagacattggatctgcagagcaaagcattaacagtgctacaaaagatcagcaagcaatattacatacaagcactaatgtgtctcgtcctagcgagatcagtggtcgagctcggtcaaccttagttgctggtgttggttctccaaataagtttcggttacaattacctggggaggtcaaactcgcagaggaagctgacaaattattggatgggttgggtccacggttttctgattggtgggggtatgaccctcttccagtggatgctgatttgttgccagcaattgttcctggataccgtaggccttttcgtctgcttccttcaggagtaccaccgaggttaactgatagagaaatgacaatccttaggagactagctcgtcccctaccctaccattacgcacttggtaatttctagttatttgtcttgtataatatctttcatggctttgactttgataaggaccactgttatttactttcgtggtgtcatttatctaggacgaagtagtaaccttcaagggttggctgcatctatgatcaaactatgggaaagatgtgaggtagcaaaggttgcaattaagagaggtgcagagaacattgatagtgatctcatttctgagaaactgaaggtaggttggtaaagaacccagctatgaggaattaattgtagatatgtaattattcatagcatttgacatttctcgagcattcttgcgataaaacattgatgacattacagatttatctttcacgtgtcatcgaattttgaaatgtaaatcatttgcctgtattcctaatttcctatcataattgaagttgaaccatagcagcccagaatttttacatgttgaatcaaaatcacttctttttatgatatatgttccctcatactcatgcatattttacatgcagtatgaaggcacttaacaatagattcatattttttatgtgtcgccttgatttatgtggcaccaaatattaggaaaatacactttagtatctctttctgatgtgaaccatttcagcacaggctccaggccttcaacctattatatcctaaactttccattatgagaaattatcattacaatcatcagtttcaaaagaaaatcagagaggagggggggggggggtatgttccaccatgacattcttaatcttgcagggcttgacaggtgggacccttttatcaagggataatgagtcaattgtattctacagagggaaagatttcctgcccacagctgtctctcttgcaatagaaaagcgtagaaagtatggcaattctacaatcagtaaccctaagcttaattttgacaaaagcacaccgcaaaattcttctaaactgaagatggctactgatgtctcactagatgggcatgaatgctatgaaaagaagcataaagatgaaactgcagtttcagataatagagcagaatctcttaatgtgtttgcccagaatgttgaggccagattatctcaggtttgcttttcttttctagtagtgccatctcttgataattttgatttggtagtttgaaaagaaaaacacttgaaatagttaaattcatatagaaatattgttcaggcaattgcagagaaagagaagactgaaaagcttattgaagagctagaaatgtcgtctgagccttctagagctgaaactagagaggttatctcagaagaggagaggtacatgttgaggaaagttggtttaaagatgaaatcattcttattgctaggttagtattctcctcaaccttgtattgtgcagcatgcatctgttcagaagtcaaaatgctacctaatttgactaccaaattagttataggaaagtagattaccagacagtgttctccttggtgacccctaggcattcggtgtccgctccgcctaggtcagcaagctgatttttcccgcctaggaagcagttaggcactaggtcccacctatggccgtgccatgtgcctactgcctagcaccaagggaaacacttctatcagactgtaatattaccacttctagagttttcatctgtttagctcataccaagtggcattttaatccttgtaaatcctttttgtggagacagtgtgagtattatgtggttttttgttactttgggagtgcacatatttgaattagttcggtcatctgttgtgattcatcgcataacctccttttgtaccattctatacctgtacatgatttgactattattgcctttccaagcagtagcatccgcagccctaaggtcaataaacaaaaagagagc

SEQ ID NO: 46756 - DNA, 748 bp, Oryza sativa
  unsure (1)..(748): unsure at all n locations
atgttttcgtagaaaaacagaaacaaaacttaagaaacctctgggttgagcagtaccgtgcgaaacaggtgccgtaggtcgaggtcctgctccgacggtaggcgcgcgaggccggggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcatgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccccagtcggtcaacgggtactgctgggtacacgtntggaagcccnnaaaagtggcgccctgcatagctgttcccccgtcgaggtcaacctgtgaagagaggtaaattatatggctcgatgaagtaattatcataaaaatttaaaaatggggctgcaggaa

SEQ ID NO: 46757 - DNA, 1265 bp, Oryza sativa
ctttgccgttggctgcttccgatgaccggcttgccgtcggcaagacgctctcccctggcgccaccctcgtctccgatggcggcgccttcgccatgggcttcttctcgccgtccaactcatctggactgtaccttgcatatggtacaacaatgtccccaagctcaccgtggtgtgggtcgccgaccagctcgcccccatcaccgaccacccttcttcttccaagctcgccatggccgacgacagcagcaacctggtcttgtccgacgcggccggccgtgttctttggaggactaatgtcaccgccggcggcgtgaactcgtcgggtgccgtggcggtgctcgtgaactccggcaacctcgtgctacggttgcccgacgacaccgccctgtggcagacgttcgagcaccccagcgacgtgttcatggccggcatgaagctcggcatcgactaccggtcgcactccggcatgcggatcgtctcctggaagggcgccggcgacccgtcgccggggagcttctcgttcggcgtcgacccggagaggccgctgcaggcgaagatctggaatgggtcgcgcgtgcactggcgcagctcgatgtggacgggttacatggtggacagcaactaccagaagggcggctcgtcggcgatctacaccgccgtcgtctacaccgacgacgagatctacgcctccttcaccctctccgccggagcgccgccgatgcactacctcatgtcctactccggcgacctccacctgcagagctggagcaacgtgtcgtcggcgtgggtcaccaacgccaggttccctcgccgcgactgcagcctcttcggctactgcggcgcgttcggctactgcggcaacagcaccggcggcggcggcggcgccgggcggcgtctcgacgtgccactgcctcgaagggttcgagccggcgagcggcgccgactggagccgcggcgacttctcgctggggtgtcgccggaaggaggcggcgcgctgcggcgacgggttcgcggagttcccggacatgaagctgcccgacgggtacgcgctcgtcgggaacatgaacgccggcgagtgcgcggcggcgtgccgccgcaactgctcctgcgtggcgtacgcctacgccgacctgagcaggagcacgaggagagatccgaccaggtgtttgatgtggggcggcgagctgctcgacatggagaaggtgaacgagagctggggtgacttaggcgagacgctgtacctccgaatggcaggtgcaggtaaa

SEQ ID NO: 46758 - DNA, 6058 bp, Oryza sativa
tctataataccctcaatactcttaacacccccactcaaatgcaatgtgtatgcaataacattgcatttgaaaggtaaactaaacactagaacacaatccaaatattagcctatctccaaagccttgatgatgtcgtcgaagtgtgccaattctaggatgatgaagaagaaaagatgtatccccttctcaatgaactggaccttggagccttcacaaactgttcttcggctcttcattgattcggagatgttgatgatgatgatgatgatgacaatggaccttcacaaactgttcttcggtcctttgactgatgatgagacattgatgttgatgaaggcccttcacaaactgttcttcggaccttcactgagtgatgatgatcatgttgacaagctccgacatggagatgatgaagtgacaatgaaggccagctccgacggggaactggtgatgattaaagccaactctgacagcgagttggtgatgtagaaaagacaatgaagagatgaattggcatgactttgacgaattgagggtaagcaatggatttggattgactcgataaattgtagagaaatttgactcaatgatagtagcagacactaagtagtagcaaaagagatgaactggtgcaaattcaacaaattaaaggatatgcattggagtattggacttggatggacttgatatgaaatatagtaaattgatgaccaagacatgaaattgatttgaaggcttatcgatagtagtggctgcaaaaagaacaatgacagtagcaggaacccattcttcaatcactaattagctgtaacccagctgcataaccaaagagtccaagagcctcaaatctgctcctatctatcctgttgctacttgaccatgagcatacacgcaacagaaaaacaaagacggagagaggggttgatgtggatctgaagttcaggaatagcctgggacgatgagaagatgatgacgatgagcatcggcggctggccggctcgatgggtggacggcagcggcttgccgcaatggacgacgagggcctggccggcggaggacgagcacccacgacgggggcactgattggctgattgctgctcctgtttgtttgctcattggagatgaactggagaacgacaggctcgctgctgctgccgcttgaagaggagaaagcaacaatcagtgatgacgactgcctttgatgcggcgggcggcggcccagatctgggcggcacggatggcgcgcgaccggcggcgatgaccgcgacttccgccgcgatgggctgtcgatggacttgatgacaggagaacgaggaagtggtgctgctgctagaacctttgctgattggggacgaaactgagctgacaacggtgctgttgcacttactactactcaatgaggatgtggacgggttagttgggcttgccggcggcgagccgccgccggcgtgccggcgtggacttggatcgacggctagggtttgctcccttgctctgataccatgtcacttttggagagaagatagaaattggggatttcaactattgcaattgacttagctcaaagagcatataaatatgtacaagagaagtagaaatgtctataataccctcaatactcttaacagaatgagcatgctacatatacatgtaaaagagtagaagtaagggacaaaccgtttccaagtatcggatgcttcatgttttcaccatgccagctatcagatggcattccctggcacatctgatgacaattgacaagtacctcattagtcctgataatgtctttgtactaatgagcgaactaaaacatctgaataaatagtaagaacctgttttatgtctcaggggatacagttttcacatgctcgatgtctaggtaattagaccacaatccatcaccttggcttttagcttcttcttcaccagctacatcggcaagctccattcccaaacctccaaacctttaaacagcgcaggtgctcttttaccgttcccacttcccactgaccgggctaattaatggtacgatggatcaggtagatgcagcaccagcaggggtgaaacggcttgggcattccgtcgaacacgtaggaggcgccgtgccggcggcgccaccagcaactctcaggtccagtccaggccaggccatgcaggaggacacaaggggataaaagaggaagcggtcgcccatggcagtagagtggcagagcaagggagagccccgcgcggccgcgcgcgcgcgcggcgacgagccggaacagtgacgacgccgcggcgaggcgacgagcgccggcagcggcggtttgaaatgcggtcacgtaccgttagatcaaagtactaacggcccagattgatagtaggcatcaagtggatattttcagatacaccctactaacattccatatttttgtctcagcccctcccccttggcttgtattttagcagaacagaagcaatcattctactgaaatttttttgtttttaaccaaaaatacagaaagaacctataaaagaaaatacaatctgacctgctccgagatagagaaaaaaattgaccgtgccttactcttaaagatcataatcggtactgaaacgtgacaaattagagcccatcggttgccaaaagaataagttaaaattaaaaattaattttgaagttgactttatgatatttttaacaaaatttatttttatcattaggttttaagtcgttatgtcggtgatatgggaccgggagtatcgtgaccagaggcttgaggcagacacaatcgcccacgtggcctggcaccttcggggacgtcgggcccgagggtgaggtgtccgccctcctcctgatttcctcgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatgcacgttgctaagctgacacgtggtggacaaggatgactgatctgtgaccagtctgacactggtcgcgtcatcaacagacagccataatcccacgtcgcacctgtttccggcggaagtggggtagatatgggccgtcccgtcagaagggcacccggacagcaaccgtaccgatctccgtccgtttatgaagagaagaacagtccagtttggagagggagaggggcatgtggtatccccttgagatataaaaggaggaccttgcccacttagatagagagaggacttttggacacaaggccttctccagatccgatcccagagcgattgggggctggttgacactttgttacttgtgcatacacaaatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcacgttacaaacacatatttaaaagttttacatataaattagtttttatcactaataagctgatacgacttataatttatttttaggtaatcgattcgatgggacccttagtttaatacgctctccgttcaaaaataaattaacttatgactataaatctaaacatcgctttttctagattcgttgataggatttaaatctttttgatggagagagcgagtaattactaattagtgctcaatttggcgacaaaaatatgaagcactactactgttatatcaaatacaggagcacataaacgcattttccaaacagaaattacaaggtgaccatcttgtttgaatcgttccactcgaagagaagcaaataccattatacgttaatacctgtcacatctctggctggtacgccccaatttcatctcaccagccacatgagtccgaaaatgtagcattaatatgataagctagactgttgcagcttaattggaaaggttagttgactttactctaagagttcaatcattgtctcattagttgtcagtatctcactgaaacgtgtggaattaatcttatcttactacttgttgattttggcataactctgtttagctacttgccatttgccaatactcgatattactgtaagtcttttacccatatgccattaaaaaagttgaaggttacgcgtgtgccacaaaaaagttttgagtcacctgtatgccatgacacaaaatttcgtttacccgtgtgccattccatccaccttctgttagagaatgagctatgacatgtgggacccacgtatgaaaatgactaaattgcccctaaagcattttcatctctactcctctcccgtgcgcctccactcgaaccctagcctagctgccgccgccgccggtcgtctccgtctccgtcgccggcgcgccaccgccggtcgtcgccatcgccggcgcgccgccgccggtcgtctcgcctcgccagatccggcggcgcgcccaagctggcgtgcccaggccggcgcggcaagccgccgccgccgccggtcgtcgccatcgccggcgtgccaccgccgcctcgcttcgtctcgcgtcgcctcgccggcggcgcgcccaggccggcgccccaaggccgcctcgcctcgcccccggcgcggcacgccgccgccgccggtcgtcgccgtcacgccgccgccgccagcgtggctgaaatagagcaagggcaaaatagacttttcaaacctctgttagtctccgttagtgctgattccatccaaagtggctcacaggtaaacgaaagtttgtgtcatggcatacaggtaactcaaaactttttcgtggcacacacgtaagctccaacttttttaatggcataggggtaaaagactcgtattaagaaccactactgcacaagctgggttctttggtggttaagtatacatctgtcccttcttggctggtacagtgaacccccaacttcatttcacctgccacatgaatcctgaaatgtagcgttgatatgatacagaaagctagtcacctgcaacttacaaatttctaaatcttctgcaacttacaaatttctgaatcttctccaatctgcatgcacacttgaacactatgtaagggtgaagttagctccatctccacaagttcaggcacaactgcaaagtgcaaggtcaggtcagctcatcatcaatggattggccagcttcagcttccacttgcatcgccatccttctcttcgttttcttgatttcatggccgtcactgtgcgcctccgacgaccggcttgccatcggcaagacgctgtctcccggcgcaaccctcgtctccgacggcggcgccttcgccatgggcttcttctcgccgtcgtccaactccactaatgctacctcgtcgggactttacctcggaatatggtacaacaacatccccaagctcaccgtcgtgtgggtcgccgaccaggcggcgcccatcgccgaccatccttcctccccggcctccacgctagccgttgccagcgacggcaacctggtcttgtccgatggcgccaccggccgcgtcctttggaggactaacgtcaccgccggcgtgaactcgtcggcgtcatcgggaggaggagtcggtgctgtggcggtgctcgccaactccggcaacctcgtgctccggctgccggacggcaccgccttgtgggagacgttcgagaaccccggcaacgcgttcctgcccggcatgaagatcggcgtca

SEQ ID NO: 46759 - DNA, 17684 bp, Oryza sativa
accagaagggcggcaggtcggcgatctacaccgccgtcgtctccaccgacgaggagatttacgccgcgttcacactgtccgacggcgcgccgccgatgcagtacacgctgggctacgccggcgacctccgcctgcagagctggagcaccgagacgtcgtcgtgggccacgctcgccgagtaccccacccgcgcgtgcagcgcgttcggctcatgcggcccgttcggctactgcggcgacgtcacggccaccgcctcgacgtgctactgcctcccggggttcgagccggcgagcgccgccggctggagccgcggcgacttcacgctggggtgccggcggagggaggcggtgcggtgcggcgacgggttcgtggcggtggcgaacctgaagctgcccgactggtacctgcacgtgggcaaccggagctacgaggagtgcgcggcggagtgccgccggaactgctcctgcgtggcgtacgcctacgccaacctcaccgggagctccacgagggatgcgacgaggtgtttggtttggggcggcgacttggtggacatggagaaggtggtcgggacatggggtgacttcggtgagacgctctacctccggcttgcaggtgcaggtatgtaaacgtacgtaccagtgtttaaaatagcgggctaagacatagcaagctaaatggagctatagcggttaattgtatatgagagcaaatagctagaactcttctcagacaagttattgccggagatagcgacggctatagctggagatttaaaaccttgatatgtacctggtgtttggatttttttttaattttaagattacacggaagacacaccactacacatttgtcatcatttgtttgggattttgttctgcagccttgtctcaacactactgatcctctgtaaatatttttataaaaaaactctataagaagaaaaaactgatcacaatttcatatatagagtggaattatatatgctttgcaaaagtatttcaaacactagttagcttgatgcaaattaatcaaggttcttactttgcaggtaggaagccaaggactagtgcactgagatttgcacttccaatagttttagcaagtgttcttatacccatatgcattttaatatgtgctcccaagatcaaaggtacccatatttattttcatgaagtttagtactttaggtccatgggtaaggtgatacatgttcaatgcattaataccctacctcatttttcttcgcgaatataatgaagaaattatcaagaaaaaatatggggagaataacaagaggcgggccttgcgagttttgagcatttctgatgatcttgggcaggaaatcccagccaaagatcttgagtttccatttgttgaatatgacaagatcctagttgcaacagacaacttttctgaagcatctttgattggaaaaggaggttttggcaaagtttacaaggtaactcattcatatgctgacctagataatttctgaagaaagaaaatgcagagtcaagctgatcctcctgaactttcagataaacaaacacccaaagtttatggtgtgatgtaaatttcttaaaaaaaagaagaagaaaaagaaaatcattcaaaatacaacatgtgagtattcagtgatgatgtttcttttatatttctgaagggagtgttagatggccgggaagttgcagtcaaaagacttagcagttggtctgaacaaggaatagtggagttcagaaatgaggtggtcctaattgccaaactacagcacagaaaccttgttcgacttgtcggttgcagcatcgaaggagatgaaaagttgctgatttatgagtatatgcccaacaagagcttagatgcttctcttttcagtatgttctctactagcagtctatcacaccacaagttgcctaattgtcacacacaataaaccattgatgctaatcaatagtgttgcttatttgcagagggtaaaagaaaatcagtgttggactggtccacacggttcaagatcgtcaaaggggttgcccgaggacttctttacctccatcaagattcaagattaacaattatccatagagatcttaaggcaagcaacattttgttggatgcagagatgaacccaaagatatcggattttggtatggcaaggattttcggcaacaaccagcaaaaggaagtcactaaacgagttgttggaacatagtgagtattgtccaaaccatttgcacagattaattaacctttttttttttacaattctatgtgtggactaactatttgaagtggtatgatccaattagtggctatatggctcctgaatatgctatgggaggtatcttttcaatgaagtccgatgtctacagcttcggcgttttacttctagagatagtaagcggttctaagataagctctattgatctcattgaggactccccaaatcttccagtctatgtaagcattccattttatgattttgcaatcacttatacaaagatccattttatgaaccggtaatcacttatacacctgaggtgtaaatctgatggatgcaggcatggaatctatggaatgaagggaaggcagacattatgatagactcaactatcactgcaaactgcttattggatgaagtcattctctgcatccatgtggccctcctgtgtgttcaggagaatctcaatgacaggccactcatgtcagatgttgtgctcatcttggagaaaggaagcaagtcactcccagctccaaatagaccggcttattttgcacaaaggaacaacaatgaagtagagcaagtaagaaatggtagccagggcgctcagaattctaacaacaacatgactctcacagatctagagggacgatgagaacactgttgtttgttaagagtgatattataaggcttaaggtgatcaactcaactagatgggctctaaacctacccaagaaaatttgatagggaaaggtgttttggttatatcttaatgtgaaagaatggcaagaatgtttagcatgaaaaaggatgataagaaattgatgtcgttactcatttatccttaacattcattaattaatcctcttctttttcgcatgcctcagctttaagaaagagatatggtcgatatttttgcaaacactagtactccctccaggctgataatacttgtcgttttagacaagggtgaggtcaaactttagaatatttgattatgaatcatttttaaaatatttgtcattcaaatatggtgattacgtgtatagattagccttaaaaagtactttaataaaatcgtatatttgttaacacttttatacatattataatggaaaataatagtcaaagttgtattttgaaaaccgtgctcttgtctaaaacgacgagtattatcaacccggagggagtagtagcttttatagctggggggtaatttcataaactttattcttttcacaaaatatatatactagtacaagtttgagtataactaaccgatgaacattttcaagtcaactggatgatcggttaattcctctagtacgctagtctagagagaaaggggaaaaaaaaaagaatagttggttattttggttcagccctaacgcctaaactcgtcaactgcgccagattgaacagttgtcaagcctggtttggggaaaaagtccacttcgactcccttcattgtaggccgaatctaattcgtgcccctcaaccgaaaaaccggatagaacgactccccgaactattaaaaccagtgcaatttgactccctcaacggttttggacagcggttttgctgacgtggcgctgacgtggcaatgttgacccggtcttcgtcccacgtggcgcttacgtggcattataattaaaaaaaatatctatgggacccatccgtcattcacacatacaaatacattgtaggacccactgacatgtagagcccagatgtcatcctttcttcttcccttcttcctcctccctctctctctcccttctccgtcttttctctccccattttctctctagtgtcccctccaccccaaggcccagccgccgcctcctcccttcctctcttctttcttcgccgacgacgccattccccaccggcgtgcggcggcggcgagggatttcgccggccaactagctccatcctcaataagataaaatcgaggggttggttgctcccggtggaagagccccgtggtctccgccgccgccccgcagcctctgtcttctccatccaccgccagctggcgccgcgtcgaaccaccacaagcgcaagaagctggcggcaaggcggaagaagggcaaggggcgcctcggcaagaagcctaggcgctccgatgaccccgccgaccgccctcgccgccgcagcaagcccagcgacaagttcctcaagctgctccgcaagtgccaccctacgccaccctcgagcccaacgtgtcgcggcgaggcccaccacgcgtcgcacccacggcgtctagcgccccgcgcgcccgcgcccctgggacggcggcctccgagcgcgcccgccgggtgcttatgcgtcgcttgccgtactcgatcattcctgcgatggcatctcagggcgttgtattgctcgccgtggtcgtggcggtggccgtcatgtccgtgtcggtggcgtcggcgccggtggacggaggcgtgctgccagcgccggcgccggtcacgggcgcggctgcagtggggcgcggcgtcagcggcgctggccgtggcgtgctctgtcgtgctgtccatcctcgtcgcgggtgggaccatgcactaggcacgcgaggtagtaatggatggaattggttcgttgataatctccgatttggacactgctcgttttgggtcgtttccggcgatagagtagtagtactagcactctgttcatttacatttcagggcctgttcatttactccgacgacgagaagcacctctcggaggaggatgaggaggagtaggggtggaaacgagccgagccaagcccaagcgggcttggcttggctcggcttgcaatggcttgcaacaagctaggcttggcttggctcggctcggttagggaaacgagctaaaacatgagctcggctcggctcgtttcctggctcgagctggctcgcgagccttccgttgaagctatataatttgtaatcattaagaaaagcaataacaaatcatcaacatgtaaaattaaaataactttatatattaaattcatcaaattatagatgataaattacatattgacaaataataactccactagtaaataaaattgtcaatataaatacatgatggctaggctcacgagccaaatcaaacggctcgcgagccagctcgggctcggctcgtttcagaaccgagcttaaaaggaagcttgggctaggctcgtttggcattcaagccgagccgagctaagcgagctcgagccaagcccgagccgagctcacaagcccaagctttttttccacccctaaggaggaggaggagggggcctccagctccgccgacgacgaggccgccgacgccatcgtgcgtccgaaggggaagagaaaagggggagagaaaagagagagaagggagagagagggaagaggaagaagggaagaagaaatgatgacatgtgggcccacatgttagtgggtcccacaatatatatttgtgtgtgaatgacagatgggtcccatagatattttttttaattctaatgccacgtaagcgccacgtgggacgaagaccaggtcaacactgctacatcagcgccacgtcagcaaaaccgttgtccaaaaccgctgagggagtcaaattacactggtttcaatagttcggggagtcgtcctatccggttttctagttgaggggtatgaattagattcagcgtacaattaagggagtcaaagtggacgttttccctggtttggaggaaccctggtttggatcaggttgggtcaaaaagtagtcaaatgtgggcttacggcctataagaccaacccgtttgttgcaagtccggactctcctgaaagccttgaagaagcccaacctttttctttgagtggactagcccagctaaatgcacagctagtgggctgcttcagtcaagcccagtaatttgatgaattacttcaaagcgaaactgtaatactctctttcaaattactttgtctcaagtgtttgatcctcgatcatcaactcctctaaactcatatagttcaacatatatttttaaattcatcatgacaaatattttcataatatataattcactgttattaaattgcacgggtttttttaaaaaaaataataatcaaagaaaaacatgttcgacttagaaaagaaccaaataatttgaaatagataaagtagaaaagtttaataagcttacgatagtatgaagtacttttaaatacaaatctacgaccccatcgtttgtcttatattggaatcagtcgctacccaaatttaaattttaaaaattgatttctaatttatttttacagtattggtttctaaattactacttagaacatatatatatatatatatatatataaattttacttatacattattattattttgctaatatgtcatacgacgtattatccacatatgcacaaccgatgagcccgacatataccgtatttttatttaaagttaagcatttgaacgtatacatttctttaaacgtactacatgtctttcgtgtaattaaaaatgttcgcttttgctaagaaaccctgtaaaaatttggttgatactgtgcacagaggacagcagtactaaccgtatccaaagcgcaaaccgcgcagtagtaggctagtagcacatctccatagtttacccgcgcacgcaaccaacagcagccagctgcaacgtgggcccacctcgcccactccagtgctcccgcacacgcgcctcacgtgctatccctcccaaacactaccaccaaaaaaaaaaaaaaagaaaaaaaacacaccgaaaagtccacccacccgcacaccgcaccaccacgcctcccaacacgcaaacccgactcctctcgcacaggccaaaacgccaccaaaattaaagggcaaaaaaaaggaaaaaaaggaaaaggaaaaggaaacgcctcgccgggaatgggcaagcagcagccgcagccgccaccggcggcgatgtcggcgccaccgcggaagcggaagaagaaggggcggccctccctcctcgacctccagaagcggaccctccgcctcgagaagctgcaggagccgccgccgccgccaccgcccccgcagccgcggcggtccacgcggaggaaccccgccggcgtcgactccggcgacgaggggacggcacccggcggccgccgcgagaagaagctccgcctcgtcatgggcctccccgacggatcggccaaggtgggcatcgttttcgttccccttccctccccttacccgatctgagaccccccgctccgaatccgcgccaatttggccaattccgcgcggaatttggcctaattctggtgccgccaggggttcgccgtacggatctgcgcagccgcgcgccgcccgaggaattttctttgctattttgggcatgaaaaggtcgccctttatttatttatctttgtgacaaggtgcagtggtcaactcagctcagcggcgagctctcccaatcatttggcgggggataaaccaaaaaccctcgcatctcccgcatcgccttgcctgcggcgacaataattggcgcacaattctttttttttaaaatggctcagttcgaagcttttaaagtcgtgccctttttatggggggagggttttgtctgcttctcgcgccaaattttgctacatttcacggcatcgctagatctgtacttggttacaggcgctgtggtaaacgaaagccccacttttttcttgtgcttttatctcctccattattttggattcttaatctgagttttttttttctgtctgttttgattttctttttatcttttgctgttgctgccgcagggagaaaagacgaggaaagcgacggatgggagtgaaggttggtgttccttgctcagatgcatttattcttgagatttctaggaacaaaaaacacctgggcgaatgtgtatgaaagatgccatttttaattcttttagtgcctgaggcattccagttattttttctggtttaattaatgcttgtgcctctgcctctgattgttgctgtgctcgtgctcgtgggttgatttgttcactcgccagagccgtcagattccgggcccacgacacctttgccggacaaaaagttgttagtcttcgtccttgataggctgcagaagtgagttgctgtgctctctgcttgctcttcctcgggttcagttcattcacagctgcatgacctctaacctaaggtggatttcctggtttcttgcaggaaggacacatatggtgtattctctgaccctgttgaccccgaagaggtttgtgtttgaagatgataatgtttcagatattaggttttctttgttttgtttctctggagttgattgatctgtatcttaatgcgtatccatggccagctgcctgattaccatgatattatcaagcatccaatggatttttcaacaattcggaagaagctcaataaaggggcttatggcaacttggagcaatttgaggtcagtgtcagagcgtatggtgatttttgttggcctttcctgtgctgtttcgattttccttcgttaacagtcaggtgtgtggtaggcaattagagtaactcttggtctgttgcagttggatttgaatgttgggtctttaacttggttatgtcctttggctggatcagctagtttagcctcctctgctacatgtgctgcccagtgccaatgtttttattttgttcttctttcagcatccataaatatattttctttcatatccagaagttcattaatgaagttttggtatctactaccgtggtcatttaaaaaaagtctattttatactggtgcactaatgcaccgtgctttttaggagcagatattcactctctgactcttaatcaaaagagctagaaacatttaatatgaataatataatagaaaccttcgagtttgctgccaagttactttcagtgacaatattccatctgtacaagattttgcagttacacctgatctccctaggagaatattgaaaaatctcaacaatttgagggctagtacagtaaaatatagctacattttatcttgtaaaagtgcacataataagtttcttccaaagggtacctacgcagctgccaggagttactgctattgattgtattaaaggaattctaacagaaaaagtatgaacaaaattcacaaacctatcttatgcagttttcttggtttgctctatttggacatttgaccgaagaaaacctgtatatcttgaaatgggaaacaagaaggatatatttgtatctatatttggcgcttgagttatccttctttatgctgcagttcatgcagtgtcattgacttctggatgtggaatttctgtcagctaattgtggtaggctatcagaggatgtattgtctatcattcctgggtggtgcttttctcaaagatcatctttggtttctgtgttatgcttagcttgctgaatttaaattgtaccaagggaaagtcctttgccctgttaatatgcatggagggaactcttgaatactgagatatcccatgccactgtatgtttaattctactgtacttgtggtttctggctaaatcaaaggatttttgggccatttagccatgaagggtgcttggatgatatcatctaagttagttggtagtatctacaataagacgagagtttttgaatgcctttcttcttttatgaaatttgctttaatactctgtatgacactggaatttatttgtcttatgcatgtgtgtttatgtttgcagtacatattcaagtcacactcaaaagaaatcacaagtacttaatatgaaaatgctgctaagtgctaacacatcaactgttataaagtgtgttgagcctcaggttggaattatgtgttgttggaaatatgagatagacaactgtaaaatgagaatatatgaactttctttaattatgatgctaggaaggttttctgtgatatctgctgcagcttctatcaaatgaagttttacttgtctgctaccatctcctaccatttcagacatatctgatccacttatttgtaccagacatcatagatttgtattttcacagggtgttagactttcttttactttaaataacaccaacatcattcttttgattagttttatgccatgcctttctgttttaaaacattggctcagccgcacacaccacaaacaatttgattcatataccactcttgagtactgcatgtgctactgttcggtccaagttgcaggctgcactagttgtaaccgtgtacagtttacattgtgttgaacccactatttcatatctagctaaaaggctgtcacgcacataatatttttgaaaaaaatgttatgcattcctaaggctcatcctaatgtgaatacttcttttttttttttgttattttcatctttctgcaacacactattccttcagtggaccagaatgctactagtgctttcttaagctcgtatgacaggacctgaagttttaatttacaggatgatgtattcttgttaacctcaaatgcgatgtgctacaattcaccagatacaatatactatcgacaggtaaagaatcatgcttgcatgttttgtttttatgtaaccataacgtatgctgcatatgtgatatttgtgtgccatgtattataggcacgggcgatccaagagcttgccaagaaggactttgagaaccttaggcaggatagtgatgcaagtgagccagaaccagaaccggaaattaaaccagatcctgaaccaaagccacaaccacggaggggcaggcctccaaataagaacactatcaaacagaaagttgggaagccaccggtagaacgcgctactgcagacttttctggagcaacactcgctagtgttggaaataatggacatcgtacgcagccaccatttgatctgcaacggcaagtaatgaatggatcctttatcgcagatgtactgagagcttcttttgccagtcgaaataatggatacaattggtctaacgagcgcaaattggaaagaattgaagattactcaggttttatttattttcttttatcaaagttttgtgttttgtatgggtcaacactcagtgggaaattgctgaacattttgacaaacttaatgtcttctcctgaccacttgcaatgccattcgtttgttgcagggtctatcggtaaatggtcagcaaaaagtgggagaaaaccaattctgacagaagaaagtagccgaagcacttattgtcagcctcaaccttcgagttcaatatatgagctgccggtgtcgtcctcatacaacgagacaaggaagctgctagttccagttgagtgtccgaaatatgagtcctgtctataagtgcttcaccatatatgtttatataatctcaacctttttctattaatgtttgtcaacagcaagacatcatcactgacactaaaactctttttatttgtcaggttggggttcagttgcagcagtcctatccccgcagcttggcacgttttgctgcgcagctaggtcctgtcgcttgggagattgcgtccaaacgaattgaacgtgcccttcccccaggaacaaagtttggccgtgggtgggtaggagacggtgaagcaccgaacgcaactcagccaccagtgcttactacatcttcaacagccttgatacacccaagtagtacagaaacatcaagtgaacagccaactcataacggtacggccagcacaagccattcagcaggacctcagccatcttccgcaccatatgcctcttctacaatcacaactcatagggtcaattgtcagtcattaccaagccagcaacacggatcagtgccacaggtttcagcagaaagaggtgaacatggtgctgaggtgaagggcaaccataataatcttcatgaacggccagccattcagcacactgttaatggcttcagtgctgtttcaggtactaacccagactcataagtaaagttcttctgatctatgtctcctgttagttctggttctaagttggctactcctaatgccctgccaattttctcctgtttttattttccttttaaggatcaaacatattcccttctgcggcacagatggtggcgaatcggatgcagacacatacagctgattagctagctagtagagagacctgagatcaacatagtgaatttaacatttggatgcagagctccagtgaattgtccatcatgatcaccaagcaacaagggcctgctcacactaggcactagcaactcagcaccaactgtccaaaaacctcggatgatccaagttctgacaagtggcaagtcttgtgagccatgtcgatccaccacgccgtgaattggcattgcatttgcgaaaacatgttgtgtgattgattagaaacataggatagcatgcagaaaattgcagagtaatatgtagggggaggtgtattcagcagtgtgtagtaacagcggtgagttccagttggagattcaacgattctgatgtgtagaaaccacagggaaaactttctgtatagattattcatcagtgtttatgattggttgacattatctgttctccatttggtagaattagatagcatagcagatcatatataggcttgcaagatatgaaagttcatcacaaactctcatcaaatacattgagatgcagttttcttttttctttttttcatctcacactgctggctgacattgctacaaattaataactgtatcagcaattttttttttattttttttagagaagggtattttttacccggtctctatatccaaccggatatatacggccattgaaataggaaacttagccccacaaacaacccaatctgaaattcgctccatagaagatttgaactaaggaccttggggtactactcaggtcaatgtaaccactaggctacacgtcctttcgtttattgcaatagggaactgtatcagcaattgcagaaagaaacaaggcaaattcgtttattgcaagtttgctgatgatgatgcatgtacttcctccgcccgcttgagctcctgctgctcacgccagatgaggacggcggcgagcaggaggacggcggcgccggcgagccggccggggacgaaggcgtcgtatatgacgacgaggcggcggaagacgccgtacatgaggacggagacggcgacgcagcaggagacggccaacttgagcgagatgtcgtcgtcggcgtccgtggcctcgtacagctcccctcgcgcttgctgctcctccttgtccggcggcgacgtcggcttccggcgaggccactccgccgctctgtcaacgtcgtcgtcaaaatactcaacggcaaaacggacttttgtctcggattgatcctttttttctcttttgatccggactcggattgatcgttggttgcatgggaaacggactctgactcagtcggtatccatccaacacgcactgatcacgtcacgctctgtttagatcaaaggttgggtttagatccaaagtttggatccaaacttcagtcctttttcatcacatcaatatgtcatacacacataacttttcattcacatcatctccaatttcaaccaaaatctaaactttgcactgaactaaacacaaccaaaaataaaaatttggtctaaaacgtcacatcaaatgtttggacacatgcatgtaatattaaatgttgaaaaccaattgcacaatttgcatgtaattgcgagacgaatattttgagcctaattgcgccatgatttgatagtgtggtgctacagtaaacatttgctaatgacggattaattaggcttaataaatttgtctcgcagtttacaggcggaatctgtaatttattttgttattagtctacgtttaatacttcaaatatgtgtccgtagacatcaaaataattttggcgaatgaagccttagtaaatctgttaatttttgggtgaatagctagtttagtctagtcgttgctcaagttttaccgaaggctcaatttggtcctccaggtttcattttgttcacataggtccccctaggtatttgtttcacataatatgccatatggctattgctagtcaatatttatgttagaaaatatcccttttgcccttaatttgtatataactatacactagataagagaaaaccaagatgaataaacaacattgcatatgtattttccattgttacaacatgtgcacatgaaacttaagcaatggctatcgtatacacttgcaagtacataatttatttttgttttacataaattactatgcattatctataaaaaaatcattgcatgcaattttttctcatatatgtgaacgagggggtacaagtgtcatttatcaatagagttgttggttatgtttacccatgtggcttctaagtgggttcaaagataagtttgaactaaaatgaaaacttgaaggactaatatggatagattgaaatatcgatgactaaactgagcctcggatgaaacttgaaggaccactttagctattcacccttaatttttctcacaataaccacaaaactttgtcacaaaggactgttttgttttgttttgatgccaaaacttaccttatcaaatagttggactaccttgtagataccaaattagggttattggtctcgtgttagccacttcaggcaccttaaggattgacacagacatttccataattttgacaaattggtccttctcaaaagtttatttcaagaataaaccatgacaaaaacttattttaagaataaaccgcgacctcagcgccatacctgatgacgctgaggtccaacataacagcgccacctattttggcgttgagatatatgccgagttgacgtgttacaccagaccagcagaaggtcagcgccaacccctcggtacatgttaaataaataatatgccattctatcgaacaaactatggtgatttaggaggatggtaacgttgtagttggtcatgggtcaacgccaacccttctggcacatgttaaataaataaggaaaaagtacaaaaataccccctaactatcgcgtacgatcgaattactcgtgatagtttagggggtaattcgtacttttttccatatgtcattctatagtacaaactggtttgggaggatggtaacaattaatgccaagctgattttactactacgatgaaaccagatgaaaccagaacttcgatttagttgggcaagtaggtgtattaacgcatgtttgaggtcagtgccaaaatacatggtgctgttctgttagacctcagcgccatcgggtatggcgctaaggtcgcggtttatttttagaatatatttttgtcacgatttaattcttaaaataagcttttgagaatggtcaaattgtcaaaattgatggtaaagtaaaatacttcaactattttttttttctgaaaatcacaatatttgcacaaccgctgtgttctccagtgattctccatcttcttcctcatagttttctctggcccaaagtaaccgatctcccaaatacctgagctatcatgtgataagcatcagaatcttcctcctgtcatgctccccatctgtcatgctcccctaaactttgtagccctcgacgcgacctacaactttgtagttgaaaaatttttgaataaaaattgtttatggtcccaaaatattgttgcatgtttatagattttgattaattttaaaattacattttgggacaaaaaatgactaaaaataaaaaaaaatcaactacaaagttgtagatcgtgtcgagggctacaagtttgatataaagtttgtcttcattagagttcacatgaaaaagttataaattatttttaaatataaagtctttagaccgtcctatttgacctagatgatattcaaatccaagtttagggaccggggtgacacaactaaacaaattggaggacctaaacgagtgatctgtaagtttagggaccgggatgacacagtcgaacaagtttgagaacctgaacggtagattggcgagtttagagaccgggatgacacaacggtacaagtttaaggaccagtgataaactttattgtgtttctgcagttatgtatctgttttttctctctctgctgaatcttgttcctttttgctgtaagactataaaatactatgtagttttctcattttgttaatgaaatggaagaggtatatcctctctttctcaaaaataataaaaaaaaactcgtatgaactgtaccagtcaacgttacaaaattaattaaacaggaggagaaagcagaaagttctcgaggacctttcgcgcgacatccctggtcaacctggcccgcctgcgctcacacgcatcaatcacggcgagtacggaggtctccactagtatcactaggccccaagccaagagagtcagcatcaaacccttggttccgcggtagacgatggcaagcgcgaacatgaacaaggtgccgaagaggccgaacagctcgaacgggacgttctcgttggaccaccaggtgtctcccgcgacccgatgggtctcggagatagcccccgcggtcacgctcacgtcgctgtcgttcatccccgccgcctgcagcctcggcaaccactccagtggcatctttccggccgcgaacgccgcatcgatctcggcgtcgatgttgttgttgcggctgatgctcatgctgtgatggatgatggtcgtttaattcttcaattcaatttatttggttgcgaacttgcgcattgcgatgccaatttctatagctcgtgtgctttgggccggaggggtcccttttgggtgatgtatatatgcactttgatgtaagctggaaaacccagcaagacaaatttgctttctatataagcaaggtcgtttcgaccttttctctaaaatttgtagctcgtgctgccacaagccgcatccgactcggaatcgttacatctcgaattcttggtggttgccgggagatcgacgcggaaccaggaatgcgaatcaaacaggagaaagcagatagtgtcggagaacagttcgcgcgacctccctaatctccgtggctcgccggcgcttacactcatcggacacggcgactagggccattgctacgtagaacacgcccacagccaagagcgtcaccatcaagcccatggtttcccggaagacgacgacggcgaccaggcacaggaacagtacgcccatgacgccgagcgcgatgaacgccattttctgcgtcgaagaccaggtggttcgcaggatgatcaggtgggtgttggcgatggacgccgcgatcacgttcacgtcgttcccgttcagccccgacgccagcagcagccgccgccactccggcggcattgctccggccgcgaacgccgcctcgatctcgccgtcgacgacgttgctgctgctggtggtgctcatcctgccgccgccgaatcgccgatggatcaatgctccttttgtccgtacagtttccgttgcgaacttgtatgtatgcaagtgccacggcccaaatatgtaaacaaag

SEQ ID NO: 46760 - DNA, 4588 bp, Oryza sativa
cgtcggggaggtgctcgccatgcgcctcaaggtggacggctggcacgtgagcccatacacgctgacgccaccaaggaggtggagaagaaggggttcaagaaccgcaccaaggtctgggccatcctcaacgcgctgcgcgaacacggcgtcaacctccgccttgacgacgacggcgatcataggccacacgtctgatgggcgacacttcattcggtccgtcaactcgtttctttttactactatcattcctctgttgaatgttttatattgttgctgaaacttcgaaagattatagaattactgctgttgtagcacaggtatcaaatcaattgtttcttgaaatcgactgttgtagcatgggaattaaacaacggataggcttcggagacgcatgaaaacttcaattaaggttttggtgtactactggtagcaaaccacaattagactacagaaaataaagtttatttgcaatgaaaatgcattttattgactagggtagcatgactcatatggtgagtgacttagtgcttctagtttatgataggcttccagctgattcagagcactatccatcacagccttcttactaccattgatagcttcccgcgactgtttaagctcacacctgacagcacccagctctgtctccaggttctgaatcttcagcatgtccctgaccttctcgagttccctgatcttctgctcgatcaaaggcaagctctgatggtttgattgaactattggtggtactgagtcccaggacatatgatcttgtattggtagagctgatggtgtattatgtgcacccttagcattggaactgctccctagaaccattatcagtttctgcgagcaaagcagagctaccagttcagttcagaaaatcaatagtggaagcgtctaggtcaataatttagaaactgtatcaaggttctgttgatctgacagattctaacttcgtgtactgtaaccctataactttggcaagttcttctttctgcggtttgatttatgtttacatttcctgtcattcctagtgcatatcaagttacatcaactaaacagattcagtttgaaaaccaagaacatgcatgtcattctacagttatgcagtgtcagtgattagagaaaagctttacctgcttgctgttctgaacttgttgatcagggtacacaattttgacgtctttccttatcctcctcttgagccagtgacaaagcattgttggattcaccttcccggccactgccacaatccctgtatcaacatctgctactgaagtttcgactccttcagggcaacaaaaaatcagtcgaaatgtctccaaccatgatgatcgaaataactttcaaaaaaaaaaaattctgaagaacatgagccaggaaggctgtaccagtgacgcttccgatgcaacccattgccttctcgatcttcctgatgcaacccatgcagcggcactgcatgtcgatttggagcctgaattgcttcactccatcctgggaagaaccaaagctatcttgttaactctgatggaaacaacagaaaacatggtcatggctcaaagaagaacaagggaaatctgctcaccatctccatggccgagtttatccgtgaccctgtttgcactagcacagattacagtctaggtgtgtggtttaggagaaggccaaggtgagtttaagtacatttttcaagtcattaggtagttaatgagcagcatttcttggttcaccgccaattaataggatggaccaaaattctacgcaaattaacagtgcgttgaatgggaatgagaagagtcactgttacccgttcacattagtcgctgttccagtcttcgaaatatacactatattatccttttttttgtgagagaaagtatacacaaaaaataatactagtgtgtagaactactactgtactttctctgacaaaaaaataaaaaacatacctattaaattattctttttagagagtatatataggtaggagtaattctttgtgagaaaattagggtattagggcaagtgctatgatagatgtgactaccacctctaaatttatctattttattcactcatgaactaagagacaacccatacaatgtatcacctctagtacacaaataccaatatatttaatactcttacatccttcttgaaatttgtgtggaggttgcctcttaatttaggggtggctcatcatctctctcctcacttctctcctccacatcatcactcaatccaatgtggcattcttaggggcaacatatgggccattatagtacttgcccttatggtctttaggggcaaattttgatggtcaacgtatcctcagcaaccttgcggacatatttgcaaacgaaaaataatttataaataaaaattttatatatgtgttcttagcgatctaaaagcaaaggctgaaaaataaacttcgatgaaaaaaaaaccttaaaatcaactctaaatttaaagttgaaaatttaaattttaactgataagtataaacataagcgaaaagatgaggccccaagtttgtaatacaagatggcatagcgacaagcactgattctgtggttcagaatctgccaagcacaagaaatacggtttcagcgagtggcaaaaagaaatatttcccccgaaattaaagctaacatctagtagcacttgtggcccaagacccatttacatttcgcagcaaagccatcgtgtattcaattcggcccaacagaggacgtagggcctaaaatggcaatggcatccaaacgaggggaaaagaaaccgcaggccagaatgtctcgccggcggcagcagccgggctccgactccgacggcgaggacgacagcttcctctaccgctacccgctcccctccgccgccgctcccggcgcctcggggccctcctcgcacggcggcaagcccggcggcggcggcggctcgggcggcctcgcgccgtccaagtcgacggtgtacgtgtccaacctcgacttcgcgctcaccaactccgacctccacaccctcttctcccgcttcggccgcgtcgcccgcgtcaccgtcctcaaggaccgggactccccgcggagccggggcgtggcttccgtcctcttcgtccgccgcgaggacgccgccgcagccgccgcccgagatgcacggcaaggtcctcaacggccgcaccctctccgcctccatcgcggaggacaacggccgcgcagccgagttcatccgccgccgcgtctaccgcgacaagtcccgctgctacgagtgcggcgaggagggccacctctcctacgagtgccctcgcaaccagctcggcccccgcgagaggccgccgccgtctaagaaatcgcggcgcggcggcggcagcggcggtggtggaggaggcggcggaggcggtcgcggggcttcctggcagtcggatgatgaggatagcgccgcggcgttcgaggacgacaggtgggcgtcagtggtggatacgagaggggaggaggagaaggcagctgggaagggcgaggggaaggcgatgaagaaggagaagaggaaaggctacttcagcgacgagagcgatgaggatgaggactgagttttcagtgtatgattccagcgttcttgtgttatgtgagattgtagcttctgtatcctaggtttccagaaatttcttgagttaattgatgaataatttcttgcagcaaacttattgccatctgcatttccatgctcccatgcttgctaagcttattagttttgaacaatatcattgctctggttagttggcatgctgagaggaacttgctcattgaaaagaacttatgctgttcttgatataacttatgctgttcatcactgatctgctaaccgacatgcttacatagttacattgttctgtttaggatatagaaagtatagatcaactatgggttgctgatgacctgatttcttgttttcatttggtaaggaactccttttttgctgatatccttttggaaccatctgatgtgcctacccgcagcaacattttttagtcttcttatatatgtgtgccccgctaatccttttcatccttcagatcgagccctcgtattatgctagtgtacatgtgttgcaagccactgcctgacatacaaaggcatattatgtgtaatgcttggttgtcaacttgtaagttagcatagggatgcaaatcatcttgttcctaacatggattcgaatgcagcattttaactttgcttctgtttaagaaaaataaaccaaatccatatccagcaatcctgttatttcaacaatttatgttttgatatcattgtgtttgtactgttcatttgatttttctagtagaatacaggaatatggttcccttttacttatagatgcacacttaagcacttgcgtttgtacctaacagtaccatatttaagctgttgaagtccctgtcttcaaaattctaaatgagacatatataacaggggaacaaaatgtctttagagtttaaaaatctcatatgtttaagataaacaacaatggatgtggattgatccaaatatttgctgaagccaactatatctgatgcctgataaggcaattgggcagg

SEQ ID NO: 46761 - DNA, 2159 bp, Oryza sativa
gttatttttagtttgctatgtagagctccttcctttgcttataagtgattcaacgaatgcaaactgtggaagatatttaattttgccttaacaaatttatcatggtgctagtagtgccagtatcagggctctagattgtctgtgctggaacttttcatccttttatttccatcctggagatgcatttagctgtacctgaatgccaatgctaatcatcaagataataaggatatgtctgccttttccaatgacacttgaggcccatgctgctttctttctaaattttgtagtcaaatgtatgttctcaaggacaatgagttggaaccttcgttgcgttgaagggggctaggatgttcacaacatctgttctcaggtctctggccttaaatttggtgagcaaatctgttttcatgaatgacaggtactaaatgtgcttttagatatcctgcatttgaaagtcttctacattatttgccctaactgatagatactgtagacaatttctggatagtatctcattgagagaacataggtcttatctctactttggctgtttccatcagctataagaacatgaaaaccagatgattccatatatgcaactattatccctgtctacaggtctaaaaattactcctcacaaaagcacatgtttacctgtcagtgtgaacttaaatttgtcattgtcaagtactccctccgttctaaaatataaggcacaaccacccttaatccaaagaccaagaaacaattattatcacctcctaatttgaatcaccctaataaataaaatgcatgcaaccaatagaattagagatcttgagggtggaggattttaaaaaatcataatttatgtagaagaggtactagttaattgcatgcatgcatgcacgccttatattatggaacatctgaaaaaagtagttgtgccttatattatggaacggagggagtacattttagaatttagacatactaatggcatttgttacagttcagaaaatccaatcttcttaaagaacacaattttttgcgtgaataacagcaacaatctctccaaaaagaacacatcatcatgctgtacgagtgcaccatacatttttgttttccaatggacaaacaaattgaacaaaggaagcatcctatcctccaatatctataacttattaagaaccattgctgtgtcaaactgtattttcagagaagcatgccaaagaattgaagtccttgctgctttttttcggcaaaagagggggaagaagactttgctgctggtcactcagacgaggggcaagtgctgtagtatcctttgaagggactatcacaggtgatcaactgatcattgatcaatgatcagtagccagcaaggattattgcacataagcatgccaagaacgtaaatatacttggggctaacctggtttagatatatttcaccctatgatctcaatcaaattacactggcttggaaaatatcaggtccatcagtgagagtatttacaagtcaatggtttctttggtatatgctacttttcaaaactgtattcccattgtcaagtactccagtgtaatcagcagttcctaatctcagcaacagattaaagactaatccagctaacaggagacctgcatctgattgtggcacttggtaccttgcacaggctgccaaccattttttgggtttccctgggtttctgaagacatcccacaagctagtgaggctcattgtgtcttcatgagaaaccagtgtgaccaatggtgatccttgttgttggactagcagccagatgaactgaaatcttgattgtttggatatctgctagtttataaacatgaaaacactcgtgtaaatctgcatcacatgtcatcaagacccattctgaatcgtcatccaaatactttacaatcaaggaattcatgtctgctatactcagacgttttgatatctcctgcttcagttcttgaaagtcacactcaggtttcaatctgaacctcaccttttctgagccaaaagtgacctttactctcatacctacatttgcagtctgcttgggggatgatggactttgagacatgtgctgttcaccatttgccttttcagcaacatcctgtaagagatctattggtgcttcctgacctgagaaatgttcatttattga

SEQ ID NO: 46762 - DNA, 6159 bp, Oryza sativa
aaattgttgtcagatgatacagaggtgtttgtgaggtccttgtagagggtgttaagctggaaagctgtctctgctccatgaactgaatcaatgatttgctgcagtttccttagagaatggtctactttctttatcttccgtgatggccagcggtttatgccatgctgcctgcatattcttttcagggtggttgggcacactgtgagagaaaaagatgtggtgagtatatgtgcagccaattttaatacagttgctttttcctcttttttgatttttttaccactagatcaaacacatataaatcatttttactaaaaaagaatgcgggcaagccatgtagtatatgcacatgatgaacagctgtctttttttcccctggaaggaataattttgcctattatccatggaactcccaaaccaactattctgtttctagaaagcaacatggcacaccaacttagggacttgtttctggactgtagtgtgttacatatttcttgtctttatatatttttcaagtcatgtttattgcatgaagttgctgctcagctgtaagtaataattgcatgagagactgatcaattctaggctatacatatctgctcaaacagccaaaaccgtacagttgacttgctaactcattctccctatttccatgaatcagtttacagtgactaaattttaccttgtaccttcatgcaatagcacgaatcacgaaaaaatagggtgataacaatgctcacattctgactataaggtgcatgtgaaggttgaccttttttatggaagaatgttttcttattcagtagttaatgctggcgtcatggcttgggtttgttaatagtttaatggctgatggtatctacttaaatagtaaagtatacatagctgaatcttgcatttatctgataagttaatgtcactcacctccaaggctctttgctgcatccttcaggctcccagcaaagtactgccgaaggacctgcaagctcacggtcttctccgtctttgtacgccttttcactttgctaccttctttacttgtttgatcaccagcttgagatgaaccatgccctccatgtgataacattccatgtgtatgcaattcagctaaatctgatcctttctgtgaagtccctactaaggttgtccaagatgcctcctctctatcccctcttgtgttgtctccaaaggataactcctcaactttgttcttgccccgaggactaaatgagttcagctcattcatttctctcatggcctcatcctccatctccttgtcagtaacaacacgtaaagtttggcaaacacttctcatggtgcctgataatgagtccagcactgccttctgctcctcaagtacttcacagtcagttggcagaaagaactctagcacaaagtcggcaatccctgtgcgcgtgcaacgcaatcggattgccactgcaccttttaaattgaaaatcttagcatggtgagacaatgggtactccagtttagtggaggatccaatatctggtaggaagcatggctggtttgtggtgaaggctttccctgcaaccccctgcccccgtagcaggtggtgttcggagcaggcctcgtggaagctctgcatccggggttcattcacatagcatgctgcatcaatggtggaaatgcagtacttgtagttctcgtcagaatggcgactgccccgctttccttgttgagcacatgtgacccaggtctgagctaatggtagcttgtgggtgatgcaggctgctctcaggacttctagtatctctggtaaagcatctttgtaggaagcactgttaagctggttgataatcaacaagaacagccataagtcacaagaatatataagcacatttttatatcaagatctttatatcaacatttacctagattggtatttccttttctaaagaatgcaaaatttaacagtagttctccaaatcatgccaatgtcaggtgttactctatcatgtgtttacaccatatggttatggtatatataagtactactccctccttttcacaatgtaagtcattctagcatttctcacattcatattgatgttaatgaatctagacatatatatctatctagatttattaacatcaatatgtatgtggtaaatgctagaatgacttacattgtgaaacggaggaagtacattgttttgtccgaaatgaaatacatatattgccccaactcaaaactgtgatacaacattctcaaatttctgttgctgcttacctttgcgcgcggaatgcttgaaacttctgtgcttgtcaggttaactgcctgcaaagagcattagcattaagaaagtccatatgcctaaaatattcagttacttcctactgtaatcaatagtcatcatgtcttggtgaaaccatacgtgctctttcttgtgcaaccaagtttatttcttggtcagatacttacaacaagatttcttttttgaacttttcagagtaagtgatgctcatacctggagagcactgcaaatggtattgagctcggaggtgaagttgagcttctgcttggtcatgatcaactcgatgacacctaagcatgagtagttccccctctcaaacaccggcagccccatcgtcccgtggacatccaaatattgtgcatggttgatcctagggtactcatagctggtgaagtatcgaacgtctggtgaccattcaggaagcctaccgatgaacaccctccctggtagcccaggtgaggaacctgaagcaacatctgcagagaactggtactttgtcgaaacctccctgaactgtatgaggctattggacctctgatcgagagtgaatggctgcccgctcgtcgtcaacaccagctgaccatcgttgcccttgactggcacccagagctgcacaagcacatcggcgtcgctctgtgtctccctgatgtaagctagagcttggtcaaaccgttcccgaactgaggtgcttgcaccgctcggctgaatccaccatgaatttgcaggtgtggtggtggcgaccgaagcatctgtcaagcagttggagggggtagcaaagaagttgggtgagcgtgaagtgtttgctgccacttcaagccaggcgttgtcggctgagagaagctgctcaaggagatccaagtcgactgccgccgccgcgccttccgacggagtgcgtgccaaggagatgctgggctgggggtctccctcttccatgcaggtaaggtttccttcagaatctggtcacagaatttgacaccatagttactgcatcagtattaaagccaacaagatggttttgctcttggaaatgatgacaagaacttgggcaaggagcatgcaagtcgtaatacttctctcctgttcggaatcaagaagtaaagctcgctgcacatcttgggcaaggggagtacaggagactgggagtcctgggatgaattttgtgctagatttgcctgcgtttggattgcagggtgtgggtagtagggaagaacacatcattttctacagaaaggaagcaaagaaagagattgatagagtagtagctcactggtaatcgtatgcctcccttctcctcatgaaaaagtctcctttcttcttcctagctcggtgttagcctccaacaagtagtagctctagaaaaggtttagtgctccaccagaacacctcccaccattcattccaaaggcatctgatgaatcttgctgctgtaggatggaaagcaaaattgtctatgcttggcctgtccttgctttggttttgcctttgtttgtctggttttgtcgtaagaacaaagcttatggggccaccgctgcattgttcttttctttatttgttagaatctttccctctcactgagggacccagcaccacacaggaatccagccatacccacttccatttttaaagtcaacttgatggtaattatgttgcttgagacggattcctccgtatgaaatcctcccttgcaataccatgggtaattgcgaagtgggggcaaactagggagggtcgtttttgacagaattacagaactaaatcacctattgctgccactatgttatcagagtacagttttttctttatttgtttgattgtagttttacacatcacatgctgggcatgaggccacatagtagactactaaaatgcaggccacaggtctaaccacattggtgactgcataagtgcatagaggggatcaggggcggtgtactaattggagattccatcgttccagtatagctgtgtacttgtgtagagtagggccaaataaaatttgtcctctctattcattggacggaaaaccacagattccgtgacaattatctgggagttctagtatcttcccactaccttggcattgatctatttttatttataagaacaagaaaacccttgttgtacacacaaatatttggttttctctagcagcaaattgcataaaaataaatctttattgtatgaaacttgtgggcaaaagatctcttgcaatgcatttgaagttgcactgtcaagtgttgaactgtcatctcttgtgcagtatccaggctaaccattccaactttttatgtaaaagtgcttctatgctactcgtaaaaagataccaaggaagcttcattaatcagtacagtgaattatggagctgtctgtctctggcaccaactcagggtaaatcatttttagccgttgatgctatgttagcttaaacaattttctctggagatcaccgaactgcttgcttatttaaatgcacactgtgcttattcctaggattgcatctcgtaaaactgcatatgtacggcctgttacttgtctactttggattggttagtgttttaatttaatcatctttttattataagatctttactttcctctattttccagacttgtgaatattaaaaagtaggggtctgttccaaacaaagatcaattaattagttgcataatggtggttttggtggacatacatgtgatccccaataccaatttgaaaggttaattgttctagagaaactcaatgttgtctcagtttaggaaggactttaaagattgtcagaatgttaacttgttaacttactatatttataggttaagtttgcttgattccatccatgggaacgtgttcttgtcccctgttcaggaaggaaataattaatatacttatttgattcattattccgtgacatgtacaggaatcttgatgcctcttggcaatgcaacaagccaacaccatacaactgctataatttatatagcttgaaccttttttctaactttttacatatgaaatgcattacataccatttcagttattttttttctcaaaaccaattattcagaaatcaagactggagagtagcacccttatattgttttgatttaaccataattgcattaatcaagactggatagtatggtagagcactcctttacattttgtattcctaatgatctaacctgttttctagtgctcgccgtatatttgtttgatgcagcatagagggggtgtacattgcttggattaattggatgctgatgagaagacactagttggagagtgacatcaaagatatagtacaaggcaccatgaatactcatcttcgagtcaccttgacatcattcatatgaaaacaaatgctatgttcacttttcttttcctgctttccctttaatataatggttcagtcactaccctagagcccactggaaataaatatagttgctacttgtctcatatttgaccaaaagcttgggttttctttagtggcatgccaatactaccatcagctctcctccaccagctatggaggtcttcttaattcccgccaatcagataccggtttggttgttaaaattctcctgtgggtgggccccaacccaaaggcaacctaatgtttggtatccatgaggagtcaccaccaccatggatccaattggcattgggcatgttaaactaatatagggttgctgttacttagcataaaactgtgtaaaatgatttctgctctgccatctgttgcatgctcttgtatgatttgaagacagggtgtaaatcagttctgaatatttaccatttttctccaagtaattatttaataaccctgtccacactgatgaattctcacaggacatttgaataggtgggatcagttat

SEQ ID NO: 46763 - DNA, 2008 bp, Oryza sativa
tgatattttagaacaactttcatataaaaagttttcgtacaaaacacaccgtttagcagtttaaaaagcgtgtcacataaatccaaaacttcatccagtctttttagtggaaatgaacggggcacagtggtgttcttttctcctgaagatgaagattaagttttttacgcaaaacgaggtggtattaacgtgtgattgattgagttttaattattacaaacttaaaaaaatatattaatatgatattttagaggaactttcatatagaaagttttcgcacaatatgcaccgtttatcagtttgaaaaacgtgtcacaaaaatcttaatctccatccaactcttgttggagaaaataacggaccgcttgttgctgttagcatgtcaactcttggccggtcaggttacagccaatgagtgatctactaatctgacagcagcaagtagtaattagtagtaacacattttcttctggctgaatctgcgaatcagtgatgaaacatgaaacatgacactggcatacaatacgactcgtgtgcgaagaaaatatttcacatttgcacctcatcttaactagttcaagatgaaacatggcaatcattttgcacgcagaagaaatatcagcacagggggctatgaaatttgcaggttagttgaagtagatgaagtgatgaaccatccgtctatccagagcatttctttggctacggaatggaatgcacactacgcactgccgatatgctctgatacactgagagagcatcagttggcagatataaatggcttattgtcacaaaggcaacacatgctaaccatgctatagcattcaggttgtcagctgggaagatttcagaatgaacttcttcaacacctattatgccgtgacatggctgaactttcagcttctcgtcagcggggtggaaatgccagatgcctaacagaagcaggctgagttggtaatggtagagcatcagtaggtgaaagcttgttcagtacattcagaactttcatcttctgcagctctttccctgacaagaggatacaaaaataatagtcaatccaaatgatcctgcttcctaaacaaattcaggatgactgatagctgaaaaaatagcatggaaactgaagtaatacactaatactgacaaacatgttcgaagcttcaacaatcagagtgaagaataccttcttcaatcaagagcttgactgctctgttctccagctcaatggcaagcttgcttcggccaacagatgacaaagaccgaagcactgcagtttagtgaaaggaaacagcgtattagatagaaattgtggcaaattgtattgaactaagataaacataaacttactgtggatatattcttcctgtcctgattgctcgttatttctcaagaaagcctgcagcctaataaacctctctttccaatcttgattgcttgatctttgtggatcaaccggataacatgctggagcagcaccacgagatgctgtactagtagccgaaacactagaagatgccaaattagctgctatagaattctgagaaactttagtagtagacgccagattgcgaggtggactagcagccgcaacactagaagatgccacattggctgctataggatttcgaggaactggagtagtagacactagattgcgaggtggaggactagcagccgcaacactggaagatgccaaattagctgctatagaattatgaggaactggagtagtagacaccagattgcgaggtggaggactagcagccgcgacactagaagatgccaaattagctgttatagaattacgaggaactggagtggtagacaccagattgcgaggtggaggactagcagcggcaacactagaacatgccaacttagctgctatagaattctgaggaactgaagtagtagacaccacattgcgaggtggaggattagcagtcactataatacttggctgaacaaccacctttcctagagattgctttctgagaaaattttgagg

SEQ ID NO: 46764 - DNA, 13085 bp, Oryza sativa
tgtgggttgtcaccagcaggcatgatgccccgcactaagcgcctggattgaaatttccaatcatcagtgataaatttgcaaaatagtaacatgttgaatattagaaaccagccaatacattagtaacgacttgccaaatcatttgtagcattcaagttatgtaattccatatctggctttagtttcgagttataatctgatgtggtattacacaatcccaggccattgcagtatgctaacattttcctttctagaaaactcaccaaaatatagagtactacagagctaaaaataataaaacatcaacaggaagcaaatgcttgtttcatctacttgaggtaggaatttcaatctatcaaccaaataaaccttgcaagccagttaaagtgaactgatgagactacaacaacataccaagcggcgactcaagtagtaaaaaagtaacagcaaaagaaaagaattacacttgtaccaaaattgtagtgcaaagttgcatgccttccataacttatggtagacaaaaatttaaaatccataaaagcaatggccctgagcccctgacagcctgactagtcacaaccttaacactgaccagggctatcagcaatttcaacacaaggccatgaatccaacttgttatatactttcagttttcagacattatattttcattcaaaaaaatgtggttatgattcacattactgcaaaaaggtcacgaatagcataagttatcccctacaacactctgtggtcaggttaatttctgcagtagcacatacaaaactcactaacatcaaagatacatagcaaaaaggggaaaagaaaattttatcaacacctctaagagcgcataatctactccaggtgatagcattttccaaatcataattaaggaatagttgaccaagaaccacagacccactagccacacaaccgtgggggatcggattagaccattgaaatataacctagaaccctaaatcaaaggtcccgtggcataaggccagatgcagcaccccaaatccacctataaagaaaagaagaagacgaagcacatccactccctctcactcaaagatcaagaacctcaaaacactctcaccaatccatggcatttcaagaacaagaaccaggcgctaggcacattcagcaaattttccaatccacccccaaagcaactgcaagctctgagaaaagaagaagtagagatgagattcaggtggttacctcacctcctggtcgcagagagaggggaagcgagctcggagcctcggatcggaggctagggtttatcattcacgccctgagagctcgggagagctgagttgtgggcgaagctactgcctgtatactgactctcctactgagcgtgagaggagtggcttgtggctagctgggctgggcccaggtgaaggcctcgttgaattcttagcccgaatacagttttgcatcacttcactggagccttgggctggaagagctaaggtgtacggcccagatgagcgggcccatcatcaaaagtagattactggagtacttgataacacaattacacaagcagttacgtgtcatgactattgtttttctccattttgttctttccaattcaaaactcaagcaaacgccggtcaaacggggaaaacgacagtcgcacatatcagagagaatttatttcagtcaaataacaatctgcttatcctttttccaatccttccgctccaagttcccttgtgtggcttccactgcaagcctgaaacttcgggcctatttgacacagctctaactctagctccaccccttttgaagctagagctcagccaaacaatttcagctccatcaaaactgggagtggagttgggtggagctttctcacaaaatgtactggagttagttgggtggagctctctcacaaaatgtactggagttgtggagctgggtttaggcagcttcacaactccactccagactcaactcctgtagttatatttaggagttaaggctgtaccaaacaggcccttcaaacttccctcggatgaaaagagtctcaattgaaaacaaaaagaaattaaatacctaagaaactactagcactacggtgatatttttttcccccaactgaagatgaagacgaaggtaggacacgaaaaataaaacattacgcatgaataattgaattttaataattacaaacttaaaaattgagtttatctgatattttaaagcaatttctacgtagaaatttttatatgaaatgtactgattaacaggttagaataggtgcaaaaatcaagataatatatgtatctttacccgtaaagaccggagcatacctcttcagcttttcttaggtcccattcttctctcatgaatatggaagattttaccttagttttcgttagcacacctttcaaatactaaacgacgcgttttatggaaaactttctatatgaatattgctataaaatatcaggtatatctatttttcaaatttataataattaaaatttaattaattatgtgttaatagttttgcatgtctcgtatttaatcccgatctttataagattcgaacgcagccacgtcctgtagctgacaccaactcggcaacaccacatgtccacatgtcatagcagctaatgtttgaaatccgaacagtgagctccctttgtaaaaaaaaaaactcaacctattactagatctcatgttttctagtacaacatatctacatgtctagattcgttgtattataaaacatcacatctaatattaggttaagttttttttttgaagtatgcccacgaacagcagattatatgatttcctgttaaaaataaacagctcacatgactgagcaccaatacctaaaccaaagtccaatctgatcacggtcactaaattaaaatatttgttgttggtgtctcacgttttgtttttaaacgccgtgcagagtgcagacatcgacgacactgtgacacactgacacacacaaaaaacttcaagaatggatcaccggacgaagcgggtggccatcgtcggcgccggaacgagtggcgtcgcggcgtgcaagcacctcctggcgaggggcttccggccggtggtgttcgacgccggcgcgtccgtcggcggccagtggacgcgcacgctcgcgtccaccaggctccagtcgccgcacgtcgcctaccgcttctccgacttcccgtggccggactccgtcgactggtacccgcgccacgaccaggtcgtcgactacctcgccgcctacgcgcgccgcttcgccgtcgacgagcgcgtcaggttccggtccacggtcctcgccgcggagttcgtcggcgacgacgcggcggacgggtgggagcggtggaacggcaacggcgaggcgttcggcgacggctccggcgcgtggcgcctcaccgtgcaccacgacgacacggacaccacgcaggtgaggtggttcattccagattgaagaaaaacagaagctctctcccatggcgcccctgacgccccgttcgtcgtcaggtgtacgagttcgacttcctcatcctctgcatcgggaggttcagcggcgtgccgaacatcccggcgttcccgcccgccggcggccccgacgtgttccgtgggcgggtgatccattccatggagttctccgacatggacgacgcggacgccgcggcgctcgtcaagggcaagcgcgtcgtcgtcgtcggctccggaaagtccgccttcgacatcgccgccgagtgcgccgaggccaacggtacgtaccccagctgcgacattgttctctgctcgatgaactaaagctgttcatgtcggtgtcgtgtcactcatgtcaggcgtcgagcagccgtgcacgatgatttgcaggagcccacggtggctactgcacgacaccaatgtctggggcaaggtggacatcggctacatctacttcacccgcttcgccgagctgatggtccggaagcccggcgccggcgtcgcgtcgaacctcctcgccacgttcctgtcacctctggtacgtacgttcgccgccggcgacggcgccggcgagcatcccgaccacattctgagctgatggtgtctgtgcaggggtggttgatctcgaagctgacagaggcgtactacaagaaggagataccaatggaggagcacgggatgtcgccggagtacgggctgtcgaagtcgctctcgtcgtgcctgatcggcatgctgccggagaggttctacgacaaggtgaaggaaggcagcgtcgtcatcaagaggtcggcgaagtccttcaccttccgcgacgacggcctggtgctggacgacgacggcggcggcggcggcgagcgcgtcgtccaggccgacctggtgatcctcgccacggggttccgcggcgacgagaagctgaggcgcatgttcgcgtcgcgccgggtgagggacatcgtcgccggctcgccggagaccgccgcgccgctgtacagggagtgcgtgcacccgcgcgtgccgcagatggcggtgatcgggtactcggagagcgcgacgaacatccagacgtgcgagatgctgaccaagtgggtggcgcggctgctggacggcgcgttccggctgccgccggtgcggcggatggaggcgagcgtggcggagtgggggaggtacatgaggcggagcgccggcgaggagcacttccggcggtcgtgcctcggcggcgtcggcatctggtacagcgacgagctgtgccgcgacatggggtgcgacccgaggaggaagaaggggctcctcgccgagtggttccagccctacggcgccgtcgattacgccgatatccagtaactttttttttatacgttgacacgttgctacaaataatgcagtgtaaaagttgaattcagaggatctaaagttgaattctgggagaggggctaaagaaatgagtggtgggagaatttggtaggtgtagtatgtggcaatggtatgttaaatgggccaaaataagttgggccttaggctagtactagttgggtatatggttgtgggctatatgggcatcttattccgtattggagaaaagtccaatgtaactccctcaaaatataggtcggatctaattcccgcccatcatctgtaaaaccgatatatcgacacctccaacaacttaaaactgggtaatcatatgtaaaaccaatatatcgactcttccaacaactattttgaagggagggggggttcgctgacatagcacattgacttggtctaacaggttgactgaacatatggggttcacatatcagtgcctcatcttgatctttcttcccctctttttcttcactcggtatccttacttttcttagcctcgttatctacgccgagaattagtggcaagagcacgggatgggcaatagatccagggccacaacgacattagggagatggtgagtgactggtgtcgaggtagacggcgagcgcagttgccacgacattagagagacaacatcgaggagctactgacagccacactcacgattagtggtgggagcaacaagagggagagacgccaacgcagcgcagctcggagccacggccggtaaaggagtcggtgatagaggccagagggagctcaaagtgacgactgatggaggagtcggtttgtggcggtgcctaggcatatatggcctgatgttggcgtcctagagattggatccggcaccagcgtcgccggcctcactagagcccagagaggatggggcggagccgagccctaagacgggcggacagagcaggagttacgaggacgggtgttgggttcggatgcagagggaggtcgacgatggggagctgagctctagcctctaggatcagatgtggctgctcttgcggagctccctctacctccttcaatctacatggagggcgactagcagcgggtggacgaggaggaggcggaaggggacaagacaaccatccttggatttggtatggatgcaacatatgccgacggatctcaccatcgaacgcccctaatcctccagcgaccgcgctcttcttctagttcttcgaatgtctttggcatgtagggcccattgtctttttcattttatttccacactgtaataccacgtaggcgccacgtcaatataggtggacaagtcaacgtgtcatatcagcgaaaatcacactaaaatagctaagggagtcattttgcatagttttaatacttgaaagagtcaatatatttggttttgcggttgagaggtatgaattagatcttgtttatatttaagggagctaaattgaaccttttcctttcgtattgcgatttcactttctaacagtggtgagcccacgaaaattatgttggccatgcacccttgccaagctctttaaatacaatgcatatgcatacgtatcctagggtcttgtgccacaattaaggctgtgtttagttcgtaaaaagaaaatattttgatgtcacatcagatatttgaccaatgtcggaagaggttttcggacacgaatgaaaaaactaatttcataactcgcctggaaaccgcgagacaaatcttttgagcttaattaagccgtcattagcacatgtaggttactgtagcacttatggctaatcatggactaattaggctcaaaagatttgtctcgcgatttccatgcaaactgtgtaattagtttttattttttatctacatttaatgctccatgcatatgtcaaagattcaatgtgacgttttttaaaaaaaaaaatgagaactaaaccaggcccaactatagccaaacgtaatgcatgcaaagcatgttgttttatgtaaacaaaaatgattcttgattttttttcttacattttttaatatgattttcagcacattttttttattattctaagtttatgatgttatcagaataatttctatttctattttttaatttcaaactatgaattctaaaatctgttgctggttaaaattttcaaagagtgactatatgctgtctaaaacatcatataattacactggagtgcgttttttttttgttgatctattatataaaaacctgaaatagattattacggccttgcatgtgcatcttcgggtgcaatgaatgaatgttattatcattaattgtgattgtttgcatgacaatagttaaattgaaaacaaaggagatctacgtactggacattaattaaagattaacacaccatgcgactcatctcctatatttgtgctaaaagagaaaatataaattagctagtgtgactaaacacatggaaaattatctaattaatattattcaagaagacaatgaatttaagatctagaacttatacaaattaattaaaaccaagtcacccctcagcctggtcgggtgtgccacggacaaaaataaataaacccacgaatgtgcccatcgggtgttgtataccacatggagccatcctcatctacgagccaaaaattagaggggtgttttatgcaacatgcatgcacatgctatacaaatacaaacgaatttatatcgttacaatataatgttgataaatgctttgtagcttccaaatgtattcagatcactattagactcatttagtttctcttgtagaataaaactttacgttctaaaaaatatggaacttgatggtttaaacgaatcgtaaatctagtactgcttatggaaaaatacgagagtacatccccagaattccccataaaccacacaactgacaagttcttgaaataaaaacatgaggtgatgggacaaatccctaacagtcttacaaaggaagccaacacttcacacacaattaaggccctatttagattccaatttttttcttcaaactttcaacttttctatcacatcgaactttcctacacacaaaaactttcaacttttccgtcacatcgttccaatttcttcaaacttctaattttagcgtggaactaaacatagcctgagacaaatgaaacatggaataataaacttactaaagtagtattaatatagtaaagaggaaatttatagccagtgtcctagtgacaatgattgtattgtcaagtacttatgattgatttttttttaaaggaacgtggtttgaatcacatgtagtactcctagctagcaagactgttcacgtctgaaccagcaaacgggtgcaacaattttggtgcaaattgaagcttcttttgttggagcagagccatgaagtactccactccagtccagtagtccactcttgcttcggtttttggaatcttgtgaaactgtcacctggccggcgctcggcggtcaggggccggccagctgatgagaaggctgccattcttttgcagttttgctgagagaaccagcaactctcgtttcctgagagaaaaccatgaaccatcgtggtgctgtctttttttctttgaaaaaacaacaatgcttgaataaatagaatctcgtttatactacgaaaaaataatagtaatttgaagaagatccgacaattggtaagcctcctaattttgtgtaaaaagaggaaaaaaaactggctgcacatagcttttatctaactaatatggttcaaaatgaaacaaatttaagcgaaagtatgtcaatagaacagtcacccatcaacctaataaacccaccgatatttcattattcatcaatattatattgaaaatgatttcctttaacaaccaataaaaccaccaaatattttgtacttagccttctacaggttcaaaattagaagagttcattaagcaatatgtgcaggatatacaatacttgcacaccaaaagccacacacgatattaattattaaatcttttctaaggcatgtttgttcctgaatggaataaaataagaataaacatgtttttcgagctcttaaataatacaattttagcaaactttttatatatgatttcttaggagattgttttcaatcgtctttaattttataatgtttaattaatttgtttgtaccttgataattctcataaatcatttatctatttagcataaaatactatatctatatatgttcaaatatattcaatactagattcgtttggtttccctcgtaaaataaaacaatatggtttaaacggattgtaaatccactaataacatttaaacgagatggactcctaaacattactagctagagtcagtacataagaagaaaagatgaatcggtactactagtaatacgtgatgaacatcgtttctatgcatgtatgcaagatgatgttgtgagttgtgacccgagtgaagtcatgtcttcacggatgcttgcactgtgcgagaaaacaatttttttaaatgaatggcttcgacataggaaataaatacgtacgtggcacttgagatacccatttggaggaacttgcacttgtaagtacgcatttccttatgtggtgtttgaaacttatagatgaagatagagattaagtattttacataaaacaatgatatcaatgtataagtaattgagtttcagaaaaaaaaatctagtatgatcgagatatacaacacattttagtattataaatctaaacataaaataagtttttttaaatttgtagtaacatgatactacatcacatcttgtattgggtttattttttaagacaatactcgtaggattactagcatactgcgcttacactactgaaatcagtagctgccgctgaaaaaaaaaatgtgtttcagctgccacggagaaagtatctgatccgttgtacatttgccgtttgtttttttttgaaaaatctatattgtatgttttgcatgccactgctcaggatgaagatgcctttttggggtctagctactgtacgttcagcgagacttgtacatttgccttccaatttctttttcagcgagacttgtacagtatgttttgcatgtcggatggttatgtctttttttagggctagttacttcagtatcaagaactgaagaggagaaattaacgataccaaagaaagggtaaagataaagagaacagggtaaacattgttcttgttgtatatgaggctatgaggagttgaggactgttcacggctgaacgagcactatccaggcaacaaaaattggtgaaaacccagactccttttgttgcatcaggaggcaggtaggcacctgcacctctcgcgtttcggtcgtggagaagcctagcctgtccctctctgaagtctgtacccagtacccacgcgcaccgtgctaggctaggccaggcaaaagataaggctgccactctcttctggtgagacaaacccgcaacccgaaaccgctagggtctgaagtgaaacaaatggttcatctctgaaataatttgccaatgttctcctgcaatattacatgagctatagattaaatttgatatatatatacaactcttaaattttagttcaataaatacaatcatatatttgtatatcatcatttaaaagtagaattccttttgctatacaactattaggtagtgttctaaataaattattcatggatgaaaattgatggattgtctacacttgattatagaaaaagtaaacattttatgttatgaaaccaaataaatagtttagaataagtggtctaagcaatgcaatagaataaatgtttttcttaataaattcatatttgaaagcatatatttatatatagaacaaataacccacgacaatggtacgttgtcattctctagataaaatttatttcatataaagaaaatttaaaagtaaaaattggattctatagacaactcttagcttgtgtagatatcctttttttaaataatatatatcaatcaatctacaccattgtaatcttgacttgtaataatatatctattggtttaattaaattttcttcttaaattaatcactccgacaatttttaaaccttagtgaatgatgacactctttttctttcttagttctcttaatatttagtatatacaaattttaaatctaaaattgtaagcacataattatttggactgctatgcaaaataaaaaatggctgctgtttttttggcaaccactgtggcttttgggtctggagaaacctgtccctctgtaatctgtatccacgcgcatcatggctatagctactggccggctaggtaggcaggcgcgacgaaaagaaggctgctaacttttcatcagcaaggcagcaaccagcgaccagcaacgctaggctctgatgtcaaacaaacggttcatgtaataccgaccagtaatttgcaaattttcattctcaatttaacaccgacctattttcaaaatattaaatttgatatacgattattgactttcaattctttagatgcaattatatttcatgcgtaataaattttacaagtagaattagatttttactatcagttcttggttgtatttctacgtatacaattgagtttagtactatctccatcacacgtgcacgcattgaaatttttgaccaatagttagtgcaatataaattaaatttattatttagtaaaaataatatcgttagattgatatttgaatttatattatacgagaaactgaaaatcaaatattagttttgaagaacatgctaaatgtaaccgcgtcttatagagtacacctccgtcttagaaaaaaactagggatgaacatggataagtgtttgtctagattcatcctcagaagttgtttattttgggacggaaggagtatgacacaaggagtatacatagattttaaaaaatagaataagatctaatatacaaggcaaatttgctacagtacatcgaaaaaacatgtaattagctaggggacaccctaaaaaactagtaattatctgctggacacccgcgatattattttataatatccaaaggaaatagagagagaaacaatcacaaaaatacgattttgcccctacctgcgaagttcagctcgcatacatgtccgacgacaccactgtactgctgccgccgccgtcgtcggcgaggtggctctcttggggggggggagggggctctcgtcgtcgatgcagcacgagggccacaccgacaccagcgctccgccacacaccgcgcttgcaggtgagcacaacgtggaccacctcgtggttcatgtcgagcagggcgtcacggagcgcaggcggtcgtagtcggtctcgcaaagacgcgccgccgttaccgacgagacgactctctagggggttcagggggcctgcgtgcctgggcctgtggctccgcatcgttcccgcactcatcgtcgttgcagcatgagggccacgccagcgttggacatgtcatagccaccgcgccgttggagctatatgcgagccgcacatggcaagcaagggtaaattcgtactttcatagctatttatttctctatttgctctaaatataataaaataacgccgcaggtatccaacagctaattatcagttttttgcggtgttccacagcagatacacgttcttgcagtgtctagttaattacacatttttgtatgtcctttagcaaattttgccaatatacaactcttagggtgcatttgagaggagggtaaaggagaagatacacaaaatgggggtgaccgttagtgcataattaattggatgctgattatttaaaacctgaaaaaaaattaatatgacttttgtaaaattacttgcctttttttttgccaaaagtataacatttagaaatttgggaagcatgcacgtgaaaaacaagattttttttctcgatctgttgcaaaaaaacactgccttagcttatgtagatataagttatattttgaatgcaaatatagggatcaatctacaccagtgtaatctaagtatctaacccagttggaatatactccaatagtttttttttcttttcactaattagtgtggtaatgtttagaacttaaaacgcatatgctgtttatttaagatatctttacaatataatattatcatagatatatagattgatgaataaattcataaataaaatctattaaaaaaagttaaggtgtacaattatttagactaatgtgcagtgctattgaagtgattaaggaaaggaaacaaaaaaaagagaattagagagtgatagaaaa

SEQ ID NO: 46765 - DNA, 20209 bp, Oryza sativa
ccccgcctcccttcccagtatcactcctgctgcctccatacttgcggccgatcccaacaatggaggcttgtctcctgcctccaccgccctttcccccttccctccgactgccagtctacctcggtggaccatcactgaccccctgcacggcaagcgaggtgcatctgccgccgttgtggtcctcgccgagcgatcgatggagtcctcacatcgggacgccgggctctcacatcggggccgttcaggctcccgcctcctccctttcttcgtgctcggagacggcggtttctttcctccccgcgccggcgctgcccacttctatggagagcactttcccgtcacctcggccgccgtcaacaccatcctcctcgacgccaccgtcgtcccccgtgccaccaccgtcggcaaggtcgcctaccgttccagcaccagcagatgccgatgatgatgatcagggtggaggttctggccaagaagctggcggcgggaatggcgaagatgaagccggcggtggtgatgactccaatggtcatggtgatgagcaagatggtgattactccagcgatgtgcagcgacgggatgtccctcgacatgagtctgctgatggttcagagatacatgacgagcaccatgtcattattactggagaagaaccacctgtttcgcctgttccaagggaaccacctgttgcgcatgtgcgcaatcgaagaccgatttccttactctgtgccgttccgatgttttttctgtatggagcataccattttacgattgggggatcagcatttggaatagacaaacatgtcactcacgatcgtctgatggccggaggcattctcgcaggcatctggttgtttctgcttccatttctgatccttggacatgtatacttctcccaccgtatccgcgtccgtgtcttgagaaacaatgcaccatcggcaggagaagctcaagtccccgcaactgacgtacaagacgaaggctacttccctcgcaagatcaaagcttccgtttctctgatggtccttagggcatccacaatgtgcatataaagtgggtagtaaggaataaaatactactactatcaggttgtatacattgtgaaagtagtaagtaacaaatactaggtaatatgcttactacctagccataagcaataaacaaatgatttctcttattcctctctcatagctaatggttgtggggcccagcttactacccacttttgttatttcaccattgtggctacaacaacaactaatacccactgacgcagggcccacccttattctcaaagtaggtagtaaacattggtgatgcccttagtggtttaggaaagattgcttatctgacattgggcactgtttggccatgggcttggctctctcatttgattgggtttatcatagaggttatcatgctaatagttaaatggtacatgcaggatgtagtagatttttccttcttattgcctgaggtgtgagtgaacagctgggtaacattgctctgggtggtaccggtagtctggcagtagtagtaattgggacttgggaagaatagttggtttactactctgcatcggcatggtcaatcagcaaggcacttatctactagtagttctctgtgtcgaacagttttttttggccccaaccttagatatctggctgtctgttctgaaggtcgttttggtactgtaactgacttgatgctgcttggttaaggttactgagactgggaattacactccatgcaatgttctaattttgctcatttattatagctgcaatatatatatattgaactgcaaattaatgacatttgggctgttaatttgatcagttcgtttctcaagatcgttttggtaatgtgtaactgaatgctactatgctagtagtataatcttgcatgttacaggttgctgagcctggcaagtagcaattgatatattgaacaaccaaatgaccatacatgttgtaccagttgaggtgattgctatatatatgtcatgcatgcacatattggactacaaatgaccttgttgttgttgaggtgatggttatgtcgtcatgcatgcacgcctggtgacattgacatatatgtctactcgctcctttcttattacaattcgttttttattttcttttagtcaaatctttttaagtttaattaaatttgtagaaaattttaacaatatttttaatacaaaatgaacatattatcaaaatatatgaaatgttagtttgaatgtaactgatttcgtgttacatgtgttgctaatttttcatataaacttgattaaactttaaaaaaatgactaggaaaggaaatagtaattaaccaagctctctgtagcgtccgcttgtgatatacgaacttctattgttcagtgttttgtgaagggaccaaattaacgagctcgtcttcgttactactgtttcgattggggaggtcattttgctaatagcatcagtgacttgtcacacacctcacatccaaaccatcatcatcatatcgatcgaatggagtccccttctccttcggctagaactctgttgtacgtcttcctaggctccagtaggtgttcgatatatatataaccatcgtatccctgagacactgactgaatgagatttatgaatgctcaatcataattgaactattctgcaatggctcaaccataactgaacagctgatgcctttttttttctttggtaaatacattttagatgcaaaagacaatcattcacacttacatagtgtgtgcccatgctcccagaattcatgctgatttccaatataaaaaaaaagtaaataatatatctctactacctaaaaaataagagatgttttcttcgtccgtaaaaaaaatagcgaaaaaaataaaataaaaaagtccgactcctatatcttattccctcttagaaacaaaaaaaaagtctagattggtgaaaaaaattgatgtgccggattgaagatctgtcttcaaaaacggaacctacaggtcgagagcattctatttttatatgattttaattttttggtttgtacttttgcatttgagtccctatatttttatatttacatttgagtccctataatcttgcaataaggtacttgaggtcgtttttgttaaaaataataataaaagagatagaacaaagggagaaaggtgcataaaaagaaaaagaaaagccgtacaaaaaagaaaataaagaaaaaacaacaacaacaaaagtctttttcccctaagtggccaaaaaaactgtagattcgaacgagaaaaaaatctgattcatataaaaggcaaaaaaagtggtgaaataaaaacgctagatccgattccttcaaaaacggaaaaaaagtctgattcctataaaggcgaaaaaaatctaaaaaaatatctaaaaaaagttcgtccgattccctaagaaagtggcgaaacaaaatctgatttctaaccagtatatatctcttctctatctctaatccaatctaacaatttaaaaagagaaaatacacgagaaaataaaaatgggtcaaataaccgcgtgaggcaaaagtcagaaaaaagcgcaaaaaaacacgctaaaaaggttttccatcttcaataaataaaaaaacgcacgagaacaattatttccatcgttggtaaaatattttaaaaaaacatgcgaggaaaaaactgtcaaaaaaacgtgccatttctaaaaaaatggttttaaaaaaccacgcaagaaaaaaaaacaccatctattaaaaaacaaatcgttctgaaaaaattgtcaggaaaaagctaaattgatagacgcttgagtcggatagggtccatcattttttgccatctactacatggctttatttcgtcatatattctcatgtattggaaaaaaacaaaaaaaacattcgaaaaaaacaagcaaaaacaacgtgcgagaaaacatgaaaaaaaacacacgagaaaagaaaagcaaaaaagagaaaaatatggttttcttcgtcagtaaagaaaagcaaaaaaacatgctaggaaaaaatcttttaaaagaaatgcgccatttctaaaaaatggtttgagaaaagggttaattggatccataccattacaaatatggcatattagaaaaataccattacaattcacgtatttggaaccatgccactggaaattttgaaaatttgaaccatgccactcccgtcactgcttccatcctcctccctcacgtcgtcatcctcacgccggcgtcactagcagataactcacatcgagcagcagcagcagcgaaacccggcgatggtggcggagacaacagcactccggcgtgcatggggagcgggaggagcggcggcggcggcggcggcgacacggtgcacgcgggaagcaggaggagcagcagcggcggcggtattcagcggcaacggcgacacggcgcgcgcggggagcaggagcagccgccgccggcgaagacgggcgcggagggggatgcgccgcctcgtcctcgccgctcgccgacgccgccttgtccctctcgccactcgtcggcgcctcgccttctcctcgtcctctcgccgctcgccggcgtcgccatcggccactgtcgttcccgctgcaccaagccatctccggtcgagccactgcgccacaagcgttgccatcatcccagtagcaagcccaccgaaggaatcgagctgaggcgttgtcgttgaggagatcgagcctttcttcctcaagtccgaccgccggccatcttcgtcgattcttctttttccagtgagctaggctatgattcctcacacatgtagcttccctatagcatttataattcattcctcttctctccttggtagcccgaaggccggaggaacccgacgcgctgtcgtcctgtcgatttccaatgccgccggagcatttctcagttcgccgccgtagtccgctcgcctcgtcctcgccgcttgccggcactgcctcgcgttctccccgtcctccagcaccgcctcgtcctcgccgctcgccggcgccacctcgttctctcgctgttcgccggcgccggcgctagctcgccttctccccgcgcgcgcacgtgacagattgacggggagggtgacgacgtgaaagaggaggatggaagagtgacgggagtggcatggaaccaaatacgtgaattgtaatggtatttttctaatatgtcatatttgtaatggcatggatccaattaacccttgagaaaatcgcgcaaggaaaaaaactgtttataaaaaaacaagccgctcattaaaatagaaacattgtcattgacatgattatgcatgaaaaacgtatattatcattataatttctttacccattgcaacgcacgggcatttttctagtatatatatacacacatggaactatagttcttctccatgctcccaggaagtactagaatgttgatttccaaacaaacgaaagaagtgcagagaagcttgtccggttgtcccctccgggtcgactgggctgacccaagtcaaattgttggacctgacgaggcgaagacgtacaaatcgcatctgaacttctgcttgcttgcccgtgagatgaaaaatgaacgtagatgcataaatccgttagaggatccggtgttggaacgagataaatatgtatataaccatcatgatttttgcagttagaggcaccgacgaaacacacacgaccgtttcgatctgcaaacaagagcgtgcatgcatgctatgcgctcgcgctaggggattggagcagtgagcagtcagtcgtcgcacggatccaccaggcatctctattagcatctcacttttatgttaaaaacataatcacaagtttgaatacgaatatatataataatatcaaatatgtgtcataaaaatatattttttgatagagtagttgttagttcaattcttgtcctaatagaacctcatgcatgcgccttaagttttttagcgaaggattgataagtccattttatttttgggtcatgtgttttgttttttctttgataaatatagttgagcatgtttcttcttttatttgcaaataaaagatgcatttcattaagttagcatataataaatattcgtgcatggaattggtaaaagttaacaaaatttacttgaataaataaaatgtatggagtgaagaaggtatatgcgtataaaaaaattacggtggagagatcaatactcactccgtcctgcctaaactacaagggctatatatatttttggttaattagatctctaccattataaatatatacgttttgaaaaataccatcaggctattcacagtgcgttgttcggcccaagcgcccaatacaaaatatttgcctccattttggtcactcgcggagccaaatgaagcacgctgatccaaaattggacacacatacttcacctccatcgagggcgtgcgacgcagggagaaaggtggaacgctgcgttgtagaggtcgtcgcctcgtccctccgtggtttcgcgtattccccacccgtgctctcctctcatgccaataactcgtgcaagggtgacggaagggagaacgagaggagcagtggcaagaaggctgcgcagcgggagagaagaggggcctaccggcgacctaggagcaccactgtcgggatccaccgcgtcggcgccgaggcaactccaccgcggccctcactagtggcgcctcctccctatccgcgccgaccagagctcgctggctacgtctccccccccccgatccgtgcagcccggagctcttcggccacgccggtcagagctcgccgaccacgccgcctccaatccgccgccagccgaagctcgccgaccgcgttgaccggagctcgccggtcggccacgccgcccctcgaggcgagaggggagaggtggtggtggccactcgcatcagacggccgtgagtagagtggtgagtttgcactgatgtcgacggagagaggaggggaagggcgcttggtggggaaatcctgtttgggatcgatcgccgtggggatggtgagcgatcgatcccctcccccctccctccctccacccctccacctggtttccttttttggcaccgcattactttcctattttagtaaatttatacattaaagtttatacacctcaagtttacacatctaaagtttagagaccaaaagtttataagtcaaaagtttatatatccgattcaaattttaatttgaattcaaattttttttatatatagtatttctatacatctaaagtttatacacctaaagtttatagacctaaagtttatagatctaaagtttataagtcaaaagtttatatacccatttcaaatttgaatttgaattatatctgaatcaaatttgaatttgaattcaaatattttctatatatagtatttctatacatctaaagtttatacatctaaagtttatagatccaaagtttataagtcaaaagtttacatacccgattcaaatttgaatttgaattcaaatattgtctatatataatatttatgtacatctaaagtttatacacctaaagtttatagacccaaagtttataagtcaaaagtttacatacccgattcaaatttaaatttaaatttaaatttttttatatatagtatttctatacataaatttttctaacttttattttttttaaaaaaattgtgtggtgtactgtagtagaaaaagaagaagggagaagaaaggaagacggatgcaagaagaaaagcgcgtggaggcaagtgggtccttctcccgatcgctggcgacgcaagtgggtccttctcccgatcgctggccgcaatcgcgcaataggggcacccgcctggtggttggtaggtagtaggagaaaaatataaaatttatagtttcccatatagtcctcaatacgataggaaaaaaaaaagacattacttgaattaatactacaggaatataaattgccaaaatataatagaaaaattatacggccatagagagcttatatatatgatctaataggacatgatcgaatcatgcaactcaattgcggttagctcataatcgatcgatcatgatctgctgcatgcacgtacgtacgtaactagctagcacatatccatctgcggtggcaactgggacgacaccgacggatgaaccctagtgttgttgttggcggcgtttctcctgcggaaccagagacgaccataatctagaatatggcagaccccaaaaatcgagatcacgaaagccgccgcggaatacccgaacaagatggtcttgtctcgacgcactgtttccgacttggccaagaacaagaacataactccgaagcctatcacgatcgctattagcggggcggaaatcttgccgatgtacgctctctcggcatcatcagccgcatccgcatccgcatccgtcgtggtgttattccgaggcttcgacgacgacggcatcatgccatcttgttggtgatcgtcgttggtcgtcgtcgtcgtcgtcgtcgtcccattggcttcacccatcgaaaatatatatataaccccaaaatctcctctctctctctcctatagtcccaaatccagacgccaagatatatatatgatcgatgatcgatctgggaacaacgatatgctgcaattagatagctggctacctcacgatgaatctccaaagtttcagtaaatacaaataagtagagagaattgcgtaccgagacggagacggagacggagacggagatggagagatcgagcttctgttttggccgtgcgtgatcctgttatgaccctgcaaaacaatagatcaaaatcgttatcgttagttatacatcccggctgtgccatgagcccagggtactacacgcgtacgcgtgagcaaggcccaacgcaaaagcctaggaaaggcccggcccacaattacaggccgctaaccgggctcatgggatagcagcagaagtgggcctactgatcctggtgaagtggtgatgccgcaaaaaaaggccttggtgcgcttcaaaccaagcgacagctgcgagcgtgcgatgcgatactgcgatacacaggaagcgcacgagggtagtttcctgcatgccggtgggctcaacacgtacaccgacaaggcaccgagggctgatttggtttgaaaccttaccaaaaatattggtactaaattctcaaaaaaaaaacattggtactaaatttaatagagtagatttattacaagctagataaaaattggtcacaatccaaatactatttgaagctatcaaaatagtggcaatggcacaaattggtactgattcaaatatgccctgaatcctcctctgtgcagtcgtccctaacccacgtaagtcacgtgaataaactttgcacacccttattatcgtgggttaatttgattcatgccattgcaaatatgtctattcaaataaatactaatataatttatctattcttatccatgccatttaaatttttataaaattgaaactataccatcgcagttatattttcgatcttctttctttcgtcctctcattttcttaattccccatctctccgtcacggcaaggagcgtgggcatgacaggaggccggtcggcggcgccgtacaacgtggccctgcaaggtcactcagtttcttgcatggtcaggaaaatccagcgcaagcacgtgtgccctgttgccggtgccggagcaacagcacaccaagaagcggtggaccttgccgtgctcctccatggtcgacatgtttttgcatatatggtgcgtgcgatgcagatggcggtgagcgcggcgttgaacattctttttttagacaaaaggtccttagggacctagctttttactgaaagccaaagtggtagcgctgaggaaaccagcttacaatgtagtacaagttcagatggccacaccccggcctgggaaggaggatagcacaacttaaaagggaaatcaacagaaaaactaattcagcctactccagttcttctcggtttcatattagaggtcagctccttcatcttttcagcaaattgttccagtttcccttcttcctcagcacgacagagtttcctccactgcaacaacaaagaaataatttgaaacggcaaagttagtggtgagtaaagtagagtttttctgaaaaccatgttgtttcttgtcagccacaaacaccagcaaatggcagctagcaacataatatgtaatctatcattaataaatgcagagctatggttgcataagagaaaaaactcatcaagatttttaggagggtaaggctagttcagaacatctctacaccaacatcacacaaagcgagccatagggcatacaaaaaggatgtgattagtagactcaaaatctccacacaggctacaattaacatctcccctccccatcctttcttttgcaattgttcagcatattgaatacgatctctatgagccagccataagaaatgtttgattttcattggacatggcgctttccaaattttctccatctccttatcaacaatccctctgaaacacatagctctatacatagatttcgtagtaaaactcttgtttgaattgagacccccaacagagcagatcttgcctatcttccaacttagtatttaaaataacagttttcaactcattccactcctctacttcatctggaccaaaagatcttctaaaggataagcagttatatccttcctttaacaccactctaaccagaatgtcttgttagttactgatctcaaagatcctataaaatctcactgtcagaggacatgacccaacccaaaaatcatgccagaaagaaatatggtcacctctacctaacttccactcagcccccaacatgaaccattttctggaattgagaacccccttccaaaattgagagcaatcccctagagtaacttgaaacaccccactattctgtaaatacttcctcctcagcaactctatacatgggctatggtcctcagattccagtttcatgatccatttagcaattaaggcagcattcatcttcctagtttcagtgaatcctagcccaccaaaatccttaggaaaagctatgtcatcccacttcaccatatggtatttccctcttttttttatttccagcccagtaatacctccctctaatagagtcaaacctcttatgtataccttccggtaattggtagaagcccattgcataggagaggatggatgataagcaagcattaatttggacagctctaccagcatgtgaaagtgtatttgtttcctaagttcccaatctcttttccaatttctgtcccaaaaaatcaaaatcatggttaagaattttttctgggctaattggaaggcccaggtatttcatgggaaaagcacctacagggcagttcaacatctgagcaactctatctgtttcctctttttccaaccccacagtgaacacctcgcttttatggtaattgattttcataccagccgtatcctcaaaacagtataggataaatttagttgctaggatttgattttcatcaaaaggaataaacaccacagtatcatcagcatattgtaggtgagtgatacccccaggaaaaatttcagggactaaaccagtcaaaacaccattacctttagctttgtcaagcataactgccagagcatcactaaccatattaaacagcaatggagagaggggatccccctgtctcacacccctatacgttctaaaaaaattacttctctccccatttatgttgacacacactttacccccagtgacacaagcttccacccatttcagccatctatctgggaaacccttcctctccatgacttcaaagaggaaattccaggacactctatcatacgctttctcaaaatctagtttccaaatgatccctttatccctcctaagttttaactcatgtagcacctcatgaacaatcacacatccttccaaaataaaccttcctggaatgaaagctgtctgtgcgggtgagatcacggagttggccacctctgtgaatctattggtaactactttactaatgaatttaaatttgtcattcagcacgcatataggtctgaagtgtctaatgtcagaagggtcacttttcttgggaatcaaagatatcacaccaaagttcaatctctttagatcaagttccccattgtagaggaggatgagcatctcaaataagttcgcggcgttgaacattgtcgggcactcaggctggcgttgcagatccagcgatctaccgtctacaccttcgtcgccaactccgtcgatggcacgagcaggggcgtggtgttcgggtggctcatgggggcgggcaagttcggcgccgtgggtcgcacttctcttggccttctcatggcgcccacctcgttcttgggaattcctggctggcgcctcgccttcctcttgctcattgctgctggtgccgtggtcggcgtgtccatccactcgttcgcccactgggagagaggcgaaggccatgctgcgtgtcccgtcgttccaggattggcaccaaacttggtgagtttgttccttactttgagcacttcaatctggtcagtttggatggagattggttgagtagagcaccggatttgagtggtggtttgtcagctcgagttactgaaattacatattgtgcagcagttagtaaagtgtcagtttgagggggcaaacagtgttcgattgggctgtttttgggacaacttggaagggactcatagaccatcatctcagccaagttctatatattacattttgatacaaatatgatcatacttaaaaaaataactttaaaaataagtcagaacgtcttatgttatactttttccgtcccattttaagtataattgtaggtttttgtgtccaatgtttgactgtccatcttatttaaaaattataaaaaaactaaaaataagtcacggataaagtactatttatgttttatcatttaataacaaaagaaatactaatcataaaaatatttcaagtaagatggatggtcaaatgttgaatatggaaacccgtaactgcacttaaaatgagatatatggagtatactatttcattgaaacaaagaaaaaactcttggtcatatcaaattagtagagtttgaaccatcaaaacaagtgcttcgatcatcgaatttgttactcaattattggttagctgagttagctttgatgatctactgcaagctagcacagatccatctgcgggggcagctggggtggctcatggagtacagatccagcgttgtcgatactgtgaaagtacatgggaccgtcaagaagatagcaacccatcgcggtagcagcgcacacgaagcagaacactgccatcccggaaaacactatcttatctagtattctcgtgtgtcttattaccaaaagcacggaaacaactcccacgcacaacatagccactgttccgatgacgagccccttgcgcactgtcatcatctgctcctgcaccttctcctccttggtcttgagacgctttggcgatgacataagattttgttgatcagccatggctgcgaagatgatgttgctcgtcgtcgtagtcgttgtccctgccttctccaatatccgatcaagttatcccaatcaacatgctactagtactacctccgttccatattacttgtctttttgagtttttgtttatcaatgtttgatcattcatcttattcaaaaaattttaaaattattatttattttgtttgtcatttgctttattatcaaaagtactttacatatgacttatcttttttttctatttgcactaattttttaaataaagcgaatggtcaaacgttacaaataaaaagtcaaaaacgtcatctattatgatacggagggagtagtatttaagcaggcttctccgattcctacttctcctcaaactgggcatcctggccagatgcgacacggacacggatcggatcgctgccgtgccgccgatgttttcaccgggcaaaccaacgaaacaacgagtagtacagtactagtattgaattctccgtactctctgctctcgaattaactgtggtttgatgtcacatgaacttaggcccgcatcactgcagcggtgtagccactactaaatgctgataaattcagccaaaaaccccaagcagatcgacagtgtaccgtctcattacacttgtaagctttagctccggggcgatcgatctcgaatggagaagatcaagaagagggtggccatcgtcggcgccggcgtgagcggcctcgccgcgtgcaagcacgcgctggagcgcggcttccggcccgtcgtcttcgaggccgacggggccggcgccgtcggcggcgtgtgggcgcgcaccatcgcctccacgcggctccagacgccgcgcccctacttcgagtactccgacttcccgtggccgccgggcgtcaccgacctgtacccggaccacgaccaggtgacggcctacctgcgctcgtacgcggagcgcttcggcgtgctggagtgcgtccgcttcggctgccgcgtcgccggcatggagtacgccgccgccggcggggaggaggaggtcatggcctgggagcactgggccggcaatggcgaggcgttcggcaccggccgcggcgagtggcggctcactgtgcagagcggccacaacattgaggcaagcacaaataactactcctactcggtttcatattatgtactcaagtcactttatttttttagtcaatttttaaaatttgactaaatctatagaaaaatttagtaacatctaaaataccaaattagtttcattaaatatactttaatgatatatgtttgttttgtgttaacagtttactatatttttcaataaattttatcaaacttaaataagtttgaccaagaaaaaaaatcaaaatgacctactctctcgggttgataatacttatcgttttgaacaatggcacggtctctaaaaaaacaactttgactattattttttattataatatgtataaaagtgtaacaaatatagtactttttaagactaatttatatatgtagtcactatatttgaaagacaaatattttaaaaatgatttataattaaatattctaaagtttgacctcatcattgtctaaaacgacaagtattatcagccggagggagtataatataaaattgaagggagtagctgcaagtgattaatatatttttagtatgaaacatcgtgttaataatagtgccggttaatgttgcattaatccatccataataagctaaagattatcattgtgcttcagctgcacgtcgcggatttcgtggtgctgtgcatcggacggttcagcggcttccccaacatgccgagatttccaccggacaaagggccagaggcgttcgccggcacggcgatccactccatggactactccaacatgggcgccgcgaaggcggctcagctcgtcaagggcaagcgcgtcgccgtcgtcggctaccagaaatccgccgtcgacatcgccgccgagtgcgcagacgccaatggtgctaagctctcgatcgacgatccatcaagctagccggccagctttcgcaatttctgcttccatgatcgagagcgaaaatgaccttgtgttttacgcgtgtgtttgtatatgcaggggcgtcgcatccgtgcacgatagtgctacgcacgaagcgatggatcgtgccggacttgtacgcttggggcgtcccggttccggtgttctacatcaaccgtttgtcccagatcttgcttcacaagcctggggatggcttgatccttagctttctagccatcctcttatcaccactggtatttacttcctccatttcatcttgtaatttctttttcatgctatgtcaatataaaacttcgtaatgtccagtgcagatcgttttaataaaaatattataagacattttgacttttctttcctaacgcaatttattttaagtttgaccaagtttataaaacaaaattgcaaaaaatatataacaccaaattagtttcaattttgtgttgaaaatgctacggttttgttacagtttttttatataaatttgaacttttaaaaaattgattttagagaaaagtcaaaatgtccgtgtaatatgaaatggagggagtaatgattaagcataccatggcacacattaatccttttgttctactgctagttatatcatgctgtcagattaggacatctctcgtcatatttgtttttttgttgtgtcctgttattcagagatggctcttcgccaagtttgttgagagctactacaaatgggctctgcccatggagaagcacggcatggtgccggacgaggatttcatggaggccatgtgctcatgctctgtgatgaagctaccggacaagttctacgacaaggtggaggaaggaagcatcgttctgaagaaatcgaagagattcagcttctgcaaggaaggcctggtcgtggaaggcgactcgtcttcagagaccataaagagcgacgtggtgatcttcgctacagggttcaatggcgaccagaagatcagggagatgttcaaatcgccattgttcagagaaatcgtggccggcccaccttccagcatagttccacacttcaggtctataaatctttcattacattcttcttctgaatgcatacgcaggtctataaatatgtcattacattcttcttctgaatgcatatatatgcaatgtgattatggtaactgatgatttgtggttgtgttttgtcaggcaatgcatccatcctaggatcccacagctggcgatcatcggctacgctgaaagctggtcgaacctctgcgtgtccgagctactgtccaagtggctggcacatttcctccatggaagcttcagattgccaagcgtaaaggagatggaggaggacatagatgaatgggacaagtacatgaaacggtattcccccggccgtttccgtcgatcttgcattgggccggtgagcgtgctgtgcagtgatcggctgtgccaagacatgggggttcaacgacggaggaagaagtggttgctggcagattggttggtaccctacggaccagccgattacgctgatatcaacttgaacagctgaaatggtgatggaatctgaatcttgagggcaccggtaatctttcttaaaaaaaaaaatcttatcttgagggtagtttgccagtgactccatttttatatttaggggtgcaaaatgaatgcaagtttttacatttattaggattcaggaccaaaataagattacgagaagcagcgggtgagaagttagcttgtgagaatcccagcttctaacttctagttcattttctggattctacaactatagtttctcagaagttgtgtgaaaaatattggcttgttggggagcttaaaattgtgatagacagctagctggtagtcagcttttgagaatctaggttttccagtttctggctttcagttcattttttggattctacaatcacaacttgtcagaatttggaccaaaagctgaactgtttggaaagtttatgacagctgaaaattctaggagaagctgcaattgctagaagctcccccagacatactctaagaataattcatttgatctgtgcagatgccacagccagccgccgcatgcaccctcccctctcgcgccgccgctcgccggccgtcgaggtagtgctggtacacgtacgagagaaacccccacacggccatgagcatggctaccaccttggtgcccgtcatcttgtccccgaacagcgccaccgccagcaccggcaccatcggcagcgccagggtgcccgtcacgttcgcgaacagcgacgacaccctcgcgatcagcctcacggcgcccagcgtcgccgcctgccaccccacggcgacccccaccacggtcgccgcgtacgccgccttcccgcccttgaacgccgccatctcgccgccgatcgtcctccactcccccgacgcgaacagcgccgtcgccgacaccgtcgcggccaccgcgttcgtggagatctgcatcttgagcacccaccgcggcgtcgctgctccgatcaccttgtcgaaggtggcctcgaacagggacaggatgagcgcgtagacggcggacgcggacagggtgaggacgacgccggcggcgtgcttgccacgctgaacggcgtcgccgccggcgccgccgccgacggaggaggaggggtcgtcgacgccgagcagcgcggcggagaaggtgagcacgacgacggagttgacgacgagcggcgtgaaccgctgcgcgttgatgaggcgcgacgtgaccgcgttgaacgccagctgcgtcgcggcgaggagcgagaacgtggacaccggcaggtacagcatggcgtacgagtacatgaggttgtcgcagccgacgacgagcccgagggccacgcagatggcgaccatcttggatgccgccggcgccggccgaggctccccgacggcggcggcccgcggcgtgaggaggaaggggatgaccagcagcggcgctccggcggactgcgcgagcgtgaccatccataggctgttgccgccggagttgtagtagaggcgggtgaggagaggcgccattgcctccccgacgagcagcatcagcatgtccaccatcactggcacccaccgacatcgtcgaacgcctcttctcctcgcgatcggcggcccaagcgcagcttgccccttgcagatttcgccatggcaggattcctcctgtccgggagtatcttggcagaaagaaagttacagtaatttagcgtacgtggtgtaagtgtgatcgaaccagtgaagtttaattattgtctgagcctgttcttaacgcagacaaattaaaggatgtacgcagtgagacatgcgtacgtacgcactgcgcagctaaggttgccgtgaactgctactactagtgtactacccgttgctttaatttgacaatcaaattgaagagaaccaatcgtgtggctagaatttgcagggcattcatactactgtttttgtaagaggttacatttccattgaagctaaaacgcatttagtctttcgtttagcataattaaacaaaaatctcaacaatggaactattggaaaaaatcattaaaatgtgtaattccaatagtacttttttttaaaaaaaaataacatgcttaccgttgatctatcaaatattacgaggttcgagtctgaaagtgcagaaatgaatcatgacagcatgtactagtttgctactctcccgtctcaatataagtctaactactacgaatatagatagctcttatatcgggacggagagagtacttactaaggtatataagaggacccacgcataagttgaagtagtacaacctgaaccaatcaggaagggttcgattctgaaggagtaccttttatcattagctgaatttcttgatcgtgtgccatagatcagatcactgactgaaactcaaaagtacctggatgatactattccggctcaacaatccctaactacttagctagctaactgtgttttagcactacttgctaatgagcaattcactctaatacgatcctagctcattagcatcttatatatatgtaccgatctgatacaacattatgaggtactatatatagtcccatatatggtgattcctttttttgcgctcctatagtttccaattaatttatacgtcatgtacagtaccctgaacccaacactgcacacaaatggttaacaatcatggactaacgtgttcttcaaagatatgcccaacgttttcagtcaaatctaccatagatctcttgatgtatactactgcgtacatcgttcgatcgcatctatgttattggacttttgacggacagcccctgatttcaattaatttgtggatggctaggattgcattaagatccatgcatgaacaataaccttattttcttctacgtgcatcttgagaaatgtccaggggtcttctgattagcttcataaggtggtgggctagccggtctgagttcgaagtctcactcattctatttatatttgatattaggtcattacctaatgttcacgttctttttcttcgcacgccttctctttgtgaccttggccctatttggatcctccggtctattaaatagtccttcggaatcttgctattaaatagccctactgataaaacccattccataacccctgggctatttgcgagacgaatctaac

SEQ ID NO: 46766 - DNA, 11385 bp, Oryza sativa
  unsure (1)..(11385): unsure at all n locations
tttgcgagacgaatctaacgaggtatattaatccataatttgctacaatgatgctacaataatcatccgctaatcatggattaatatacctcgttagattcgtctcgcaaaatagactagaagttatggaatgggttttgtcaataatctatgtttaatactcttaaatagtaagattccgaagggttatttaataccctggggatccaaacaagacgcttgtttggtagagcgagcgagcttgctccccacctctcctccgatcctcaagccaagcgtagacgctggcccactgccagcctccatccatacggttccgtcgacgctccagggaaagccccctctccccgacctaaactggttgggggtgttgatgcctcgctagagctgccatgactcgttgaagctaaaggaggttggcacggattaatagtccaaattttgatagaaatgctcatatttttttgtggaatgaaggatagcaattccgctaatttatgcttcatgtgcagaacccaacacatagggttaacaatcatggatcaacatttttcttgaaagctatggccaaagttgaaagttctcagtcaaatctaccatacattgctcgatcgcatccatgtatggagaagctgactttagaatttagataccccaaactgctctgtacagttgacttcaaggcatccccgacgactccgaaatcagatatcgtgaaggtaagaaagtacattgcatcgaccatggtatgatctctctatacgtagaggcgacttcgatgaccggaagagctagctcgaaatgatggatctgtctgtagattgaaatacagttgacttgcaaagggtcatacagttgacttggtgattgcctgattggtgtgccacagtgccagttgaccatgacgtatgattgatgaggaggccggaggcatggagccatgcttgcagattgagaattttttttatttataattttttttattaaaagttttacaaaaataatttttcattttgaaaattgacggaaggagtcgcctaccgccttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggcatggaattttgcaggcggcccccttgccgccctgggggagggcgatttttgcctctccccctataaagcccagtccctcctctgtgaaatttcattatattcactaaaaatccaaaaaaaacaaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacatcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagaggaaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgctcataaggatgagatgaaggaggcggtgaagcattgggcagtttccttgcagagagagtttagggtggtcaagtcaacaaattatgtgtatgaagtgaggtgcatgaaggaaaattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcacacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggtgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaagcgcacactcaggagcagccagaggtcacacctgtacaggcaggacgggttggccgtgtcgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacagtaacaatccaaatatgccctaaaaaataataaaattgtattttaccagtcttggagattttaatcttgtatagttttcaatataaaaagatttgataactattgatatttatacaaaaatatagagcacagtacaaaatcgcccttgcggagggcggcaagggggccgcctgcaaaattccatgcccccctcgccgcccatttgcaggcggccccccgcacagtacaaaatcgccctcgcggagggcggcaagggggccgcctgcaaatttcgttgacggccgtcgcccgagagcgaacggtcgtctgccacgtcattttcgccgccctctgggagggcgatttttaaaaatcgccttcccagaggccggtaggcgactacttccgtcaattttcaaaatggaaaattatttttgtaaaacttttaataaaaaaaattaaaaataaaaaaaattctgcagattgacctatcctgggcttggatcatatgcgtgctgggcgggggaaggcggcgaattgagagtggagagggaacaggcctagtcaaggtttctcttattattgggcctccactaattataacggccttcgttagtgggccttccgctagaattggctaatttgggcaccatattgggcctgattttggtaaacatttcttctcgctttagaccacaaactttgatagggaccaaatgcggctttaccacctccatcatcggccggaagacgttcgctgacgtcgttgccaagcatgttggatcgattcgaggccttgttggccaatccagaatctagcccattgggatgccctcttgatatatgcgtataaattcagattttatcccattgagatgccatgatatttgctcaactttgaaagagacctcacctcacctcacctcattaagcactcaaaacacatccatcatccatttataaaattaccactcccaacctcccactgaacacaaacacacaaaaagaaaaactcacagcggaaaaaaagggacaaactaccagaggctgacagggctagaaccagcaaacagtgaagacgccaagcaagcaagtggtggtggtttggcccccatccaatccccggaaaagatccaccaactccaaaaaaatctaatttaacttatccaaagaatcaatcaatcagcaacattctataacatctacccccatcttcttccttcctcccaagaacctggacgcagagcaagaaaatggacaggaagagggttggcatcatcggcgccggtgtgagcggcctagcagcatgcaagcactcactggacaaaggattcaacccaatcgtgttcgaagcagacgacaccatcggtggcgtctgggcacacaccttggagtcaacaaggctccaggcaccaaccacggcattcaggttctcagacctggcatggccagcaactgtgacagagaagtacccaagccataggaaggtcatggagtacctgaggtcatatgccagcgagtttgatctcctcaagtgcatcaggttcaatagccaggtgcttggagttgaataccttggtgcaaccgagggagagataatgcagtgggagcactggtctggcaatggtgaggcatttggtgctcagaaagatggggtgtggcgcctcaccgtgaaggacttgaaaattggtaacattgaggtatgtgcattcaccttgcatatttatcaaattcacactggtgcataggaatggagtaacatgtgagaaaagacattatctagcaatgaaaatagaacagcatcctcaccctgaacaagaataatatgaagtcagcaaatctgcttgaaccaacaatataatgtatttcaccttttgtgtgaagaaaattgtatgccatactgcaactttgtatgttgatctcctgttgtcacaggtttttctagtggattttctaatcgtgtgcattggaaggcacagcggaagcccaaatatcccagaatttccggcaaacagtggcctagagttgttcaaggggaaaatcttgcactcaatagattactcttacatggataatgcagctgaatttgtcaaagggaagaaggtgactataataggctctggaaaatctgcatttgacatcgctgcagaggtcgccaaggtgaatggtgcgtcaaacagaatcagctcctcactaactggcaataatcagtctaaagaacatatggctaacacttctgttcaaaatgtaggtgaaacccagccatgtaccatgatatatagaacaaggcactggttggtacacaaatctagtatttgcggagttgacctcagttacttctatcttaaccgtatttcacagctactagttcataaacccggtgaaggatttctatattatgttttagccactgcgctctctcccttggtacattagcacttcaatttaattggagtttagaaaccagttcaactttcattcagactaataagcttgagaacccacaaaactgaaaatatttctttccatctgctttttcagagatgggcaatctcaaaagtaattgaaacttacttcaagcaaagcattcctttacaaaagcatgggatggttcctgactacagcttctcctttgccatgtcgtcttgcttgattgcaatgctaccagaggggttttatgataaggttgatgaaggcagcattattctcaagaaatccaagaggttcagcttctttaatgatggaatcatcctggaagatggaaatgaacacataaagagtgacattgtaattctagcaacaggatttaggggagatcagaaacttagagacatcttcacagcaaactggtgcaaagagaaagtggcagggtcatcagctactgcggtccctctatacaggtagaagttcaacatttctttggttagtgtgcatactttgagaacaatacagtgaatagacaggaacaagggataacattatgtccgcaaaattagtgcactgctattatgcatgaaaatgtccatcagctgttgaagctattaaccaatttttacgctccagagcagctaataggtatcattacgaaattccaatggttttgataacaataagccagtagttagcataatttgggatgatgagaatttaataaacttgatacatcatgtttaagttttaatgtttactagttaaagcctgtacgttcatttcccatttaccaaaatatttgaaacttgcagagaatgcatccatcctcggattcctcagttagcaattgttggatactctgagagccttaccaacatatatgcctcagaaaggatggccaattgggttacgcatttcctgggtggtcgcttcaaattaccaagcataagatgtatggaagagagtgtagcagagtgggctaaatataaggatctttacaacggaaagtactttcgcaggtcctgtataagcaccgttaacatttggtttaacgatatcttatgccaagacattggatgcaaccctaaaaggaagaaaggagtactggctgaatggttccagccatatgggcctgctgattatgcgagtctttactgacgactaccctacaagtatattcataggaaaagaacacaagtactgcctccaggatcctactgattgattagaaaggttttatatctttcaagtttgttgttatcataacaatataaaatagaatctaccatgttctttacacacttctactttcagagagagagagagagagagagagagagttagttctcaatttatgtgaatttatgcttgtacttcagttaatatcatgtaaatctacctaaagtccaaaacatttgcaaaagtcaacacaatgctaagaacaaaatatattgaactagtctgttgagtataatgcacctttgatcacttccattctctatcttcctatttatcccctgcagcccaacatcaacatgtacttgagtgtaatctgcatataacaatgtattagcaaaaatactaccagctatgtgcataccctaaagatgcaatcatcactatattttctaccaaaagataacaactagatgccaaaccaatgtggtaatgttacagccaaagaaccttattcagattaaagggttgtctttgtctcctaaaattaaaactaattagtaatctctttgtaaatgtacttctgtcatggtgcactagaaaatatgctaagcgtaatccatgataggttggaaaaggatatcttttttttaattagatgtaccttctttgttttactagtgagaaagatatatcttattgtttaacaacagatgatatcactgtatatgtcaggtatgggaagatggcactagcatgagactcaatttagacttaaattgagccatatgtagattggttcaaaacttcaaattaacagcatctcacgtctagttcaattcttggtatagaagtagcggtaatgattagttacttattattaaacgaatcaataaaacatcacaaccaagaatacattttcactaacttgtatgttggctctttctggtgcaaaaaccaccaaggacctgctctcgaacccaatctgtaaagtagataggtaaatgtcacaacatgatcaaacagcctggttatgatcagcaggagccaaagtttgcaccacaacaatgaaaggtttgcatccattaaatgcttgcaagcatatgaacgattctgaagacaatcaacatatgcaaacaatatatttacaaaccagcacagtaattctgtatttgaaatgactgaaatagagctcaacaaaacctatatgcaaatgttgtaacagctgcattttcaggggaagttaaactctgctatttactccatccattatagtacagaaaagataacaatacatatcaaagataacctcaaattgtctcctacagttcagcaaatcacgagaggaagtcagaaagaaaaacttgcctcaaaaatcctgcagtcatgcgcaaacccatgaaaagagccagcccagcccaaaccccagggaggccaaaaactttgggagcatatagcaaaaataaagaagatattgccccaacagtaatctgtagacaaaagacagtaattaatcacagcagaaaggaaaggacacagtggcaaactaaatagttgcagctaatgcaagatcaaaatattacagatttattatgtaagtgtatataccattgaagaagcagaatatgagaagtctgagacaccgaagtgaagtccatcgaagataaaagctagggcattaattggttggctggcactaacaaacttcaaaaacaaaaacagaacgggtaaagatgacgttgacagtgctgaagatcttattgtagtatgacaaaaaaaaggggcacataccagaacaccactcccaacaatttgtagaaccataggatctttggagaacagttctgcaattctaccaaaagaggcaaacagaagaagggctaaagctgcaccaacaagcagtcctatctggaaaatagagttcagttgtaagttgcttcgatacatgctcaatgaataatatccaacaatagaagataacacctgcgtaatttaataaaggttgttatttattaccttcaagacatagtatgtgacctccttgaccttttcatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagct

SEQ ID NO: 46767 - DNA, 3526 bp, Oryza sativa
  unsure (1)..(3526): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgacgttcaagacgcgcacatgcgagcgcttggtgtcgtggaagggccccgacgacccgtcgccggggagcttctcgttcggcggcgacccggacacgttcctgcaggtgttcatctggaacgggacgcgcccggtttcgagggacgggccatggacgggctacatggtgtcgagccagtatcaggcgaactccagcgacatcttctacttctccatcgtcaacaacgaggaaaagagatacataacgttcagcgtctccgagggctcgccgtacaccaggtatgtgattacctacgccggcaagtaccagttccagcgctggaacatcagctcgtcggcgtgggatgtcgcggagtggcctagatgggactgcaactattacaactactgcggcccgaacggctactgcgacaacacagcgagggcgcctgctgtcccgacgtgcaagtgcctcttcggcttcgagccagcgaacgcggcggagtggaacagcggccggttttcgcagggttgccggcgaaaggaggcggtgcagtgcggcgaccgtttcttggccgtgccggggatgatttcgccggacaagttcgtgctcttcccgaacaggacgctcgacgcgtgcgccgccgagtgcagcagcaactgctcctgcgtggcgtacgcctacgccaacctgagtagcagcatatctaagggcgacaagacgaggtgcttggtgtggtcaggggagctgattgacgcggagatggtaggcgaaaggcttggcagcgacacgatctacctcaggctcgccggtcttgacgcgggtaagcaccaatttaaattgagcaattttactgttcgtaaggaggtatttaaatttgataccttatgctacctaactactatgaggtaccaaatttttcactaaatttttgatacctgatggtatctcctcaaagactataaaattactcatttaaatttgtttatctttctactatgcatgattgttgtttttcttggagaagtacggattacaatttgaggtattttactgtttgaggtttatacttttagtccttgagttgagaaagtactaccagatacagcgaggtgctaatgaaatataactgtccatctatcaagtaggatcggtctaaatagtacgttgttccttgcctttcgttttgttcatgcaaagcggcgatccatgaaatttttgtacctggaaaaaaatcttggtacatgttggggggatggattctaatagctcgagtggacgtccacccatttattgcatgtcaactaaatggctatgaaaaatgttcaaaaaaatcggcaagataaatcaatatgtaatatatcactccacaaacatacaagttaaaattcaacttctataagttgtaacaaaaataacaaatttaactgtaaatatacatatagtaattttttgagttttgttggacatcggcatcggcgtcagcgtcagtgagaacatggcgctgataacataatatagcatcaccgtctactgccaatggccgctgcatgtagtaccaatatatgctatgtgcaccgcttgggtatattgacaagattagattgtgcctttgccagaggttgacgagattatagtaggaaaatttgctaacaccgagattcgccacccatttcaaagtgcaacgagtttcagttctataaatccaagggtacaaaatccacatataccaaataaaacatccaaaatttcagttcaatagaaatcgaggaggcctgtgagctaaaattcttgctccttgctaactcgcctgtgagctcgaggaggcctttccgccattgtcctcagccatatctggtacctcgatgtcgtggcgtttggaggtgtcccgtggagttcgaatcctgtcctctccaatataaaaaacgattagctttttaacacataattaattaagtattagctatttttttaaatagttaatataatttttgaaaacaacttttctataaagatatttttttgcaaaaaatagaagaacgcattagaaagcgtgctcataaaaaaaagagagagtagaagatgataagagggaatgccgaacacaacccaagtatctctcatgaccagacatgcgaaaataccattatactgtcttaatacctggtaggattgagtgatggtaccacaagaaccctcgtagtactagttggaggccgtctaggactctaggaggcccttcaagctactttttcttacaactagctgggtggcccgcgcaattgcgcggctagcacctaaacaaaatcatatatttttcagtatgattttacctaaaatttattaaatagctatccccgtatcatccccgtatttataattatatagtttttaaaagtcactctaccccttacttctgtcgtatccttttttatttacttgctcggtctatcactatttttattcattctcctttaaaccttaaaaaattggatcttatagttttttgagtttattatctcgttgggtttctttttataatttctcgaagtcccgtcaaacgctgccattatattcctctacggcccgtccaatgtcttttctctttattgtaattaggattttacaaatcgaacataattatcgtttgagttcattttttactttttataagtcccgccaaaccgtcagcggctttgccattgtactcctttattgctcgcccgctgcctcccttctttattgccattgagattttaaaatcgaacaggattatcattggttgtttttttactttttagaagttccgaacctttaaaaattggaccttatagtttttagaaattattgtcttgttgggtttcattttttataatttttagaagtcacatcaaacgatgccactatactcctctacgatccatccgtcgcctactctttattgtcattgggattctaaaaaccaaacataattatcgttggaatacattttttattttctagaagtctcgccaaccgtcagcggctctgcaactatactcctatataccccgcatgctgcttctcctttttattgtcattgagattttaaaaatcg

SEQ ID NO: 46768 - DNA, 1617 bp, Oryza sativa
tcctttcaaagctgttttaataatataactagctgggtggcccacgcaattgcgcggctagcaccaaaataaaatcatatatttttagtatgattttacttaaaatttattaaatagctatatcattgtactaagacatcgaaagatcaaaccttatcattcccccatgtttttaattatatagttttttaaaaatcacaccagttgctaccccttatgtcatctccttctttatttgcttgctcgatctaccattatttctattcattctcctgcaacctttaaaaattggatcttatagtttgtagagtttattgtcatgttgggtttcgtttttataatttctagacgtcccgtcaaacattatcattataattctctatggcccgtccactatatcttctctttattgtcattgagattttaaaaattgaacataattatcgtttggattcatttttactttctagaagtcccaccaaaccgtcagcggcttttccattgtacttctctacggctcgcccgttgcctcccttctttattattattgagattttaaaatcgaacatgattatcattgttttttttactttttagaagttcttaacctttaaaaattggaccttgtagtttttagggtttattgtcttgttgggttttattttttataatttttagaagtctcgtcaaacgatgccactatgctcctctacagcccgtccgctgcctactctttatttcattgtgattctaaaaatcgaacataactatcgttggaattcattttttattttctaaaagtcccgccaaccgttgtgaccgtgcttcttaacggcctgtccgtcattcctcctcttaatcgtcattgggattctatttgggttttgtttataatttttagatgccctatcaaccatcaccatctactttataggcatgaccacgatcaaaaccttgagagcaaacgtagaggcttccttttacattactttgatgtattttatttatataaaactatactgatcaatataaaccgttaaaatctagatcctttaaatatttcactttttatgattaatgtggtaattttcgccgcttctcagctctgccccatcatcggagtatgagctataacatatggaccgtaaatatgtagaaaactattagggaatcttgttacttaggattgtttttaaaaaagaaaagcatactgctgcctctagagattatgcgatagtgcaaaacttgaatgtggttgaaggagtttggatgcccagctggtttgcctcccctgcacatgattttgtacaggacgtgtcaattgtgcctatatacgatttctaatttagctacacggacaggacatgattgtctcgtgtagtaaattaagtttcctaatccaattttgatttcaattgctattgcgtagcacacatcaaattctagtccatgctctttcacgtgtctgattcatgatctaactgtgtagattttttttcttcggttaatatgaaaatttctagaccccagagtgtacgtgatgtcttctttcaaagttgtcttaataattttgaagtatataaaaataccgatcatggtaatttggaaccaattggt

SEQ ID NO: 46769 - DNA, 6731 bp, Oryza sativa
agcagttcattggatgaagtccagctttgcatccacgtcgggctcttgtgtgtagaagacaacccgaacagcaggccgctcatgtcatctgttgtgtccatcttggagaatggaagcacaacatttctggcaatgccaaatcagcctgcatattttgcacaaacaacaagtgaaatggacaaaatgacagacggtagctctagaaacaccatgactatgacagttcttcagggacggtagagcaactcaaacttaatgtagatgtgtcaggacggtagagcaactcaaacctaatgtagatggctcttgttttaccagaataatgcttgggaggttggagtgcttatattaagaaattctgaaaggaaagtgcttatgactgtatctggcatcttctacattttcaggatgacttacaatcaaagacatattttaagatattccaatcagtgactatgggcagcagttaataccctagagggattatgttgagtattagatgcagataaagttagtattgttgctatggactgagtgttatttgacttgctaaagtctgcaaagaatctgaccagttgaagtatcaggttttcttgtttaaaatttgtgagtataagtcaaactgaaaaaaaaacatattttctcaagtatttatattagtaccacatatttttattacttctgatggtcctggaacgtttcatatatcaagtgcacttgcaaactcggcaattttctgttgaagtccttacaatagttgaatgcagcgaatttatcacttaatcaccagaaagtaactgcaacaatcaaataaatcaaaagcactgaatatcagtatatttctaacctttttttttgactaatgtatatttctaaccttacccagatagcttaacttgttgggtaaattcatgtgcaatccttcctcttagtttttttgcagtctggcctttgattgtggtaattaaattatgtaaaacctgaattgttcctgctgaaagaaatgatattaagcatctggcaggaggagaactgaacagcagcaagaaatatccaatcttacaaggacagtgcagaagcagtctgtgggaggtacttataataagcaattccttgcagctattctccacaagagaaggaagaaaaatagacagcacatatctctctcgtccccatccactctctgcacttcctctcgaaatgcagattccttcagagatcgaaagctagcagtactggaactgctcagtgctcatcaccacataacaatttcaccgcaatgcagttcatggaggcattcatcccagcctttgtgatgactcgaaaaaggaagagtaattggacggagaaatggaaatctatcccctttaatgcgcggtgctagccggcgacttcacctccctctcccgctccggtaaccggtacgacggcggcggggggcggaagtcgtagccgtatggatgaaagaaaacgaatctccgaacatggttttccagtgagggacagaggtggcggcttttccgcctgtaggacgaccatggcgtccggcaaggctgacgtcggcgttggcggaggagaagcgatgaggaggtggtggcagtctggatgggctggcagaggctccagtggagcatcacatatggcgtagggggtgccttcaggcttcagcgacggcgaggcgccgaggcggccgccggcgtcagcggacgagcgcggcggcggcggcggcggcagggggaggggcgaccaaaagtctcggaccgaattgggccagagcaaaggtgcgggccgtgcagcatagcccaacgcaaagcacatactagtatccggtattgggccctatatgtaccggtccatgtaatgggctaatggcacgtacatgcgaatcccgtttcggcccatattgttggcagcacgctcgtcggaatcgggtccagcccacaggttcaacaattctggacgccgcctacccgtcttcttcctcgggttcaaccccaccgagctgcccgtgcccggtacaatgagcggcggaagctggcgagcaccgagctccggcgagcggtatgagagggccactgtcctggatgcttgccttcagcttccccgcgttctccttgagaccagggatcccgctgtccaagtgtccatccctcctcagctcatgctccgcaacatctttccgtgattctttcgcttggtgtcctggtgctcctcttcaccaggaggcatggtcgcatctcgcatgggccgatgggcatgctcttaagcttcctcatccctggcatatccaagccgcagcagatattactttggcaggttgctattctctccttcctcgttggggctgggttcattgggctgtacctaaagttcttctactggtcgtcggaacggaagatcaagaaagcctaagtcaccgatcttctgtagaatcattttgctcgtcacgctctggaggattaagaccggccgaaaccagtttagagaatacagacacaaccttttgtctgatatgttttgttgagaatgttgttggataactactatgatgtagaaatttctgcatttctaatatgagaaactagagtacttattaccacttatgatgtaagaggaggtttgctactccgtatgaaatttacttatttaccacctctttgttgaactttcaattttaagcttattttactccatctatagttgctttgaatttctttccatgctgctgtggataccaaggaccaagctggatttgctagacatcgtcattttctttaagtcctgatactgaaagatactatttttttgcaaaactaatgatttgaattcaggaattctttgtgcacagggtttgagctgtctctgtcctaattacaggttgagcctaacagacataaccgaaaagatgtgtgacattctttacgaattgactgttagaggtaagtgttctccagaaaattttgtgatgtactattcttatctttttgtttccaacaaatatctgttgtgaacaaacattatttacataagtgaaagtagcatttataattatagtagagggtgattgtgaacacacttcagtttgatatgttagttccaactccaaactgtttcatgtaagctttgttgtatgagtgcattctctgacacaagggctcactttctacttaaacatcttgagctcctatctttattcacaatggagcgtctgaaccttgtcgagtatgagatgctgaaattctggccatcaatgctggactttgtttcccctgagtatgttggcaggtgtgtttggctgatcaaggaatttagactacttccatattttcacagtgttaaagaagataaaagtagaggttagcataatctcaattgtttgcgcttgaaatacctggtgtttgatatggtctccttgaagtttacttgtgtgttttacagtttaggaagacagcaagtgtgaatctactctagatctcattgtatttctacaacatttttgtttctgcagaatgaaatattctgcatattttctataagggacaatttctataatgaatacacgtgctcaatcattatgttctcattgaatagttaactagtgaacttttttagaaggaaaattttatcgtccagcacccccccccccgaggtaccaaatctgggccgttcgttcggtgagatctaacggataggattgcacggtacctcccggtaccatttttatccctggcgcggtaccactttgccatgtgcggtggaagggtagcgaggtcttttcacatcatcctggatcgatccctcggctgcggcaacaccggcacagacgcggcttcagctcctggggactccggcggatgctgccgaggctaggcaagactgaaacggcggcagtttgcttccggcgatgtatagtggctgctccggcgattcagaccacggcgcgacagccttcccccatccaggatggaaagcttcgcttcactcaagtcggccaagacggcaaaacggaggatttggggcgcgattttttggcggctagggtttcggatttggggtcgaggtttcttcggcggcgctcgctctcgagtctgaaaagaagacggcggcgctcttgcgggagagataatcgcgctacgggatagatgaggaggacagacaatgcttcttttccttttccaatcctacccacgcgaaatcaacggccagatgggttttggtaccgcgtggtacatgtaccgagcggtacaaaacgcaggacgggagcattgctctttttagaaagactttaacttcagtacaatagagttagattgactgtactattgccctcctgccacgtctatgggatgcggacatgaggcgagtgtgcacaccatgctcttttttagtaaagcttctaatttgatctataggctagtttatataagatgtgggttaatgtacagcagttataaaatttactcctatctaattagcccaccattccaaattaccaaaacgcggattaatttgcttatgagaatctaacggattttcacctttcttcactcatttgcacttccataaaaaacctaacaagtctctcatgctcgcagattcacgaatgcattgagcatcccgtgtcaaatggagtaccagggtggaaggtaatatgcaggctctgaagagagttgctctgccgtttctgaagaactgtcagtcattgtgttcctagagttctcgactaccattttgtctgagtaacaagggcctgcgtctagtattatggggagtgagaaaatagcaatccacttggaaacctggcggcaaatgagtgaaccagtagtccagtataaatcctaaacctaccgtggacccagaaaaggttagcaattacacgaaccaatatgtaaggtaacatcgagaacaggaatggcacttggctggagacatctcactggacttgatgttagtcaccttgtggccaaataacttgctacaatgggttgtttggttgaatttcaacttgccccgccacagcccacatgttcatacgacctatagcctggttcctggcgacttgggaatggggatgtcactgcgtatcctatttattgactttgatgctgtacatggtgcctccaattatatacttgcactccctatcccagaaaaaaaaaatccaatcctcaggatatatctgaacatgcacatgcactttgtttaaatacatctctatgaaattggagccttatcggttgcccatatattagggaataaaaattattttataggtaaaacttttatatatttgttcgtagcgatttaaaaactaatggtacaaagaaattatgttgaaaatattttaaattaagtttgaaaatttaaattttaacttttgctttgacttattaagccaacaagatggggctcttggtttttcacttttgggatagagtacaggtagagaaagggcccacccaaaaaattgaccctggcgacgtctcaacgtcttcatttgccagcgccaggcttctcggtcgctggcgcacggtgcgcccgccgcctcttcggctcaccggcggccacgtagccatgttcggcaccttcatgctcgccagcggcagcgccacgaagtccctgtcgacgctgccgtccttccaccggcactccggcaggcacccctgcgctcgccgccggctcgaactcgtccaggcactagctagcttgcacgttggaatggcgcctttccaggcgtcagagtggccggccatgccgcgatggtcatccactctgttatgctgaagggaaattttagccggccatgccgcgatggttgctgaatggaaattttagggtacctttaagtcgacattttagagcaattcagatcctttgcagtattacagaccgacatgtgggcccgagggtctgtggagcctctgcagtattgcagatcgacacgtgagctcgagagtatgtagagtccacatgttagagagcagtactgtacatagaggatcgcactcatttataacttattagagttgtaaggttctgtttttaaaagatgaattttatatatacctggtagtacaagaaatatgataggatcagttagtttttactgtttttaataaggcaactagcagaaccttatataaaagcgactacaataaatgtaagcaggatctacaaattatctagaagagcggagagagaagaaaaacaagctacaaatttaccatctacagctcatgtcagtggcggacgtagctttaaaacatagatcgggcggagaactgagatgtgcactcaataaaaacaattcaacacaacacatattatatttatatttcaatcgcataactacctcgatcatttcaatcatcgtttgcggcgtgcatgtgttgtgaagagatggactaatctgttgggtgttcacaccttgttatacctaattttgatggcccatgactattataagagggtagggagggccttgggggtatggggtgacacggatcgtagctgggtcggtcgatccaccttgcctgcctaatgattagatccacccctggctccagtatttgtttcaaggcattgtgtgtatgagaggtagatcagcagttaatggtgcgatacgtatatttatacgtacctatagattattggagaattttttttatttataattttttttattaaaagttttacaaaaataatttttcattttgaaaattgacggaagt

SEQ ID NO: 46770 - DNA, 2466 bp, Oryza sativa
tggtgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtattgttggtaacattggctttgaaccaaaatcaattattatgcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaaaagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatcgagttgttgctcaaggcatacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcaatttaggaaataaaatgctgttgtgatgtaatgagtgttcggactaaatacttctatcgtgtaatttcaattcaatgttgttgtaatgagtacctccgactattgttgtactagtattattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgtgcgagtggttgcgtgtcgacccccgtcacgttccttggtacgcgtatgtcgagggtgcacagaagaagccgtcgctgcgagagcaccgctaggactttcgtccttgtgcacacgcgaccaggcttactggctcac

SEQ ID NO: 46771 - DNA, 7298 bp, Oryza sativa
tttgtctcgtctacatagttcttttcattcatatggggctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcccccagggcggcaagggggccgcctgcaaaattccatgccccctcgccgcccatttgcaggcggccccccgcacagtataaaatcgccctagcggagggcggcaagggggccgcctgcaaatttcgttgacggccgtcgcccgagagcgaacggccgtctgccacgtcatttttgccgccctctgagagggcggagggcggtaggcgactacttccgtcaattttcaaaatggaaaattatttttgtaaaacttttaataaaaaaaattataaataaaaaaaggtcattattggattggtcgtagctaccatcgtagtttatatccaatctttctttaggttggcatagatctaacttctaagagtatattttactcttaacaacatcgtattacacctaatatacatacaatagtagcaagtagcaagaagtttctcgttaatgttaaaccaacacacattgttatgactcctgagaagaactcggcgtccacggcgtatcagaagaccagagatgaactggatagctttcaactacctcaccacagccatcttcctcctcctccttccggcgtgcgtagctgatgaccagcttgtccccggcaaacctctgtccattggctccaccgtcgtttcgaacggcggcgccttcgccttaggattcttctccccgaccaactccacctcgtccaatctctaccttggcatttggtacaacgacatctcgccgctcaccttggtctgggttgccaaccgaggaactccggtgaaggacggcggccatggcagctcttcctctgcaccgtcgctcaccctgtcaaactcctctggcctcgtcttggccgacggcgacggccgcgttctttggactacggacatcaccattattgcggcgaattctccggcggttgcagtgctgatgaacaccggcaacctcgtcgtccggtcgccgaacggcgccacgctgtggcagagcttcgaccacccgacggacacgtacctccccggcatgaagatagggatcaactacaggacgcgagtcggcgagcgcctcctctcctggaacgacggccccggcgatccatcgccggggagcttctcgttcggcggcgacccggacacgttcctccagctcttcatctggaaccagtcacgcccgtactggcgctccccggtttggacaggcaacccgatccccagccagctgatggtcaacggcaccaccgtgatctacctgtccgtcgtcgacgccgacgacgagatctacctctccttcggcatctccgaccgggcgccgcgcacgcggtacgtgctaacaaactccggcaagctccaagtcctctcatgggacggcggcgacggcgcgtcggagtggagcaagctcggcgagctgccgaaatacgagtgcgaacactacggctactgcgggccatacggttactgctactattcggaggtggctccgacatgcgagtgcctcgatgggtttgagccgaggagcaaggaggagtggagcaacggccgtttctcgcggggatgccggcgaacggaggagctgccctgcggcggcgacggtggcgacgccgtcttcttggagatgcaggggatgcagttgccggacaagttcgtgcgcgtcaggaacaagacgttccacgagtgcgcggcggagtgcgccggtgactgctcctgcacggcgtacgcgtatgccaacctgggtggtagcggcagcgcaaggaaggacgcgacgaggtgcttggtgtggctgggagagctgatcgacacacagaaagttggcccggattgggtgccttggggcatagttggtggtgagacgctttatctcaaagctgcaggtttcacaggtaaaactttatcggactatcttttcacttatactttatactttcaattttaaatttaaagctgatttaaggtatttttattaaaatttattttttagtctttgcttttagatcgttaagaacatctatataaaagttttatttataaattatttttcatttgtaaatatgtgatagggcttaagtctcgcagaatatcaggtcgcagtttgtatgtttcattcagagttgcttgacatcacccgctgaacattctttttaatgtcaaaacatctcattatagttcgtgcaatattcccctcctagattcctttagtctccgggtgaaccttccacgtatgtttctttagcgacaggattcagcgcgcaatggtaaaagaaaggagctcctatatcttttgggtcaaatgaccgaatgatcaacggtgtgtggacaaactctagataagattactgacgagttaatgtgacatgtataatattgtaaagactaacccttcattccattcccctgacaggccgttcctaacccttataagctgaacttgctatttaaatgccagaagcaggactatttgccatggattcgtggaatgtcaatcctaggcatttcttaattctcaaaaactgttgctagtctgctgtaaatcctaaacatctgcattatttacttgcatgtcacgacccaagctgcagctcagcaatttcttactgctcctaatgcatgtctaaagaaattaaggaatggctatatatacgagcgaaacataggtgatctatctccttcaggccacagattgacagatggattggtcatcatctgctttcacctgcatcgccgccttcctcctcttgtcgccggcgttgtgcgccgccgacgaccggattgtctccggcaagccactctcccccggcgccgctgtcatctccgatggcggcgacttcgccttgggcttcttcgccccatctaactcaactccggcgaagctgcacctcggcatatggtacaacaacatcccacggcgcaccgtggtttgggtcgccaaccgggcaactccgatcatcgttaacggcagctctaactcctcgttgccttctcttgccatgaccaacacatctgaccttgtcttgtccgatgccagcggacagattgtttggaccacgaacctcaccgccgtagcgagctcctcctcgttgtcgccgtcaccgtcgacggccgtgctcatgaacacgggcaacctcgtcgttcggtcgcagaacggcaccgtgctgtggcagagctttagccagccgacggacacgctgctccccggcatgaaagtgaggctcagctaccggacgctcgccggcgaccggctggtttcatggaagagccccgaggacccctcgccgggcagcttctcctacggcggcgactcagacacgttcgtccagttcttcatatggaacggttcgcgcccggcgtggcgcgccggcgtctggacggggtacatggtgacgtcgagccagttccaggccaacgccagaacggcggtctacctggcactggtcgacaccgacaacgacctatccattgtgttcaccgtagccgacggcgccccgcccacgcatttcctgttgagcgactccggcaagctacagctccttggctggaacaaggaagcatccgaatggatgatgctcgccacatggccggccatggattgcttcacgtatgagcactgcggcccgggcggctcctgcgacgccacgggcgccgtcccgacgtgcaagtgcctggacgggttcgagccagtgagcgcggaggagtggaacagcggcctgttctcccgtggctgccgacgaaaggaggcgctgcgatgcggcggcgacgggcacttcgtggcgctgccgggcatgaaggtgcctgacaggttcgtgcacgtcgggaacaggagcctcgacgagtgcgcggcggagtgcggcggcgactgcaactgcgtggcgtacgcttacgcgaccctgaacagcagcgctaagtcaaggggtgacgtgacgaggtgcttggtttgggccggcgacggcgagctcgtcgacacgggcaggttgggtcccgggcaggtctggggcaccgtcggtgccggcggcgacagccgtgaaacactctaccttagagtggcaggcatgccaaattcaggtacaggcctaaagcatcatacttcatgttatgataaaaaacggttcaggtatacgagtgccaaatgcaagtatgatccatatgcatttcacgaaattaggagagaatatcatgtgcaagattctttaaaatgaaatattggtcgaaaatgaaatgaacagtgtgtctctgtgcaggtaaaaggaaacagagaaatgcagtgaaaattgcagtgccagtgttagtgattgtcacctgcatttccctttcatggttctgcatcttcagaggtaagaacagaattcttgtttttcccctcaatgcttctgtacatacactacaagagcagaggaacataatggtcataaacttttacggcaggtaagaaaaggagcgtgaaagaacacaagaaatcacaagttcagggagtactgacagctactgcccttgaacttgaagaagcaagcacaacccatgaccatgaatttccatttgtaaaatttgatgatattgtggctgcaacaaacaacttctccaaatcattcatggttggacagggcggttttggtaaagtttataaggtaacttccagtgatataattttaaggatttttagagtccatgagcaggactcgttaccacaaattagcactagaaagtctataaaatattatacctcttcaaggagcataaaaatctaattatctttttatgtgcattaacatgacactgctatttctcaaaaggggatgttacaaggttgtcaagaggttgctgtgaaaaggctaagtagagactctgatcaaggaatagtggagtttagaaatgaagtcactctgattgctaaactacaacaccgaaatttggttcgacttctcggttgctgcgttgagggacatgagaaattgttaatttacgagtacttgccaaataaaagcttggatgtcgccattttcagtatgttcaaccagcatatcacaagttcaaagaacaatttaatgaatgtttatttgcatttcacacatagcatatatgttcttttgcagagagtgaaagaggtgtaacactagactggccagcaaggttcagaataatcaaaggtgttgctaggggccttgtttatctacatcatgattcaaggttgacgattattcatagagatctcaaaactagtaatgctttgctggactcggagatgaggcccaaaatagcagactttggtatggcacgcatatttggtgacaaccaacagaatgccaatactagaagagttgttggaacatagtgcgtaattctttgtgccaatttcatagcttaacatgcagattaactcaattcaactttcataacttttcaatgtgaaattttctcaacagtggctacatggctcctgaatatgcaatggagggaatgttttctgtcaagactgacatctatagcttcggtgtcttactcttggaggttatcagtggtgtgaaaataagcaatattgatcgcattatggactttcctaaccttatagtctatgtaagtattttgcttctaagcttatatagctcttagatccttaaggtatatggagttcttatgcaatctgaagatgtaatttcgtttttctgttaggcatggagcctttggatggaagggagggcaaaggagctggtagacctgaatatcaccgagagctgcactctggatgaggccttgctttgcattcatgtagggctcttgtgtgttcaggaaaatcctgatgacaggccactcatgtcttctgttgtgtccatcttggagaatggaagcaccacactgccaaccccaaatcaccctgcatattttgctccaaggaaaaatggggcagatcagagaagagacaatgtcttcaactctgggaatgagatgactcttacagttctggaggggagatagagcaactattcagttttaattgcagaattgttgtctaacaaaatgccaggaatatacttgacatgcatttttttttgtaagttgtattagcctaatcttgacaataatatcttgtaccaggtatataaaggtcatcttctaaaaatgaaagctttcaactctgagtctctcacaaatctctgaaatgaccacctaaaggcccttaaagtttcccttatgcataccttggctagttgcaagacgttcctgtaacgctccgcttttcgtgaggcgttaaaaactaatttggcaaaatcctaattgcgaaaatttttgttccttgtgtgcaagtctaagttgtgccgtggatctcaattcaaatctgtccttgatccctctcgtcgccatcaaatccttctcctcgaagtccctattccgatttaagtattcgaaattcaaatcctttcttgaaaaccttgccaaatatcttcccgactccaaaatatccaaattcccattttgcattcaaatccaaactccatatcaaatttctctccaaatcagatttcccagtaaaagtctacttcgcctcctcttgttttggatgggccggatttcctcccatcagcccacttctctccctcagccctcctccctcagtcgccttcccccttctaacgtgcgccgcacgcgagccgctcgggagagaaag

SEQ ID NO: 46772 - DNA, 2485 bp, Oryza sativa
gtgcacgccgcccctcccggttcgccgccgctagacggtacgagccgctcgccgccagccgtcggatcggccgcccggcctcccctccctttcctccatccaacgaaaactgtccacgtgggcttgaccgggtcaagctgacgccccgccagccagcccccccccccccctttgggcctcgccagccgttgggctgcgctgctccccggtccaatggactaaagtccacttatactccctcgtgccgagcccagtaccccccacccaaaagctaaagtccatctttgctcccttcccaaacacagtgaccaaaagtccatatctgttccctcccaattcacctctctctcaccatatgttggccccacatgtcaatgagtgataaaagaatattcttgagaatattcttttccataaaattcataaatcattgcctgcattccaaaaaaaaaagattcgacaaatcatttccttgtccagaaattccaattaaactcccaaaattcatatctcccgatccgtaattccgattaaccccgttccacttccagtattcccgtaaaatcgagatctatttaatggcaccattatctagtctaaataggatttttcttttggtcttttgtttaggtttttgattgtttgcgtatagttgcggttaccggattttcgtcgatcgcgggttttctcgaagattcgtgaagctccgtgaagaccttgagcaaggcaagtcaccctttgatcaattgctcctataattggaaaatcattattattttgtttgcaacttgcattagtagaatcacacacttaatttgcttggcctcggtttgcatgtcaaatcgacggacctacccagtagtcgcactaattcctgtaggttgtactaccctgattccttgtcgctccacccttgtggtacttcggtatttgtactctctgagtgcgtataccaaatatcccacatacaccgttgattgtcgaaaatttgggaaatgggtttgagaagccttgaaaacccgacatgtggtgtcggtgtgtttaaaaataaaatgaattatgaaaactcgcgatgcgggggttgtgcctatgtggcactgtcccgtattcgcatataaggaccgattcctgtgggaaactcatcgagcataatcaaagtgcaaccacaaggtggaatgggacaccctggctaagtaactagtcggttcagggaaacctcgcatgccaatagttgggaacgccggagcggggtctgttggagccaaaccgggttcctggtaagcaaggaagagaagcttgctgaattaccgatcgaggtggttggagtttgatttgtgaaaactaaaatggcctatatttatgtgaggattcgatccttctatgtggcatgaggtaaccctgggtcggcttgggaaaggctttgttgcgaacctccgataccgacgggtgttcggaataagttcgtatcttgtgggtaaagtgtacccctctgcagaggttaactaactgttcgaacagccgtgcccacggtcatgggtggatgtgaggtggttcccgttgcgtagatttgtttgcctgtgctttgtgaaaagttgttgtggtgttggaatcgtaaccagaatcagcctacgtggcagatggatgacctgagtggtcagaaacgaatctgtgtgattcgggatgtctgcgggcatcatagactaggcttcccgagtggaagcggattgctttgctgctgggcagctggactctgggagtccgagaaaatgaaaaaggctctgggagccgcttaatcaagtgaaatggctctgggagccgataagtaatgatatgacccgggaggtcggtacattaccatttgacttgttgaaaagcatctcttaagtcgaatcgagacacaagtctcttttcgatccaaactcaaaaagaaataaatcacttagtgttttcaaaatgatttcaaacaaaggatttgcaaaacaaccttgcctctcttccaagcttgcattaaacacctaaattcccgtgacttgctgagtacgaaagtactcacccttgctctatataaatatatatagttcccccgccttgaagtgaagtgaagattagggtttcgtcctggttcccagccatcgcctgtggtgttgggtgttagtccgttggttccgctgctgctgctgttgttggtgtttcctcgtccatgtcgtcggttgcattctcgggctgttctgagctgcaacctaagttaaggtaaataagtcatctatttattttaaggattttcaatgattcatatttgtcaccatggataccagcactatggtcctgggactggtaccgagatcgcggtttcgtaggaagcggttcgcgccgttattcctacgacacgctcctatcaggtgacgttgtacggcggtgccggattggggtgtgacagttcccctccaagtcaacacatgttggcatcagctgcgttgtgttttag

SEQ ID NO: 46773 - DNA, 736 bp, Oryza sativa
acggcggatggcgacggcggctatcgccggcgagcaaagaggggtttctcgccggagcgacgaggggtcaattcgccggtgctggagcatctacgcgaggtcgcgaactcattccaccggtcgagagggcacgggcggcgccgagagaggccggcgacggcgagttcgtgcgcggcacagagcgactacgcggcgtcgagcactctagcagcctaaggaggaggaaaaacagagagaggggcggagggagtcaccgcgacggggagaggcggcgggggacggccggtggcacgagacgcgatcacggcgacctcgggtcgggcaagggaagaagacggcgcccggagtcccgcgtcacgcgcccacgcacgcaccggctcccccggtgctcggcgacggacggcgacggcgagaacagcgggaaggcaacgatggcacggtggaggtggagagtgaagcgggagggattgtgaggaggggctcggctttatagcggaggcgaggtcggttcgaggcgggagcgagcggcaaaggcggttcgtgggcgacgtggggacggcgacggcgtggatgcaagggacgatggaggcggtggatcggacggcgaagaatcgggtcacgagcgcgggaggagcaatatggcgcggtcaaggtgggggcactggcgcggcgggacgtcgtcggcgtcctctgcctccgcgcgcaagaagacaaggacgggagagagagaggccgg

SEQ ID NO: 46774 - DNA, 1964 bp, Oryza sativa
attcctgcagcccctaattttaaattgtattcctacttgaactcttcttttattttttttttctaattttggattttatttttatttttattcccaattttaattaatcgcgctcatattgggttcttatatggactcttcttttaatattctttatttttaattctaaattttaactattttaaaattgttattcctacttggactatcattttcttttataattttggattttatttaatttttatttcgaattttgattaatctcatattgagttcttatatggaaacttctttcaatattgcttatttttaatcctgaatttcagctatttttaaattgtatttctactgggactcttttttttctaattttgaattttattttatttttatttcaaattttgattaatctcatattggttcttatatagaaacttctttcaatattgcttattttttaattccgaattttagctatttttagattgtatttctactcggactcttcttttcttttttttctttttcttcgattaatgtgggaatttctagcccccacagcgaacgtggtgcctcctttcaaagctgttttaataatataatagatagatagatagatagatagatttgctacttcctattttttaaaaatgtgtttactagttggattgtaaaagtttacacccttgtgtttgttgcacaggtcataggaggaagagcaatgcggtcaagattgttctagcagtgttaagcagtattttggttgtcctatgcatttcctttgcatggttaaaaatcaaaggccggtatattcagtgctcttttatttacttagatgcgtatggtatactcacaagaaaaattaaagttggttacatttgattttgtgagcaggcaagaaaagaaaacgcgaaaagcacaggaagctatttttggatggtgcgtgtacatctgaagagattgaggatgggagccctatccaagatcttgaactcccatatgtaagatttgaggaaattgctttagcaacccacaatttctcagaagaaaataagattgggcaaggaggttttggcaaagtttatatggtaattcgttccctagtaaaacttcctcttatttattatagtttgttcactaattcattttgtatgacacatgctcaaatacaaatttcttctcaacttttttaaggcaatgctaggtggtcaggaagttgctgttaagaggttaagtaaggattctcgacaagggacagaggaattcaggaatgaagttattcttatcgcaaaattgcagcataggaatttggttcgccttcttggttgttgtgttgagggagatgaaaagctgctaatttatgagtacttaccaaacaaaagcctagatgctaccctttttggtatgccctggtgacatatcaagcataagctactaaatcgacttgacaatagattgcttacatttgcttctttctatagatgtttcgaggaaattgaaactagactggagaacacggtttaatataatcaaaggagtggcaaggggacttctttatctacaccaagactcaagattaaccataattcacagagatcttaaagctggcaatgttttgctagatgcagagatgaaacccaagatagcagactttggtatggcgaggatcgttggtgataatcaacaaaatacaaatactcgacgtgttgttggaacatagtgagtttctatttgaattaattgttcaaagtaagtgtgattaatttaaatcatgtttagtaactcttgcaattgaaatggttacagtggttacatggctcctgagtatgcaatggaaggtgtcttttctactaaatccgatgtctatagctttggtgtgttactattggaggttgttactggtataaggagaagctcgactagtaacatcatgggttttgcaaacctcatagttttggtga

SEQ ID NO: 46775 - DNA, 8319 bp, Oryza sativa
  unsure (1)..(8319): unsure at all n locations
agcactgttgtgtgttcaagaaaaccctgatgatagaccacttatgtcatccgttgtgttcttcctggacaatgggagtaatactgcacttccagccccaaatagccctgcctattttgcacaaaggagttctgaaatagagcaattgagagataatattcagaactcaatgaatacttttacgctaacagatatagaggggaggtagctaaggataattctttgacttaggatgtaacaatcactgtccaaagaaaaatgcagacagctgatgcatgatttgtggtttggaactcaatttgttgctattcttttctagccctttctttggtctttctcgttatatcacaaaaaaaaatctaaaaaaatctaaacaacacattatacttaaaaagtaaaagccaacatctgtacaagtgtaggatgtcactcagttgaacagacagaacgttgactgacacgaagggtatgcattcatatgaagctaagtcaccttcaactcgttcccgaatcccgacgcaccagtgcagcacgtacggcaactgcgacatcaccgacgggtgccgccgccacgcgcaagtgcctcgacggcttcgagccggcgagcggcgaggagtggagcaccggcaggttctcggggggttgccggcggaaggaggcgctgcccgtgcgacgccgccgatgatttcttggcgctgccgcggatgaaggtgccggacaagttctctatgctcgtcgctttgcaatgaaacagtagaccagtttaccaagctttgctcctgctttgagacttgccgggtcttcacctttcctatacataaaagctcgtcacgatctgtagcgatcagtctctttcagtacacaagatggggaacaactggatttaacggaccaaggttttcatagccgctgaggtaaagagttttccttttcatcccttgtcaatgagggattgaggggcaggaagtctattttatgatgtttcattgtgtgaagtggtaaaccaagtacggaaagttgccaacgttgccagggaagtgggccaagttgttgaggatggattctaatatctcgggtggacgtccacccgtgtgtttaaaacagtttccccaagttgttccaaaatctatatttcacacgcaggcaatgatatagcattgtagcctgctcacttcacttgctcagtgcaagctcatactgaaaaggaagaaggttctgatggatcgatcagctgcggctttagcctgcatcaccagtgttctcctcctcctgccgccgccatgtgcatccgacgaccggcttgtcaccggcaagccgctctcccctggcgccaccctcgtctccgacggcggtgccttcgccttgagctttttctccccctcaactgccactccggagaagatgtacctcggcatatggtacaacgacatcccccagcgcacggtggtgtgggtcgccgaccgaggaactccggtcacaaacactagttcgtctgcgccgacgctgtcgcttaccaactcctccaaccttgtcttgtctgacgctgacggccgcgttcgctggtcgaccaacatcaccgacgatgcagcgggctccggctccacggcggtgctcctgaacaccggcaacctcgtcatccggtcaccgaacggcaccatcctgtggaagagcttcgatcaccccaccgactcgttcctccctgggatgaagcttgggatgacgttcaagacgcgtgtctccgatcgcttggtgtcgtggaggggccccggtgacccgtcgccgggaagcttctcgttcggcggcgacccggacacgttcctccaggtgttcgtccggaaagggacgcgcccggtttcgagggacgcgccatggacgggctacatgatgttgagccggtacctgcaagtgaattccagcgacatcttctacttctctgttgtcgacaacgacgagaagagatacataacgttcagcgtctccgagggctcgccgcacaccaggtatgtgattacctacgccggcaggtaccagttccagcgctggaacatcagctcgtcagcgtgggcggtggtcgccgagttgcctagatgggactgcaactactacaactactgcggcccgaacggctactgtgcgacaacacggcgagggcgcctgccgtcccgacgtgcaagtgcctcgcagggttcgagccggcgagcgcggaggagtggaacagcggccggttctcgcgtggttgccggcggacggaggcggtgcagtgcagcgaccgtttcttggccgtgccggggatgaagtcgccggacaagttcgtgcacgtcccgaacaggacgctcgacgcgtgcgccgccgagtgcagcaacaactgctcctgcgtggcgtacgcctacgccaacctgagtagcagcatatcagagggcgacgtgacgaggtgcttggtgtggtcaggcgagctgattgacacagagaagataggcgaatggcctgaaagtgacacgatccaccttaggcttgccagcattgacgcggnnaatgtatgattacaattttcttctgcaaaaaaaaaagtggttacaatttcagtgattatatgagaagtggattcttgtcccttaagaggacatcttctcgttttatgcatgacatttaaaaagttatcaaaataattgaaaaaaaatgttaagatagatcaatatatgatatattgtttcgcaaacatgcaaattaaaattcgacttatacaattcaaaaaaataacaaatttgactgtgaattacacgttcttttcataatcaaatttattatattttttttctacttatataagttgaatttgaatatacatgttcgtgaagtgacatattacatgttgatccatcataataattttttgatgactttttaagtgaaatgtaaaaacgaggggatatccctttaagggatgaatatagttttccgattatatgctttagtactccactactcggtaccttttaataccacctttttagtttatttttattagcttaggtaccaaaatttacaatagaaaccgtgccaaggatcgctatgttacaatttactacttcctttctttcttaaaaaatacaattgctagttggatcgtaaaagtttgcagcgttttgtactgttgtaaaggtcggaggacgaagatcaatgccgtactcaaggttgttctgccagtgttaagcagcattattattgtcctatgcatgtcctttgcatggttaaaaattaaaggtatattcagtattcttttcttttcttagaagccccatggtacagtcatcagaaaattaacgttggatacttttgattttctgagcaggcaagaaaagaaaccgggaaaagcacaggaagctaattttcgatggtgcgaatacatctgaagagattgggcaagggaaccctgtccaagatcttgaacttccatttgtaagatttgaggatattgctctagcaacccacaatttctcagaagcaaataagattgggcaaggaggttttggcaaagtttacatggtaattcgttccctagctagtaaaacatcctcttatttattatagtttgttcactaattcattttctatgacacaagctcaaatttcttctcaacctttttaaggcaatgctaggtggtcaggaagttgctgttaagaggttaagtaaggattctcgacaagggacagaggaattcaggaatgaagttattcttatcgcaaaattgcagcacagaaatttggttcgccttcttagttgttgtgttgagagagatgaaaagctgctaatttatgagtatttacctaacaaaagcttagatgctaccctttttggtatgccctggtgacatatcaagcataagctactaaattgacttgacaatagattgcttacatttacttctttctatggatgtttcaaggaaatttaaactagactggagaacacggtttactataataaagggagtggcaagaggacttctttatctacaccaagactcaagattaaccataattcacagagatcttaaagctggcaatgttctactagatgcagagatgaaacccaagatagcagactttggtatggcaaggatctttggtgataatcaacaaaatgcaaatactcgacgtgttgttggaacatagtgagttgccatttgaattaatttctcaaagtaaacatgattaatttaaatcatgtttagtaactcttgcgattgaaatggtaacagtggttatatggctcctgagtatgcaattgaaggtatcttctctactaaatccgatgtctatagctttggtgtgttactactggaagttgtaactggtataaggagaagctctactagtaacatcatggactttccaaacctcatagtttacgtgagtatatatatcttttctgtagatttatctcagattaaaaccagaagatttgggatcttttttcttagttctataaccaaacattactttttattgtttcagtcatggaacatgtggaaggaagggaagatgaaggatttggcagactcatcaattatggatagttgcttactacatgaagttttgctatgtatccatgtagcactgttgtgtgttcaagaaaacccagatgacaggccacttatgtcatccgttgtgcccaccctggagagtgggagtaccactgcacttccaaccccgaattgccctgcttactttgcacaaaggagttctgaaatagagcaattgagagataatattcagaactcaatgaatacttttacgctaacagatatagaggggaggtagctaaggataattctttgactttagatgatgtaacaatcactgtccaaagaaaaaggcagacagctgatgcatgatttgtggtttggaactcaatttgttgctattcttttctagccctttctttggtctttctcgttatatcacaaaaaaaatctaaataacacattataattaaaaaaataaaagctcatatttgtacaaatgtaggatgtcactcagttgaatacacagaacattgactgacacgaagggtatgcattcatatgaagctaagtcaaatctagagtcgtcaacatgacggtaatcaatacaataccatcagaagtacgtctgcaataggataaattcaatattatttgtctaaggctggtttgagccgcctaatagtgtcgttgatcacgttttcctgcagctctctcctgatcctaataaaattcagccgacgatcttcacctgtccaaaataaagtcgatttcatcaatcatcagaagcaagtctggaaggtgactttcaggtttaagctctgaagtttcggtaaccaagacaaatgcaaaacgagtagagactttaaacatacctgaaaaattcacaacctacaactctggtttgatttcatattttcattgttctgactaggactgtacagaagagaacaccattggacggacattcacgcgcagtatgaacaacacgcacatgcaggaaaaaaaacacgcttccacaccaaatagtactagtatttacctaccgatcctcttgttcttggtcgcaccatcgtgttcacctcctaagaagaaaatcttcagttgttgttgaatattgcattgtgcgtaacagaggagactatttcttccgtccatttgttaggccttgtttagttccaaaaaatttgtctcgcaagacgaattctttaagtctaattagtccatgattagctataagtgctacagtaaccccatatatgctaatgacatattaattagacttaacaaatttgtcttgcggtttccaggtgagttacgaaattagttttttcattcgtgaccgaaaacttcaaccgacatccggtcaaacgtccgatgtgacacttaaaaattttatttcgcgaattaaacacgccgttaatctacctggcacaacgtcaccgtgtactagtaccaactgtcagacttagacgttgtctgaaactcttgatgctggaaaaaaaaaaaactcgcccaatgaaatttcattcagactgcaattttcagagtttatgtatctgattgtgcacttcgaagctgctcctcctgattctgtaatcctgtagagtacagaagggaatacaaatcttggtgatggatagtacagcttgtactaccatcgtcgtcttcctcctcctcttgccgcggttgtgttcgtcggccagcgacaagatagagcttggcgagcaactgttgccggggcaaacaagagcttcggatggcggggccttcgtgctaggcttcttctcgccgtccaattccacaccggagaggcagtacatcggcatatggtacaacatcaccgaccgcaccgtggtgtgggtggccaaccgggaagctccggcgatcgccgccggcaggtccatcgccccgaggcttgcgctgaccaacgactccaacctcgtcttgtccgacgccgacggccgcgttctttggtcgaccaatgtcaccgccggcgtcgcggctgggcgctcgacctcgccgccggtggccgagctcctcaacaatggcaacctcgtcatccggtcgaacggcgccatcctgtggcagagcttcgaccacccgaccgacacgctcatacctgagatgaagatccagctgaacaaacggacgcggcgtggcgcgcgccttgtgtcctggaaggacgccggcggcgacccctcgccggggagcttctcgtacggcatggacccggagacgtcgctccagctcgtcatgtggaacgggtccaggccgtactggcgcaccaccgtgtggacgggctacctcacctccggccagtacctcgccgccaccggcacgaccatctaccggacgtggtggacaacgacgatgagatctacgtgaagctcagggtctccgacggcgcctcgccgacgcggtacgtgatgaccagctccggcgagttccagctcctgggctgggacaagagctcgtcggagtggatcaccttcagctcgttcccgacgcaccactgcaccacgtacggctactgcgggcgaacggctaatgagacatcacgacgggcgccgccgccgcgtgcaagtgcctcgacggcttcgagccggcaagcggcggggagtggagcgccggcaggttctcggggggttgccggcggaaggaggcgccgccgtgcggtggcggggatggtttcttggcgctgccgcggatgaaggtgccggacaagttctcgacgctcgtcgggaacatgacgttcgacgagtgcgcggcgaggtgcgccatgaactgctcgtgcgaggcgtacgcccacgccgacctgagcagcagcagcgcccggggggacatcggccggtgcttggtgtgggccagtgagcttatcgacatggtgatgatcggccagacgacatggggccgcgccggcgagacgctctacctccgtgttcctgcaagttcaacaggtaagctaaattgataaattttgaaaccagatttcacaagcatatgcaggttgtatcatttgctgttggttaaaaatgagctgaaaactgtcaaagagacaaaattcaaaccagtttcgtattgcatttgttcataatacattgccctgttttggtgcaggtagcaggggaaggggaaatgttgtgaaaattgctgtgccaatactggccagcgctttagtgctcacctgcattttctttgtatatttctgcaagtccagaggtacagtagtacttctatccttgtttttatgtttagattatatgctctgatcagtcatgagagaagacaagaccttaacttaaactttacagagaatagaagaaaaagagatagccagaagacgttggttcctggaagtaggaatacttcaagtgaacttcttgaggaaaatcctactcaggatcttgaatttccatccatacgattcagtgatattgttgctgcaacagacaacttctccaaatcatgtttgatcggacgtggaggatttggaaaggtttacaaggtaatttattctgaattaaccttttgcagtttttttttctgaattgaattatactcaattcttacttactcttttataatttggaaggtaacattagaaaatggtcaagaagttgcaatcaaaaggctcagcaaggattctgaccaaggaatagaggagttcaaaaacgaggctattttgattgccaaattacagcataggaacttggttcgacttcttggctgttgcactgagggatctgaaaagttgttgatatatgaatacttagctaacaaaggcctagatggg

SEQ ID NO: 46776 - DNA, 1341 bp, Oryza sativa
gaattactaggagagtcgtcggaacatagtgagtaatgctcgaaccatcgcgaattaacatttgtttggaccctgtgcacggactaattttttgaagtgatatgatccaactagtggctacatggctcctgaatatgctatgggaggtatcttttctatgaagtccgatgtctatagctttggtgtgctgcttttggagatcgtaagcggttctaggataagctctactgatttcattgaggacttcccaaatctttcaatatatgtaagtattccattctatgaatttgtaatcacttcatttacttgcagaaggatttgaagagaagcaagttatacttatataattaacttatcaatatgatggattcaggcgtggaacctatggaatgaagggaaggcaaaaaacatgattgacccatctattgtggcaagttgcctattagatgaggtcatgctatgcatccatgttggactcttgtgcgttcaggaaaatctaaatgataggccactcatgtcatctgttatgcttattttggagaatggaagcaattcacttccagccccaaatagacctgcttactttgcgcaaagggatatcgaaatggagcaaccaagagatgacactcagaactcaaacaacacagtcactcttacagttatggaggggcgatagagtactaagaggtggtcaaatgggctcgattacgtcaacagcattcaagaagttggtagtgttaggtacttcagtgatgtcttcatgtgaaagacctgcaggagtgcccagtgcaaagatcccaataagaaagacactcctcaacatcaactgttttcaatatggctcaacattcattgaatttgagatcagaagacatgagtcttgataattgacggtttgatatgtattgttgtcacagaatgtgtcacttttggagagaagatagaaattggggatttcaactattgcaattgacttagctcaaagagcatataaatatgtacaagagaagtagaaatgtctataataccctcaatactcttaacagaatgagcatgctacatatacatgtaaaagagtagaagtaagggacaaaccgtttccaagtatcggatgcttcatgttttcaccatgccagctatcagatggcattccctggcacatctgatgacaattgacaagtacctcattagtcctgataatgtctttgtactaatgagcgaactaaaacatctgaataaatagtaagaacctgttttatgtctcaggggatacagttttcacatgctcgatgtctaggtaattagaccacaatccatcaccttggcttttagcttcttctt

SEQ ID NO: 46777 - DNA, 786 bp, Oryza sativa
cacgcgttgggatcttcctcgcccaaaaacataaagtggggcggggtgtatttcgcagtcacaaactcgtacagttccggcctggcagctggttttggtttttctggttttttaaattcgatgcgatgaacttttacagcttcattgatgaggtctgcgaaggtcatgcgaggcttcgttgtctggtcgcagataccagcggcgatgttgttgaaccgagcagtcaaatctgcatccttgctgacaattctgttaaacacggttgcacagagggacgccaatgcttcctgcaatttccagtcatcatcttgggtaccttcaaggcctgaaactgccactcgcagtatctcttctcctgtcaacccccaaccaagtgcttctcttagcacctgcaacattacagtgctttcggtcattccgatataaataggatgcatataaaagcagtatcccatcttttggagactactctgatggatattcagtaagcatggatgaaattttaatgatacaagttgtgcttcagttttgctttaaacaagtttgttacccatggattgctgcgaatgtagaggttgccaaactatttaatgagctatggtttcgtgcatctgacaatgtagaggctgccagagttatatttcattatcatgaaaaaaaatgtttgttgacataagaagtataaatgacagcgactaacgtaccttgggtatcaaatcaatgatggcctccttcagattctgaagatgttcctcgtcagtggagtagggactacacagatgattg

SEQ ID NO: 46778 - DNA, 1458 bp, Oryza sativa
gaacccaaccttcttatggttatggggcaacgcgatgaagcgtgcggccttgcacaagcgcttcaatgagtacccaatgtggcttacttttccattcagaaaaacatcgaatatcctgtttcagatattttttgtttggatggatgaattttccggttaaaaggacagataccgacagtggaaagagtaagtacggtttttttgttagggatgaacacaataataaaataagattcagtacatgccatcctgtcaaactaatttcacattaattaatgatcaaatttacttttggcgatcgtgtaaaattaattttgccatgaaagaatgaatgcagagagtagctctttctttttcttttttattaactatttttttttctcttccaaaatttgacatttcaattctagtatggcatctctctgaacatgcctatgtgtctgtctgttgtagaatcatatgatgattaatcttggtgatgaacaattgtcaacggtaagtgttgttgaaaatacggtggatagtattttcgaatggtgaacactgcggtcggcaccgggtgcttgtcagaccgggcaggaggcaccggtcagaccgggcggcccgatggtctgactgagtgattccaagagggagtcggtttcgggttgtttttatggaatttctagattgattcatgtttattatttctagatggtttctattcgtatgtgatactattgtatgctgatgtgagtcaagttagcgtgaacttgtactcagatatggagtttcattgttattcatgtgcaggtgttgcttgaggctatgggagtatagtcggtgatggatcaggactaggctcggaagaagttgaggtccagacggtcaaggatgtcatgcgggatgctcaagctagagaacaatgtacatggaggtgaaggtttccatatggcatacacatcgtgttgtgtgcatatggaaagaggagtcaaatttcgatcggagtccaagtttggaaagactagagtttgtaaagtttgtttcttatacgggaaggactttttgtatgagttggattcgtggctagggacagccatgttatcggtataaatagagagggaggatgttgtctgccggtatcaatggatagagagttgagttgagagataagtttgggtatcaagtctagttcgagattttggtgaggagtgatgttggtgcactttgtaaacactagttgatgcaataaagtcgagatagattaatctacatcttagagttttcatctatcggtgttttctggatctcgacggtcgatggtttgaccgaagtattacgagcggtcaccagcggcaatcaagcagtcagactggcggcggcgagcagtgacaagtagagaggcggtggtcttatcggccagacaacacctgtcagaccagcggcataggagcggtcagatcggtgcgcacatggtgg

SEQ ID NO: 46779 - DNA, 8577 bp, Oryza sativa
ttgaaaaaactaacaagctttatttgtctttttctcttggatttgctttgcatgctctcatgttgttaatgagttgactttgacaaaagaacgttttgaaaaaaaatataaagttgctttttgtgcgtgttctttgttcaatgttttgagtgcataaaggattaaacaacacaaatatgttttggtttctccaaattgctcaaagtgttttttgaatgaaatgagattgaaagatgctttagggcgtgttgagtatatggaggatcttgtaaaagctgatgaggtgctttcttgttctaattgtcacaaagaacaatggtgttttggttgatgatgaaaattgtgaaaatttgacaaaagaagtttcttatttggaaaggttttctgatggtaagaagaaacttaacatgatttggataagtcaaaagtgagtgcttataattgtggtgtaggttttgataccaatgcccattttacaaatcaccgatatgttgtcttgagcataactgaaaaaggtgaagtacaaaacccaaacctaaggagttttgccgtctctttcttcgacgactcaagagaaaaagactttcattgcaaaaccatctacttcaaaaatttcttgtcgtgagagatacacttgttctttttttggaaaagatgaatatttggttggtttttgttttagacttgtccgcaaacagaaaaaggaaagagaaattgcttttgcgaaacgacagtggcaaaaacaaggttgtggattaaggagcttggttagaccgacactaaccaatcggtcatactagttgccaatggcggtcagactgcaggtatatcaatggtcagaccggcgactaggcccgggcagactgcaggtacaactgcgatcagaccgacctcggggcgattttgcgcgtaattcaaatcggatttttgtgaagcgtcaaggtaagttttcaggtatgtttggttccgattttgttcgtgcatatgtacctactggttcagtgttggattccaaatttttttatgactaatgccaacacggaggcctcaacatcttcatgttcataggtattttggcggcatactccccatgattgtttagtgcggagacggtgatttcttttcaaggtaacatcaatgtacttttgagttgacataactttgttctacttcttcgtttataagcttttcatgctagtgtttgaagaggtagttttggtaattcaaatggatatatgttaattcataagaaccttggtgatatcattggcaattagatgtctttttcaaaatctttgatttcttcttgatttttcttcagggagaattggaggtttatttgaggggaagtttgtgctttttcggtgcattcatgtctatatccatgcattgctctaaatctgaaaataaagaaaaaaaatgagaaaaagaagagctttggtatatacctctagtatattcttgtgcatgctagtaaaataattgatgtatatttgttgatatgttagcttgtatgcattttagtcttttcatgtggcttggatattacttttaagtgagatgatgcatgacactaattcttttacttgattaagtaaatatgcaatgttaaagcaagtgctgagtttggatgattaatgcttatatttatacttattggattgttattcctcaaattgcttattgtttattccaaatgtcacaggagaataaaaagttgcttatgatgagagaaaaaaaatgaatacagaatccttggaaacagtattgacgataaagccgtatttacagtaaggaaaataatgggtaccaaatccttagaacattcttaacgacacggacgtactcgaaataaattgagatattttattatcaatgtcaaaatgagcacaaaaagctctaatacttgtggaaaattctcttggttatttttgtgaagaagttattttgagaaagagtgatgatgcaataggtatatatatatatatagggattttttttcaacctatgtacttgtgaatatgttgcattataaatcgtttgaaatcattatctttattattgactagaaaaaatgcccgtgtgttgcaacgggtgaagattattttaatcttattatattatatcgagttaagatgaaattcactgtgtcaaattcgcttggatatatattgtgttagaaaatcatgagctgtaattaggtgtccgaacgtctcaagttagtagtatgtgagtttttaaagagatttcttatacgatttcttctgtatttccaaaagcgaacgaacttaaaaactgactcaaatacggatttgtatttccaaaatcaaacggacttaaaaaccgactcatacgcggatgacgtactaaaatactgacgaaaacatctacaatttttataatagtagagatagaaatataatttaagaggtaaagatatatgtgcgcagtagcttgattgaatatttctctgattaggttttcgtatttctcttggcaaccgtcatcgatcggctgctgttgctgatcgtcttgctgcacgcgtggattttcgatatgtgggtagtaatagatctcggctttgatatcgatcctgatcttttctttaatctttttggaacacgtatacacagtagacaatattggattgagtttctgatgaacacagtaggaattcttctcgatacggtgtgtgcgtgtagagaataatcaacaatggtacgtcgtgctgcttgcctcggcgcacggcaacacacctgactgctgctggttggtgttgatataggtgcacgacagcaggtcccaaaccgtgttgccgaacagaccgtatcagcaagatgacaacctcgcggtggtggttggttcgtgacaatgcacaggatgaaacgcaatcggccaaaggcactgatccgaacaagcaaattttcttatggaaaatctaatgtttaaagctcatacatgtggggcacataaataattaaattggcagtaattatgtgcgaggctaattcggacatgacgacttaccaagccaccggcaaaaacatcttcaatttttataatagtagagatttgagcttaattgtaatacctttgattcatgtttatactctaatgcatgcttgttaactagttgatgaatttatctcatttgtcttgcaacatatgaccatgaattgcattgctttaggtacacttcaaagctctcaaaaaaatttcagaaaattaaaataaaaattaaaaaagaagtgattattacatgtcacaatcatgaaatcatgacatttgtgctttattggttatattctcttttaaaattcttgatgaaattattatcaaatggggagagaaatatacaaaatacatgcttcttgaaaaggggagaaaataattcgattttaaaaatagttgattttgcaaatatgggacttgaatattttcatatcaatgtagtatataaagccactctggaattgcaacgttttgcagcatattcggttcgcaacactagatctgacagtaaactagtagctagctagcaatgcgaaactccaaatgcttggctgaactggttaatgttgggaacgcgaaataaatataagtctggtggagatggctatagatagctcaccttgtttgaacgagcgtgatcaccgtgagactccagaagtccttgttggatagcatggagacgaatccaccgaggaggatgacggtggaccacgtgagcaccaggaaccccgtcccggtgacaaccatcgacaggtaccccatgaacaccgcatagtcattgatcaacaagacctctggccaatccgaatcaatgtgtaatccaaggcgatgaccacggctctgtccggcgccggacatcgatccttcctccgctaaacacctgatcaagtcgagtttgatatatacatggtaaaatatttcaggtccagccgtcttagatgatactggctctcactgcatttgcatgctcagtgtgcgccaggcaccaagaaaccggtaggtaataaactctaaactgtactaaacactaaaatcacatcaactcccaggtggtatccaagtaaagttccacgccagtttaaccccaaaatccacaaactacgagcattaaggcctatgtatcgactcccagagtcacaaccaagggtgtgtttagttcacgctaaaattagaagtttgattgaaattggaacgatgtgacggaaaattaagttgaaagtttgtgtgtgtagaaaagttttgatgtgatggaaaagttgaaagtttgaagaaaaaattaggaattaaacctggcccaagacaagaaagacgaaattttaagggatgatcacaagcagtatctgcagtcccttaattacctgcttagccgcttgccgaacccggccggccagccagccgccgcctggccatgctgatacctcgctgcggcgcacgtgcgccctccggactccgctgacccgctgcttgctggagtgctactagttggcagctcgtctactgaggcaagcaagggagcgcttagctggggacgactggggtggtggtgggtgggctgtacgtttcaatattaaaccatcggagagctagaaccatcctctttctgctgaagtgtactgttagttgatagtcatatgctccacaagttctctgctgaccatctagcaatcactactagcaaaagagtttttcgctggtggcactgtcagccgcccgcaaacaaatggcaagtgaaaataacaatcttcactagcgaaactttaaagcttgttttcacaagcggttaagttacgttgaccgccagcgaaaaagatattcgagcgaaaaaaagaaaattgaaaatccgtttcccgaccaccaagaaaaattgattttggagaaaaaaaaacatgccggatcgatacccgagctccgccgccggatgcgtcggccacgccccaccaccccgagccactggatatgagagaggggaggagagtggaggagccgcccagagcctatccatcgttgcagcagccgctgctgtcgtcgtccttgaactggttgacgagaaccaccgccatcggatccgtcctctccaccatcactgctaccgatctcgccgccgccgccgccgtagcctccaccgctccccgcgcaccagatctgagagagggagaggggtgggtggtggcggtggaggaaggggaggaggaggatcgggggagagagagctgggactaggaggcggcggatccaccgccggatggagtcgccgctgctcctcccataccaaatcgtgccctccccgccgggctcaaccgagccgctgtcttcccgctgccaccaccggtgggaagggaggcggtggtggctggagaagatgaggtctagagatgaagatgaggatgaggaggagggaaagcagtggtggcaaggtggcacggtaggtggtggtttttattgtgttcaattattttttagtgcgatgatgatttttttttcttttttttttctggtggacctcttagcagccgacatcgaaaattggtttttgctcacggcctcttaagaagtccgcttgtaaacaatggattttcgctggtagcttcttaagaggttcgcttataaaaatattactatttgctggcttattaagaggccgttcgctggaggttcgtgactttgaatctttccattcaattttacaagcggtgttttgtcatggccgccggtaaaaataaaagggtgatgtcataaaaaatcattttttacagtgaattaaccattctatggagaggccacaaaagcgatgcaggcaagtggggatgtgatcatcaggaaaaaacatctggtgtatacggaactggtgtatacggaacaggatgcaaaccccagtccacacggttcacgaatcacgatcccgacaccattgctctagagtggtatctacggataaatcttgtctaactttttttacaaaactagaaaggtggtagcccgcgcatatgcgcaggcatctttttatttgatgttgcttgaaattttattttggatgttttatatgtgggttactttttcttgaaattctttgactctcttctaaatttgtttttgtcaataattagtttggggttgctttgaacattgtaagtatattggttatgatactctttgatctacccttgcaacatatgaattctaaactaatattacttggaaccatgcaatcttaaatttatgagaaaatattgtgtcgcaataatagagttgattactattagactatcattttgtactatgtgtatatcttttttgaatattagcatatcttattttttaaaaactttcggtcacaaaatttcttttatactatagatgtatttatagattttaggatatatttaaatatatattctacttacatttacttctgcgcctttctttttttcacatcacatctcttttttgaaaaaaaaaagagatctgaaataagtaggtgtggatcatttgtaaatggtccgtcaccacggactaattaaagtataattttgtttggttaattcttatttttatatcgtatattttcattgcatgaattctgatatataagcttagtatgatttgtattccctaattaaccaaacttagtatgaaacacccatatcacaaattttacaaaatttgtgtggcatggttcaaattgtccctttttaataggaattaaagagaaaaaaatcgcatgccctatactccgaatacttttggttattcccatactatcctaaccgctgaataaaatggaccccaaattttatgcatcttcaaatgatgatataatccatatcactaatttttcatgatttttaataattctcgatttccatgcaaagcgccaatatgacttgttatttttgggcattgtagatttaatttaatggtgcatacctatgaaccaataatggatatatagtgatatactatattactgttatcttattcaaaattctcaataacgtttgtaacatacctgcatacatttacgtatagatcccgggtggagatgggtttgcgaggtaatggttgtaaataatagatccattttacttttatcattgtagagttaatttaattattgtgaagttatatgtaagatgataaaatctatatcattatttgtttataatctttataacagtttaaatactatgcaaaagtcagaaaatataataaaaaatggcatatttcttttccaagtgaatatggatatttaacactaaatttaaaaagttacatgtatgatttagatgttatagttgtttaattttgtaacacaaattttctaacttaatatagcttgaaaatagaagaaaaagatgatgaagggattgagggagaggggagtacgcacattacgtatgtacatccatccacgtacaaggactcgaatttgctatatatttgtcgacaaattttcctccaaaaatttatcagatgtaattacagtataatcatagtgtaattacactgtaacttgcatgtaattacactgtaactataatgtaacttgtacgtaactttcaagaatctctcggtaacatgttatttcagtaaaatagaggtcgtgggaacaaatccttttacatatgtgtgtgctgtgatttttttcttcttcaccagaacaaattttgtaatagatctaacgattcaaaattacgtgaaacttaaatacaagttacaccgtagttacatgcaagttacagtgtaattacatacaagttacagtgtaattacactatgattgtattataattatatatgtcaaatttttagtagaaaatttgtcgacaaatgtataggtagtcccacaaggacttagtggagcctggttttagcggtggatttttctcgaagatagatataatagttttaaataatgagtccaccggatttgatgaattttgtattaactagaatgctatgtggcggcttagaagcgtccgtagaaggacacatgccggcttaagagcgtttttaggaagtttaatggacttttagtatgtaatagattagggtttttttttcacttgaaaaaagtgccatttgtgttttcaaccaggtacagtttccaccgggataataaaccttgcagtccttgcagcccgaaaaggttagggttaagtctattttgcttccctcaattcatgctatgtgatgttgatgtgtcattaaataaaaataaaaaactaaataggacccacatgtaagtgagaaaataataaaaataaataacgggtccacatgtcaggcacccctttctcccctttacccattctctatctttacccttttctctctccctggtctccgtttcttctccacatgtgacaggttgacagaggctcgcgagggagcgccggtgcagcgactggtagtggacggtagcagcggcaggacggagctcggatgagcagtcccaaaaccggaatcaatcagagaccgtggagatgacgcatgagcaggagcctatttttccatatgaagagtcaacagagatgatggggtgatggaatgcgtcggtccatggtt

SEQ ID NO: 46780 - DNA, 5560 bp, Oryza sativa
tgtcacactccgattttctttcatggattaaaatcaattaataattcatttctagaatatgtactattatattataaaatttgaacatgttttaatggtacgtcattcgtatttaagatggtttttatgttcgttctcttttggaaatacagatccatgtttgagtcggtttttaagttctttcgcttttaaaaatacagcaagatttgtataagaaatctctttaaaaaaactcgcatgctaacttaagacgataggacttctaattgcagctcctgattttgtaaaaaaaatatccaagcgaattctgacagtgaattttatcatagctaaaccgtataacaataataatattaaaatagccttcacccgctgtatcacacgagcgttttttcttatatattaaaatataaggatttatgaagtgaattaatgtgggaaataaagtttcctttaaaaaatcatggctaaggaatatttttataatattctccataccctaaaatactatctggaatgttcttgaatttctagagctcaatatctgattttaataatagaaagttcatttcatcaacaacttacatacaaaaaccaattcaaagtctactctttgtccttggaccgtttccaaaccaactgtggtttccctccccctcctttccacgtgcggtctcggcccgcttctccatttttctctctgtctagcccagccttctccgcaagtccgttttacctccccatccaccggcccacctcgccccactctcccctctctccactggtggagaaaccatctttgctcggtcggccaaaatccataatagtcccggttgcaataaaaaccgggactaaagatagtttagagctgctttttaatctttagtcccggtagtcccggttggtgtatttctagtcccggttggtaacaccaaccggaaaaaaagatgcctactatctttagtcccggttcgtgttaccaatcaagactaaagatctatttttagttccggttggtaataccaaccggaacaaaagatcgtggcggagagtacgaggcatatgccatctgcgagattgagaaggaggaggagatgggcagccttatctcttcacctcttcctccactgaccttatctcttcatcccatctcttcctcttcctcctcctctcctctaactcctctccttccctcccccttcatcccttcctcttcctcctctctaacttctctcctctaactcctctccttccctccccatcatccccactgatagatcgggcggctggctgcctcgcggcggcgcgccggcgggcggaggccagggcggcctcgcggcgggacggaggcctgggcggaggcctcgcggcctcgcggcggcaaggcggcagaccacgggacctcgtggcagacggcgcggcgagcggcgcgccggtgggcggcgcggcagcggctgcggcagcctgtgtttttatttcttttttctttaagaatttgtgattcggatctgtgtatttgatttgtgtgtgatgtccgtgaatatgtgatgtatttgtgatgaatttgtagaagttgtgatgtaattttgttttaagattttgtgatctatttgactatggccgatttggggatttgaggatttggggataatttatttgggattttgggatggggatggagtgaaatcaatatattaaaaacacaatgaagaaaagaaaaaaataatagagcaaccggatctagctaggctagctgtatctttagtcccggttggtgacatcaaccaggactaaaaatggatttttactcccggttatttcacccgggacaaaagatagtgatctttagtcccggattcatagtcccggttggatagccgggactaagggggactacgaaccgggatgaaagatgctttctccaccagtggccctctcctctctcccctacaactgggaccaagaggccgacatctcataatcatctcctttcctctgaccaaatgagttagcaaccgttccccccatgacgacatcgttcccgtgcctctcctttcccgctcttacattcaaactcaagagggcgttgtcgccacctgcgtcctccacctctttcccaactctcccctgcaaatcgcacggcgtaaagccgcatctcgctccacgatgccccctcctcctccaccggctaccgcctttccccagccttgaatctgcctcccgagcctgtaaatggcacccccgtgccttttcctctccttttcccctcctgtagagctcaattggaccccaaactgttagaatttgttattgtttccttcttgtatttactttggtgtcctcctattctcccaactttggttctataagtcggttcgagacatagaaggcctagcaacctatatatgtactcgtgctatctggcaactgattattgcattgagtttattcatgcttacatagtatcagattaatctcgctttcgcgaaattctctaaaccggtgtgatggtcgctatagaccaatttcgaccatcaatataactaaaataaaggagaactagatatgcttgcaatgcatatttgttttagaataatataattccacttgtacttggagtattatttgtttgctgatattagcacataaatagaaaataaatgaggaaaactcactcctaagcaagcttaagcataagaaaggcccacatgtcaggtttaacctccgatcttggaaaccgccataactgtcacaactgtcataaggaccaacctgtcagtgaccctgccaaatctggaggcctgctaagccggctaggttcagcctggtggcgtcggattaggctagccttacacgtggatgctccagatcgcttgctgatggcggttacagagcattttggacaattcgcatcagttacaaccatcataccggcctatttaaggaggagctcatttcactcaacttaagcaagacttgatatctctctctcaactttagtttagtgctctaatgctatgtgcagtagaatagaatagttttcgcagtcctcaagtcttcagaggagtttgggtatggctctagtagttttcctttcctctttagtaagacgttcggaattaacagaatattcttctttatatactttcgatacttaactttgtttgagtatcagttttactttatatctatgtcgttataattgtgtggctagcttaccagagaagtgtagtgttggtatttcttaacgacattactagaaatagtcattccagcaatggcgccagaaatggtcctggtatatttatggttacagaattaatccgcaagcgcatagatataccattgtagtatttcacccgaaagtattccaaggtatcacatttttaatcccaagggaagagaataagagtgaactttactaatgcactttatacatatattacttataattgtcagagcctaagcaggggttaaatataatgtaatggtagagtgacacgaagcaaagctatccaatcctcgtaacaaaataattctaactaagtggaagaagaaatagaaagcactcaattcctatacttctagtatacactcaaattctaatttacatctgctaatgtacaatcgtgtggccaataccccctaacagtgtcctcctagtacttcgagagatcaccttgggttgccgagtttcttacgacaacttgtcatggccgtccaaccggggctaaatacggaggagtaccctccccaagaatttgtcttaggaatatatactaacgtggaggaatacccgtactgagctgtcaccatcagcggcccacctctattatcccgcagcatatatgcccaattaatgatacttaataatctaagcaccacgcttacattactaaatactactctatacccgcatgcttgacatagagtaacggataaatcagaccttaaacccgcaccattacacctctctgttaggctacccacacaattaacacaatgcagatataaagtaagaccaatactcaaactaagtaaagtaccaaagatatataaagaagagtaattcattaattaggaaagtattacaaaagagattacaagagctgctagagccataccgaaaactcttccgaagactccgaggacttccaaacactattctattctactccacttagcactatactactaatactaaagtatgaagaggaatttagcttgcttgagtgtgttgagagagtgaatgagctcctccttttatagggctggtatgacggttgtagctatgcgtaatgtccattttaccctcacaaccgtcattgagagtgcatcctggacgtccacgtggagggccagccggagctgaagccaccagggttcggccgaacccctggttaggccgaacctgggctggcccagcaggcctccagccacggcaggtcctgacaagtggggtcccttaggcggttgtggcagttaaaagtcagtttctgatggttgcttctgacatgtgggcccatcttatccatttgcttgcttaggagtgagttttctccactttctctttattttatttgataaattcctgcaacatgttattctccaagtacaagtggaaatatattatttgaaaataaacatgcattgtaagcatagctagttctccattattttagttatattaacggtcgaaatttgtcggtaacgaccgtcaacatgcagtagtgtgggtttaatgtccgagtattcggttactctatgtcatccatggggatatagagtagtatttaataatgtcggtgtggtacttagattattaaatatcattatctgggcatatatgttgcgggacagtagaggtggactgctgatggtgatagctcagtacgggtattcctctacgttagtatatattcctaagataatttcctaggaagggtactccttcgtttttagcgctagttggatggcaatgacaggttgtcataagaaactcggtaacccggggtggtctctcaaaacacgaggagggcatagggggtattggccgcacagttgtatattagcagatgtaaattaactagaattgagtgtatattagtagtataggaattgattgcttttctacttcttccacatagctctaggattaattaatgagagaatcaaagttcttctgctttgtatcactctacccatacacttgaattaacccctgcttagactttgattatacaagtgatgtatataaattgttagcatggttctctcttataaatcttcccttgggattaaataaatacgataccttagaatacttccgggtgaaatgctacaatggtatatccatgcacttgcggattacttctataaccataaatatacaaggattatttctgtgtcattattgggaatttatatttccagtaatgtcgttaagaaataccaacaaccagcgcctctcacatgcgcccctcggcgcttctctcgtgccaccatcaccatgacagtgccctcactctcgttgacctcggccgacgctctcgacgctacg

SEQ ID NO: 46781 - DNA, 16061 bp, Oryza sativa
gtcagactgcaagccatggatgactctagtcgacacttctaccaagttgtcctctaccaatggtgtcgtgattgctgatcctattgactttcgcagtctagcgggtgctctacaatctcttacattaactcggccagatatcgcatacgatgtctagcaggtctgtctccacatgcatgaccctcgcgaaccacacctttctgctcataagaggattctccgtcatgttcgaggcacactagactatgggcattgcatccaacattattctttcgctgaccagattgcctactctgatgcagactgggccggctgtccaaacaccataagtcaacctctagctatgctgtctttcttggcaacaaccttatctcttggtcctctaagcatcagaacaccgtgttccgttccagtgctgaggtagaatataggatggttgttggtatttattaacgccatagatagaatccacaagcgcacgaatataccgatgtagcacttcacctgggagtattccaaggtatcgattccacgaggaatgtgtgtgctaagctcttctccaggttcatccaagaacataaagcaatgataggcaaaagggtagagaggatttcctagtgagaaacagtgtctacagaaagcttaatttaatcctatagcaatacttcaggcattggcttgctcacttctaacagaacgcgctctactccgtacccagacagagaggactgcagtgctcttgagtgttgtcactacctctacaccaacctttaacgaattgtgggatacacaacaatcactggaaattaactacctagacactaaagtaattaattactactttagcgttagataaacattaaagtaatcattatctattaatgaacaatagtgaacaatgatccagtatgctaataggaactaactaagatataattctcacaaagtaaatcttaattactcggaaagatatttctattaaattagagtaattaacaaggtacaaaaagtaagaggagattaccgacaactccgaaattcctccgatttcttctaccttacaataaagtagaatagagcctcatgtaattcagctcatgcttcgtgtgttatgaatgagggaggagagggatatttataggccaagtgccttgggagtgtggagatgctcaaggcatccaatgagcatattcccccttgcttcacttccttgtgccaagtgtcctatgacggtttcttcaggttgaaattgtcacaactgccttgggatgtcgataactaccggcgtgtgaagtttctaggccagatgggctagccctggtttggccgaaccctggttagcctccctggcctaggcctttctcctggtcactgacacatgggtcccctttagtatttctctggagttacccatttaattatgatcttattgggtttgtaggctaagactccattgacttggatatggaagtattatttccctccttcatgtatatttcctctcaactttagtagtttgtcatctgcatccaaatacacatcaacacttgtggaaagtgttagaaataaaccctatcactatgttggatattttatactctcagttttatgcagatattgacggcgtaaatttggtatttagcagtcgtcaacagcggtcgcaaatgctgttgctgaaaccagtcggcttcgtcaactaagtcaactctgttctccccctactaaggctactctggtttactatgataatgtcaacgcgatctatctctcaattaatctggttcggcatcaacaaactaagcatgtcaagactaatctccacttcgttcgtgagcgggtggcagttggtgcagactgtgttctgcatgtccccacatcgtcacatatgccgatatcttcaccaaggcctaccttcgtccgtctttacaaagtttttaatgcttcaatccacaatttaattgacagagtagaatgacctagcatactgagaacaatgtgaggtgcaggtgtgccctgtgtgcacacctgcacagagcggcggacggagactcgatctggattagagtttggagatggaataatggatgggaggaaggggaagcgatacttttctgtttgactagtaatcgtgcacgtgcaatgcacgttctttccatcataacttgctttcatgcaactttacaattatatcatcatgatcccttaaaaatattggtggtctatcttgagaagataaagtagcacttcaatgtgtaaataaaccgaccgtaatacattgaaatccatgtagctaagaaataaatctataaagaggaatgatacaagcttcgtttccatttccatacaaacagaaagaacaaacaaccagtacgtgcacaaagtaatccacgtagaaatacacacacttacaatggagtctaatttgaagatggtgtatattataaatccgtacacatttcttatatctccaaactgaagttgaatcatccaccatgaacacctagaatcgataaataagttcacacccttcaattagcaaaatctatgctctggtgggcaacaattgttaacattcattctacaaagcttgataattgaatcaaaatccaatccaagagaacgcaaccatttcgtgatatgtcttatagatttaacagataacagataaatggaatgattatatgttcagttaatacaataacaagaagcacccatgatggtgaacactgcagagaacggcaccattttatcatagtactgaattacagtatagacaaatgtgtagcatttggcagcagcagggtccttgtgtagccatgatctttgacaaccaaattgacttccatacaattagtgcagacaactaaggcactgccatgttattgaactgcttgcgaagcattgcttaaaatattattgtggccccaattttccatactaaataaaaattagtgcatatgaggaacaaaacagaaaaagatgaaggtacaaagtggctgttagtaataatgtgagaatacacataagaaaagatatatgatgcccaagtgtggtgcttaattatgtaagaacttgatagccccaggaaataacaataattggaccacatcggaagcacctcagcaaatccacaatggaatcagtcctgccgaatcagtcatccaaaacaaattcctaatacatgaataaaggaaaggtcacaagattcagccgagaaaaatagtacatattcgataatacaaataacaagtcatatcatctacaatcagaccagcaaacctgtaaaggcacattaactctcatgctcacatatttgcttcccatttggcaatgaaactgatcatctgcatagtcaagagaaagagaacatatcaatagttagtgtgcgcatgcaaggcacatgtcatgtatatcgatgggagaaaatactcttattttcataaatactaaaatctgtttcacatgccaattgatattgaaatctgtttcttttttctctgcagtgtgccccttgtgccagtatgaagtatgagcacctgcacctatacagctccagcaaacatgtggcctcgtttttattgacggaagagtagaaaagaaatataataccattgaagattgatttatcgcaaggagcaaggtaatctggagatggcagatcacaacaaaaaataattaatcttaccagctgtgaccaaagtacagttctagactacctttacttagtagtagcaatcatagagatcgagattagagagagatagagagagatgcggccctacctttaccaggagcgtgatgccctccacgcccacatccgcggcacagatcgtcccctcctgctccacggtcactggcatgcgcctcaggttcgtgatgccgcacatcatcatcatcagtaagaacgctgaaaagttttttccagattagactacactatctgaaataaagaggagactttttttaaggtcaagaggagatggtttgaaagcaaaaaaaaaaaattcccatattttttttccaaaatctcggtgcccttaccttagtcaaatccttttaaaatgaaaaaagattggagcagtgataaaaacaactggagcctggttgatatcttgacaattggataaatgaatgctcacaagaagaatataattctgcaatataatcataaagaaaacaatatgctgaaagtacatgtggcgaaccgtcaagataaattaatgactgaacacgtaccgatcggtgaaaaaggactgaaaacacttaataacagtaccaatagcaccttttcgcccacaaattcttcttcagttcaatttgtcatcaactcagtcctaacaagcaaacaacaaaccaataagataaccggggagcctagggaagaaaacaagattagatatattcaaaatctgaggcaattgcaagattacatagaaagcatatcaattaggtacgggaagggaaaagaaccgcatctgcctccattaccgagtcaaatcttcattgtcatctgacattactgcacctgtgctagcattgcgaacagttgagagttcaactcatgattaattcttgaaagctttgttaattaaactgaattgggtaaaatggctagagttttatagggtaattaaacataccacaaaagcaaaaaagagatatggaatcaagatatagttctgtctcatggtaagttttataggggagtttatagcgctgaacagatgacaatgaaggattctcaattcacacacaatcatctcctagtagttgtaaacaaaatcacaattgttaggcaatcatccaggtcttgaagagcctcatcaatagtctttgttcaaccaaaagatagtttgctgaataatgctagagagtatgtacccatataaaataagctttgtgaatatgtgaattggtgactgatttaatagcgtctggaacaacctccttgatcttctctgtatgaaaaccaaccaacatgtatcaacaccaactggataaactatgtacaatattttcttaagtcctccactgtaaggagattaaatgaacaaagcctaaggagatagataaacccatgaacaatcaaatatgaggcaacggttaggaataaatagaaacagtattggttgagtggtattcagtcgaacacttctggggcaaaacggttatttatgcaaccaaaaaagaactccacgataatctgaaacaaatagactgcagtgattcataaagaggatcgaatgcaattggttggtacttggtacctgcatgagattgcagaatccgtctgatgaacagagcatcaagggtcgttgtggtcgtggcgggtaaagttggaggtgctgtactgggagaagccgcggtggaggacaacgtcggagctggtggcgacggaaagtccgctccggccgcggcggcggacctcggcagcggcggcggcggatggggccgaggtcggaaccggacacggcggctctggcggcggggaagaagcagcggctccggcggcggggatgcagcggcagtccacgcggggaagaagcaccggctccggcggcggcgaagaatcagaggctccggcggcggcagtccacgcggggaggatgaagtcttcacccgtggagcgatgtcttcgcgggtagaggaagaggagtgaagtattcggcgtggatggatggatcaaacgagcgaggagcaacgaagtctgcgcgaggaggaggagcgaagtctacgcggggatggagagtagtattcgcggcagtactcaatcgtgtggtggtgagatcgtgcgcgcggatggacggcaaagattactccgaatgatttcaccagtacgattggaggggggcaacttctcctttttatattagtatagatttctctcgattgatttttctattgacgatgcatggtgactaatgtacttgggccatcatgggactttctctatcggccatggttgtcctacgaatttatctctgtgtaagctcgttaagacttgcaagcagctcgtaaacccgcttgaactggctcgttatgcctaacgagctgaaacgacgtctcggctcgtttcaaaacataatgagccgagctggtcacaagcctcgagcttttcgtccagccctagttgcgtcgttctgctactccgttctactgaggttcattaggcatgggtaacaatcccatattgctggagatataaggcaaatggactagaaatttgcccaagtggagcaagcttccctagtattcatcaccacgatttgatctcacgagtttaagtttagcattatgctgattttccactttggccttaaatttctcaagagatttagaacaaccattaatgggataaatatagccaaaacgggaataatcatttgtgaatgtaatgaatgagtcaaagccatccagaaatgtcattgggaacagtccacaaatattgatctgaattatttctagtggcccctttcttaattgtcttagtgaaatttcccttaatgcaatctacgtaatgatctacttcagaaaaatctgaaggaaggagtatttattctttaatgagacattcaattctttctctagaaatgtggcccaaacgatagtgccataattttgatgacatctcagctttatcattatatgcatttataacattcatcacaaaatcatccaaagagagcaaatagagtttgtctcgcacgaaggcaagacccacaactttattattaaacttaaacatgttccttttgtaaaatgacagtcataacctgtctctactaagactcttaaccgaaataagatttctcttaatagatggagcaaataagacattatttaaaattaaattacagccgctagggagtctatgtgtgaggtctccaacagccctcacttcaatctcggctctatcaactactctaggctatgaacttttcacctatttcacaaagttttgatgtgttttatgttgactatttgttacaccaaattgagaggcgttatataaacaaaagtgttttagattcttgataactggagtaatttaattttaaattatttggagctagaatatattatatgaaatttatgacttatagtttgtaatttagtagtacttactctacaatgttaaagtttagagatgatctttatattaaaggttccatattttattttaaaacgtgaaacaatacgcttctgtgaatctagcaggacttggttcactctattttgagctaagatgagtttcctatgaattttagaagttggattatgtgtgtgttgattattttgctattcatatttttagtgatgtttcaggtacagccgtacaggaggtgcaaaattttatcttactaaattaaagtccacatcttgctgaacctacagaaatttggttcatctcaaaacaatttatatttgattttatacggattttacaatttaacatattttctaattcaataggaaaacttgttaatatttccattttatttaaaagatttcaaactggcgactttgcatgaagaaccctagtttttatggaaaccaacacgcagtcctgtgactgttcaatggtgtgggatatttacagataggatcctagattttatctaatttccagagaaagtccctgtgttcctcccagagcagggcagcatggccgacggccatgcctggtctcggcggcggcgaacggtggggattcgagctacgcgaccaaaagaagaaatgtataggggtcctctgcgaactcgaagatgatccaatcacgggctatggtgaccggatttgatagcagtggcggcgcgagcggcggcaacactcgggtgatggtgcatgtggagctagagctcgtttatggctaaaagggcacatgaatgtgtgtttacaggggtcttggagactcattcgatgtcccgcgtggcccagcgaagcttggatgacggcggcagcggcttcggactccggaaaatgctcgatccagccatcaatctgccatgcgtgcatgcgcagggtgttagataggtgctagggatgctccatgcgcgaggaatcggactgggactgaccagagtggacgaatttggagacggtggtcataggccggagttggagaagaaaagctcgatccctctactcggtgcacgaatcttcaggaatatggagggtttttggagaggacctctaggggaagcctatggcgcggtggctcgccccggcttgctccagatcgacggcgacggacatgatgtcttggcggcggctctcagagcgtgctccaggacgaccgagagcgcggcggtgttcccagcgattggctgcacaaattggaccgcggttaaaaggaatggaatcggcatggaagtgggatgacggaacgcataagacatggagaccgccgtcatctttgcggccgacggcgggaagggtgtggtcgacggcgatctggggctgctctctcggtttcttctactccatgggatgggagggaagaggacggagagtacatgcaaaaaggcgaggtttttgctcggtggaggagacctggggctcggccggccgtcgcccgtcgacgcgtggggacgcgcgtgtcgcgcgttcctgaatgtggggtgacctggcacattctgtgacacttacaggtgggtcccacatagacctggggcccactggcagcgagagaggaggacatctcttggaaaaacttcaactctattagctgcagtactgttccaactttgactcgaacttttcttgtattggtgtggtttaaatggtggtggcctactgggaagtggtacagggatgtttgttgcagaggttggacaaggtttcaggccaaattgaattatggttaaattttaagagagttgcaaagtaggttaactgaaatctgtaatttccagattttgctgctttagatgatttattatttgaggtatcaaagtgagtgataaaaaataagtaaaaattacatttgtcgatgtttgaggtcgcgattccggtatttgcatagtatgaggatcgttggtactaggatatatgcgagattgtagtaaaaaagatggggacgaagatttttatacaggttcgggcccctgaattgtcaggtaataaccctactcctgttggccaaagccggtagttgctcttattcaccataaccacaccagtacaatatttggggtagcctatctatctgttgtcgacatggcgatttgaagtgctgacacgtagttgacaacagagtagtcttcctcctcaaatccgcatccggcgagatcaaagacagcgctatgtctctcctgacagtatccgtagacaccgtagggactagccatgcttatctctgaagtcgatatccggcgtcttgtcttggcgcatgttggcttgtatgttgatcttgtatcttgatctattgttccgtgtcccctcttctcctaggggccttgtatttatacccataggtgttctcttgtccaagtagaactaggaaaaccaatatggatataatccgagtagtccttatcgtatccatatagaactctatttatctttccttatccagaactcttatccggaactccttctatatacccgaaggttgtttccgtataaaacatggtatgtggtgggtcctgctaagatttagtcaactactgttaggtatgtagtatccataaccttgacaacattgggttttacttattggatagtacttttggtgaaatttttcatgattttatattgctccgattagatttagaaatgcaccaaggctatcttgtttatgtgttactattatagaaatgcagctaagtgtttataaaaattgtatttggattattctctaactgatgtgatattgttaggcttgattttcattccaccgtccacaatctcatgtgatatttgtaaatttatttatttatatatttggaattaagttaagtgaagactatggtgagagtttaatataagggtgctaatatatacttattaacttttgtgaccatgacctatgttcagatgagagacaaaactaacttaatgaagtttgtcattggtaatgttgtaatattttggttgtaggaattttagggaatgcttcccattcttgacattaggtgttccttaacttagttattgctcctagatttgagtgatgcacatcagacctattatgaagtgcatttaaaattcaaaaacacaaaaaagactcaagtcacactaaaacattatgcacatgcaattatacactatgtttcatttttatttccggttagtaagggaaaagttttaaattgttacaaaattctcatatgtgcactagttaaattagccttgtctaggtgagtcaaaattttaagatttttatttatgaaaagaattttcaccaattttagatgcataatttggaattcaaatattttgggtatattacatatataaatgcatcattaggaaaatttgtatcattcacaagtagtccaaaacttatttggagatggacagaaagaatgtggacccaatttacttggagatgaagcattgccacattctatgtacgtatatatttttgttcttagggggacccttcccacgcagagtagtcaagagatacaacactcgttgggattttcatcgttagaacgcatagcgttctccggcggatagtacggcggctgcctctgcattgcttcttggatgaggtcactgaaggtcttgagaggctccgctgccaggtcgcacatacgggccgtaatgtcttcaaaccgatcggccaaatctgcatctgtgttgaccattctattatacacggtcgcacaaagggatgccaatgcttcctgcaatctcccgtcattgtcttgggtagctgcaaggcctgaacctgccggtgcagtataacttggcactctttgtatatgtgtttctgtcaatccccaaccaagtacttctcttagtacctgcgacattaactaagaagttagcaatacttttagacactctgtttggcataaaaaagatcagaagttgtatggtgtttgcattctaaaaatagtaaaaatccaactatatatccacaatgaaaggtacaatgtaaaatcaatagttatagtatatttcattatcataaaaaagatgtttattgatataggtagtaaatgtcagagattgcataccttgggcaacaaatcaatcatggcctccttcagattctgaaaatgttcatcatcgatggaatagttaccatataggtgtttcaggacatctgctgcaattttcctgtggatgctgttgtacaagcctgaatcagttttaccgatacaatcaatcatattaggaccatatttctccaatatgatggtggcacagcttccaaatccgaaagatagctgcgccagctcttcacctgccagattttcaaactgggagcccttactcttgtgaagaaacatgtcgatcagggagccaatgaatctttctttgttctggtcacccataaccgaagatgtatcccagcatatttgtgcgagaacccttatagcttgtttcttgacctcttcgtcacatttgtcacagtcgataatactctccaaggagctgattgcttccaagcttgtcgatatttcgcgccatagaatgttgtttgatcttgtagtcgcagacatgaaccgttttataagtttcaccccagggtctactatatcgcgggaccatttgtcatgtttccggaggtgtagttctttgtcgtttataagtgctactatcttccagaccagatcatccgtgttgctcatgatcctcaggttgttctcgtcgtcggagagctttagaaggatttgaatgcctctaacctgcatctgtccctcttcaccgacagaaatacggtggccatactcctcaagtggctcatctggctgatgaaatggcttgagatcaagcaacgaagatatgcactggatcccttgcaggatcttgtccaagcggatgtcgattacaaagtgttccacaatcctcgcggcgcgcaacctgatctcttcgtcatatgggcttttggaatccagcatctgtaccaagttgtggagtatggagccggaggacgctgatccaattgtattggatatcagcatactttgtcctggaaatccgctcccaattgcacccgagttaaatcggatgagtgtatcaagaatccttactccagataggtacctataagataatagggagattttataaagagtaattttacgatccctgaaaggtaaaaaaagaaatgcaaattttgatatcaccttgtaaaagaggtactaaattttacattaaaaatttgatatctctcggaaactcctaaaggaccgtaaaattacttttttataaagagtattgctatgcacataaagtttcagtcatctaaaattatacattcctaagcctaaaattgtagagatatagaatgcgcaatttcacttctttttaacttgttatatattgtttttaccctgtttttatcttagtttggataattttgcatggaattttataaacagtcaatttatttaattcctttcatataaggaacaaagggagaggtacgagaaccactggatcagcatctaagggatgaaaaaaaagtgactgaaatttatggaaaggtacctgttaggtgatgtggactccatcagctgtgcggcgtacgtgatcatgttccgaccaccggcaaaggacgggtccttctcgcatcccaccttgatctcgtgcaagtaatccaagaccgatccacgtgacgcctcgtcgaacccgtatgcatcggccacatttcttaccagcttgttttcctcgtaagcagagatggtcctgtaatagaagagcacaccctgaaacaaagccagggaatagagaaccaccagcgccggccgcaggttcgccttgctactatctccggagtccggccgtctcaccgtaatcctgaaagattagacgccacagcgaaatccagggagaaacgaacagcccaaacatgtatagcaggaacagtgggcatagcacgatggtgaacaccagcacccgaacggcacccctgaacccgagctctgtgcgggtatggggcaacgcgatgaagactgaagcctcccatagccgcttgaatgaatacccaataaggcgtatatttccattcagaaaaacatcgaatatcctgtggtatacactataagtttcagttttttttatttgaaaggataaatgttgcatttaaaaagattgagagaggagatagtggaaatagtattgtttgttgtcaacaattcgtaaaccaacaatgcttttagtataaatggagcctaacattctgacgtgttagccctagataagtcactaccacaagatttttggagagactagccaacggatcctgtcgaaggatgggatcaccatccattcttaccagttttctcttctttcgtatctcgcgctccatcctcctcccatctatcgacctccacctccacctcccactctatctctctctctgtgtgtgactgctcccttcattcctaccggaacaggggtgggcactgggcacacgccccttggtgagcaccagcacctgtgccgctgtgcgtggtacgccttggctttgaaggctcaaggcatttcttctggcggttgagttgtctgcgacaagccacttcgagaaggatgaggtggtatccgtgatctctatgttgcgtgttgcgctaccggtggtggctattgggctctcacacgcaggggcgggcctaccataattcataggtattcagtggaatacccaagattttggacaaaaaaattcatatatgtaatatatatttcatatgtatgtggaaaagtatgcaaaatagacttgttccttaaaagaaagcccgacttagcaccatcccacctccctcctctactcggcccattggcacaataacccaaatcagcccaaaatggatgtaaccctaacctctccagctctccttcccgatctcctccatggcatggctacctagccccctccccaaccccgacgcgacggcgcatcgcctcctacccacccccgagtcctcaacggcggcagcgcccagctagctgcggcgcagcagcggctgccaatctcacgccgcgcgtccgtgcccccaggccggccgccgcgaaggccgccattgcccacgcgccgccgcccctgccctgtggcgcccgggcggcgagccaggcagtgcccgcactccgccgcccgcacctctaccctccaccagtccacctccagtccctggagctgcctcagacttagacggctagacgcccagacccaaacaaaggtggaaggttagaaacattttggtaatttggttggattaggattttagtatttaggtcatagttgaatccaggatggttcatttgatttaggatttaggatttagtttatttgaattgttgaatctaggaattgttcatggttgaacattttttatttaggatttgaatccagtcattcaggaatggttcatgatcgaacaatcgaactttgaaacttgtgattcacttatttgtgaagctctgtagcagagttagtacttataaattgcataagtgcacatattcagcagacttagtatggttagtacttaaattggaagaccatattgttgttctataggtttgaaacatgaagaggaaaaatgctcccacggttaatttaaaggcttttttagaagcagctgttgcaaagaagagaactcaaaaacaagttaagaagcaagatggaataagaatatttgaatgattgtttggttacattcattgaaagggatctattctttcaagttaaggataaagacatcattactcattttcatcaaaatatcaagaaacggaaagttcttctctaaattataagatttcttattattttttcattttctatgctctataaatttaatatgttttgtcaattaatactttagtatgcttaacacattcaatttataatcaattctataaatctacggctttttaaaatcatgtttataccgttatatattatacaaatattagactttaggttgaaaaaaaaattctcttccagtttcaaatacccaagttgaaaatcctgggcatgcccctgctcacatgccaggggaacgggaagacttgcaatgagtgaagtgagctgaggtgtgtgtcatgttgccacaggtggtacctgtactcgctgttgcacttgcacacatgttgaggatctaacggtggtgctccagatcgaggatggcagcaagaaggaatggtctccctcaacctcccagaaaggtacctatctcatctccgtgcttgccctgcctcctttcccttatcctctttggctctcgttagcatgaagggttggtctgagtagctgatagtattactcccttcgtccctaaataaaagggattttggttggatataacatatcctagtacaacgttgttaaactaggatacgttacatccaatcaaaatcccttatatttagggacggaggaagtacgtacttaggccctgtttagttccaaagtttttttccaaacttccaacttttcatcacatcaaacattttatacacatataatttttctatcacattgtaccaatttcaaccaaacttctaaacttcagtgtgaactaaacacagctttagtatctagattgatggacctggtacatgtaggtatcagactgcagcatctaaacagttgaagtggggcgtttctagtggggagatcaatgtggactgacgagtggttagatggtctgacaattaatcatgctcattaactatcccgtccttggaacgggcccatagcatagccgtagtcaaagcttttatacaggttcgagacgtcattagggtaataaccatatgccatgttggttgtaggcaacatatcctatgcacacaggccctcacgtgtatacacgtgcacaccaactaaaaaatgtcaccaaaaaatctagaaaaaatcatacacatactttcaa

SEQ ID NO: 46782 - DNA, 24414 bp, Oryza sativa
ttttcagctattagattagatcatattaaagtaattaatccttctttcctaatctcatgtgtacttgcaagagagaaaaataaatatatactatttgcccagaaaaaaatatacgtacatatatattcatgtacaagagactattatttgaaaaaaaaacatacatatgtacgtacatcagaaaagaactattaaccatgtcctcctaacccttaagtagaaagtttttacttgatcagtctacccctatgctgtactcctttctctccagtttatttcctagcgttgttgttgactaagctatatcgtatatctataatactcttatatataatacaataaaaaactattacattctatcatatgttatctatttttttaataaaaaagactgtatatttcttctgacataaaactaacgctataacaatcagatttcacaatacaattaaaaggagatcactaaggttccgaccaaatagaatgcagcacaatttattaatattgttgtcgaaatgacaaccgcatacgtcgaaagacgtggttactcaacagtggtaggaagaaaacgaagtgtattaaattttaagtttcccttcttttctctccccccattacatggccctaggggactattttatagccccattacaggttcttactactagggtttaggttatacaggagaatttacatgattaccctgatgaaaggacatttacaggggtacatgatgatataggggctcatgggcccctgatgggccgtctggcgatcgccggccctattgcccctaggcttgatgggccggaaaggcttcttcggccctcgcgggggtgaacttgccaaggcgaagtcgtcttccttcggcagatagtcttcgccttgcacccttcgcctgagatgcctctggcctggcaaggcactcgcacgactcttcgcctcatgccgttcttgctccatagtcttcgccatgggtttcggcagatttggtcgaagggcctcatgccatccgccaacaaatatgatgatgcaaaattaaagaaaattaacttggtgaaaaatacaaaatagtaattaaattttgaaaaagaactaatgattaaaaattacactccagtataaaatacaccttaatcatatcctatcttactataaagttataacccattaattctaaagctcaacatgcaaacatgtcacaagaatatatccatcatttttataatccttaacatatattcaccatataatcaaagtatgggatatcatatttcatctactaaatgtatttctctctaaacatagtttgacaaccaattttatttttttaataactaatataaattttacttttacctcgattaattaaaaaaattaaaagttatttaggaatttccgcagcaaagcgcggggaatcacctagtatatctataaagttcatccttactaagtgtagttaatactaattctctctctcataaagccacatcatcttaattgtttttagccttaggatgatacataaagggtgtaaattgcatctctttacatcacctcaattgtttttagtctttagaagatttatcaaaggtgtaaattgtatctctaccccaaaaggcacaccatataacccaatcatttataacctatggataattgataaaggcacagacatatataaacacatgaaaaaaaattgtataataggtaagaaagaaaattttataactcatatctactatataatcacacaattctcccacaacaacgcgcggggtacccatctagttataatgtagttacactataattataaatataaatgcaagtgaagtgtaattacgcagtaaaaacattcagattatgctaattgtgacttctctctctttctgccatttgccagtcgcgtggatggcatctgacctttctactggtcgtgtactggtagtagtagaggtttagagtagtagcaatggctcagctaagaagccagttagtgtcagcttagtaaatgctatagcacagatctcaacattagaagtaaatttcactttaaggcactatattattatggatattttgctttttacaatgtttttactttgcaccgggtatttttacctttgtgacttttttgaccaccctcaacttttttatccatctatatcatatataaaaaaatatggtcttacatataactgtgacacttaattcattattatgagccaacctacccaagatcgttgacatgcttacctagtccaaaataaaaatattgaaaatactggtgaaagggtagtataaaataaaacattcgaaaaaaaatatagcccaaagtgaaatttatgacctatatatagcatttcggattaaaaagttatcacatggaaaaatattctagcccctttttatgactttccgatgcaaataatcttgacaattacttcatgctttttaataactggtagtggatattttattcatttgcaacccacttttttctgtagaaaatttataaatatgttaactatcttttgaattaaaaaatattacatgaaccacattctatcacttttcatgatattataaatagtcttaacaattggcacaaataaacttgaaaacatatattattgtatcatatattagcccacggacatgcatagacgaattagatcaataatacaaagaaacaaaaatatcaaaaactcatatcacctcatatattcgtgaacaattactactcaagcaaataattttttcacgtggttctcaccactgaagctattagattatttgaagtaatgttgaatgatcaattctgcttatttttagaagagaaaattacttttgtaccactaaaatttagtagaccaattaacgccataaacaagtgctaactctattttataaatggactcaaaacttttaaaaaaatatttatatcactttcatcttatctatgtgtcattccctaaagggcgccaagcatagataacatagcatgctaagctaacttacgtatagcggggtcatgcatatgactgagttgaggtgaccccagtgacaggtacagtactcacaataaagttcaactggcctacttaaaattgtgctccacactgatcttgaggagcacagctatttataaatagaggcaattgcaaatttaccactactttgaattcttattgcaagactgccactaaaaaattacaaaaatgccactagtactgtcattcgagtggcatccttgcaaaattgaaaaaaaccagtagcaaatttgcaaatgtcctaaggtaagttgctcgtgcatctgtgcgggttttcttcctagttattttaaagagtaaaatgcactagcggtccttaaacttgtcaggagatttcacttaggtccacgaacttgcaaaatacacatcgagttccctaaacttggtttattgtatcatcccagtccaaagtcgtgtttgaccgtggtcttgcttacgtggcacgccacgtggacgatgacatgaaattttttctcttctcccttttttttgacccgctgtggccacaaaacatcatctccttttctctctctctgcctgccgctcgtctcctcctcgccaactcggttgccgcccccgtctctccgcaccacgccgcaccaccgtagctgctaatgacaagctagccatggcggcgacggcagatccgcgaagccgcctgccacgacgtcgacgcaccacctcgagctgtgggagcagctgccgccgccgctgctgccaactcccttaaacggtgggatcgaggagctccgcgtgccccagcctagcccctcacccataccgccgccgccgctgacaacgaagcctgagagcctacctgcggagatggacttcgagcccgagctcaaggcgctgcctccgcctccacttctcgccctgtcacagccgcaagtggatggtgcagtgaggccgtggaacctgcgacagctgacgtggcggcgcccagccatctccttgtcgtgggcggcggcggtgcccatgccgtcctcattccgacgccggaagcatgcgccatttttggtggcactcaccgcggaggagatcgaggaggacatctatgcgccactgcccccctccctcctgtcagcgccgctgtcctccctcccatcgcgcgcttgcctccggcatggcagctcagtggctcggcgagtggaccagaggctgatggagaaggagatggaggcgcggctgtggagctcgcggtgcagcggctgccggagagaaaaaaaaggaagaagggagaaaaaaaaaggagaagaagggagagaaaaagaaggaagaagggagaaaaaataaaaaaatttcatgtcatcgtccacgtggtgtgccacgtaggcaagaccacggttaaatgagactttgtactaggatgatacaataaaccaagtttagagagctcgatgtgcgttttataagttcgtggacctaagtgaaacctcacgacaagtctaaggaccaccggtgtattttactaaattttaaatgagcgatgagactgtcagacgagggagcttggcacaatacgattggcagattggtctttagaaatctcgttggcttgctctgctatgttgatgattcgatcgtgtggacctgtatttttaatggactcatacggatatttttttaggaggtgttttagatcatgggtgtaaagttttggcgtgtcacgtcggatattatatagggtatcgcatgagatgttcgggcactaataaaaaaaactaattacagaacccatcaataaaccatgagacgattttattaagtctaattaattcatcattagcaccacattgttaaatcattgaacaattaaggtgtaaaatttttgtggggatctaaacagggccttaatcgtcctatgcagccatggttggagtctgatatccctggttatagggagttgttatcatgtatggaatgatatattattgctccgttggtgtattcatgcacctgtatggtatcccatatttaggacacactgacaatagcaactagccgttgactacctagcctccatatttaggagtaaactctattcaagaaaggaccatcaatcttacatcatctgagccgatcaagcagtagccattgactacctagcctccaaacattcccaactgccaacggcagctccaaccagccacatctcctcgcggggccaaactccaacctactccctccgctaaaaaaaaatccatttctagcatcctagtatcgaattagtggagagtgaaaaaaatagtaagagtaagggtattgaagaaataaaacttctcgttttacgtgttgagggtagatagaatgatagaagttggttttttttacaaaatttaaactctagagagtacaacacatcccctggccaaacgtgcaccgatgcctatgccagagccacatccatcgtcgggcactccaagtggtcgcctcgtcgcccggcgcgctcctagatcgacatcacctgctggcgcgcgccacacccaccaccaacctctcctggcgctgccgtcctctgctcgagcgccccaccagctgctcctacgcaaactccacacccgagggatggcagtgggccccgttcccggttcctgtagggaattctcccactagggaatggggcatggatacaagtgattctccacggggaatcaaatggaggaaaattgtccccgtcaggtatagcggggcggggatgatcctctatcctctgtccccattccccacggaaacctgattattgtatataggggtctaaatccaatgtgaatgttacatgtctaaaggactaacagccatgataagtggataatcaacaatattttgttcttgtcatgtgactaatagatactccctctgtcctaaaatgtaagcatttttagctataaatctggataactgtgtgtccagattcatagccaaaagttgttacattttaggacggaggtagtatatgctaatatattgctatatgttatggacattatttattaattacatatgtgatttaaggtgtaaaagatttttttaaacgtcaacggaggatccgcggggattaattccccgcgctgaggcagggatgggagaggatgggggcagagaaatttcctactcacaggggcggggatggggacgttgccgtgcctacacccgatgcttgatccggccagagggacgctagatctggcattgaggttgctagacccagtcgtactagccgccacaactgtacacatccgacacagctaactagacagtctgcccaccatgtaggccacaatctcttgctcacaacaccaccatgcccctgaccatcaacttgctcgtgcatgcgcattagatccgctacgcccaccgctcgctagatccagctcaggagggaagagaacggtcctgttgccgccatccttgctgccacacggtctctggcggccggctcctttgacggcgagctcctttaacggcgagtgcgaagggaggaagacggagaggtggcgcagtgagcagactcaccacactatccactctgtggggagtgacacagggaccttctgaatgaagaaaaccctgaaatgctgcagaagtttgagcagcacaaaaaggttgtcttgtgttgttcattcctctagtgtttctaacatttgaattttagtattgcaactcccaaaacacatattgcgcagtctgttcggtgatgtgtctattttgcttgcaacatccccctacgcaaaatgctaaacatacttttgataattggttgagggagtgcctagatccattaaaaaaatgatttcttttttaaactattgccttgttacttggtcaatctgcgttgtcaaaatgatgtaatattatactaccagtagaaatgatctaaaccatttattattaagggtaaatcggtgatttactaatatagtaattaggggtaactttgtcctttatgtttttttcctggctaaatcgatatgtagtcatccattgccctggtatcgctcatattccatccaaaaagccaaaaaaatgaaaaaagaagtttagtcagtactaaatgacgattataccctttaacgcagtttttttaaaataatgccacttcacgtttctactgccgccaactagggtggtggtataagtagatatgaactcttcaattaaatgagttcaatggttcatattgatttctactactagtagagagagtactgtagtggggctctaacccttcatgtcttttagatggctccattattagtccttatgcttttataggagaaggacattataagtaatggagctacactattgatagccaagatcttttattttactttggatggcacaattcctatagaacatcatcatagaacccacgtgttttctattcgagatttcagtcggatatcatcaggaagggatggggatttaaatcccataaccttgagaattttgtttaacttgactcattggccatttggctatgtccgttggcagaggccggagatataagcaattttcattataaaataaaacacatgtgtatgtgtatctgagtgttgtttgagatcgatttgaatattttactgtgtaatatgaaatctcaacgtttcacaattctgaagagaattcaaattaaagctatatctaaccataaactagcaagctgaaactccaaatgctcggcttaagggtcactacaatagaaatgcacaaaggtgtcggcactatagataccggaagtgttaaaacctagaaccggcgccttcgaacaaattatatgtgccgattctaaagaaaaaccgacaccaatattattggtgctgatttttttaaaaaaagaatcggcatctagaatattaataggtactggcacctgtaaaactgacctgagccaaaccggtgggtgttttacctcccgtccttatcctctctctctctctctccgcccaacccacccacccacccaccattatctctctctttctcgcgcgcgccctcccaacccagcggtggcagcggcgatgatgggaggagaggcggtggcaagggtgagattcttgtgttcttgatgttcttgtgttcttggtgttcttgtatgttcttgggttaaatgttcattctatgaattaaatgttctatggaatttggttctagtgaaggtgagctgctcgatgcatcggctcgaacatcaagctggggttcttcgtggaaccttaaaggtgtcgatttctaaaccggcacttatttcccttccacatcaatgccgcctattaggtgtcggttggtaaatccagtacctttgtgaggttctcaaccggcaccgattaaggtttgtgtagtagtgggtgcacttgatcagtaatgacaatcagatctaatttcaggaattgtggagtaattctaattgtttcccttgtttagtaaaaccatatgagatgctagtgatcaggaataaaggattacggtgtaaccaatattccgggaatatgtggcattggagtttcttttaaaaacatgtgtctatcctgggttatccttacccttatgaaaacttatcgaactacagaattccctactatttgatcccgatggataggactatgggggtaatattccacaatttcctatagccaaacgcacgtataattggttaggtctacggaggtaataatattaagataacgattcgctataactaaacgcgaagtcttaattaattaacctggaacaccaaaatttgattgagatgacaagctgacctcgtttgaacgaacctaatgaccgtgagactccagaagtccttcgttgatagcgtggaaacgaatccaccgaggaggacgacggtggaccaagtgagcaccaggaagcccgtcccggtgacagccattgacaggtaccccatgaacatcgcgtagtcgttgatcagcttcacctctggccagttcccatcgatgtgcccaaggcgatgagcacggctctgtccaccggacattctgttcacctgcagagacggtaaatatttacttgtacacaaaactacacaaaatttacttgtacgaacaggctctaccgttctaattccgtttacgaggaaaaaggaaatggtaggaagctatctttgcatttttcccgaccgttttagtccttagccgaagctaccatcggctggaattaaaccaaaccctagaaattacaagcaaggacatctagatcccaagttccagggaacaggcaattaaaaacacaccacaccattatagggaagatgacaaagtaatctctagtcacagaatctaaagatgtcacctgttttgccaaaacctggcctgcgccgcgacacgtttgcctcagccagtcagcctgctcgatcctcctggtagcgaactgacaattgcttggcgtcgccgcaagttaggttcggtttgcgtgggaatgtagaaagcagaacgaaggaatcggggaagaagaacaagaggaagagtgaggctggggaattcgatcaggatttatttactacttcttggatgccttgcccattcagcaagtaggtgatttaggctgtgtttagttccacgtcaaaattgaaagtttaaagagattggaacgatgtgactgaaaagttgaaagtttgatgtgacggaaaagttgaaaatttgaagaaaaacgttggaatctaaaacagagccttacacaattccacgcacggcccacactgccatcataaccgttgcatattttactaatccgcttgttggcctgttctcagagaacttaaagctcccaaacaatttaattttttgtctagattataataaactcgaataaaaaaataggagcaaccggttagggtttgcaagaatctaagaaagctatgtttccgcttctagcttcctagttaattttttaagattctatagctacgatttcttagaaaaaatatatattgtttgagaatgctaaaggttctgagagaagctgcagcttttagactccccgaaacatgaaactatatagatgcaacaaaagcaatgcagcatgtaagtggcacataaccattaccattatatgaaaaaaaaaaaacattccgcctgtcaaactatcttcaaggccgtacctaagaatccttcattatagttttttttttttggcaaattttgctacaggacatcgcaattatgtggttttagctcaggacactgcgaaagtgaagttttgggggaagacatcccacaatcatgaatatttgccgatggataccgcgccgtctaaaggatacttgccgtgctgacgtggcgggcgagaggcccttttttgacacggtatgacgtaaatacccctgctgacgaaggagggagtagtaggtcccacattgaagcggttgtgttggttaagaggaggattaaatagaaatttactccgttggggaccagttgctgttgagacattggaagggacgaggagggaataaatattgcacaagagataataaggttatgtggggcccacttgacagtgtcccactcctcttctttttcttctctctcgatttcttctcctctcgatctctcctcacctctctccatctcgtttccctttctccccacgcgcgcgcgcacccgagcgggatgcggccagccgcgccgtcgcggccggcaaccggccgcgcaactcgggccgaggtgacagcggcggcctgaaggcagcctggcccggtggcgtcgggtggatgggaagatgatggtgacgatggcaggttgttggctcacctgcggcccgtggaggaggcgcggatgagcggccaaggcgagagaaggacttaactggcggcaagcacgagaggggagcaaccgctgcttcgtggcaagttgggggcgcaacgagaaggggaggtaggcagccgctcgcatggggaagacgaggccagacgagaggcagtcaacgaacgaggcctctcacttcgcctcgtctgtctatcacggtgttgcctctcgcgcggccggcgaccggctgcggcggcacgggccgaggcgatggcggcggcctaaaggcggtccggcggcgttgggtggatggggagaaaaggccggcacagcgaggaggtgccggggcagcgccgggcagaggaggcggaggtggaggcgttgggtggtcggcggaggcggcgcccgtgcgggccggcttggccgcgcgcgggggcagcgctcgtagcatggtggtggccccgagcaagacgaagacggcgggtggtggcaaagcggcagtggcgcacgggtggtgctcgtacgggacatgtggccacacgcgcagcagcggccgagcgtggcgatggcttggcgcggcggcggagaggggaaagaagtagctggcgacggtggggagtggcctgacgggaggcccttttttttgctgacgtggggctagggtttttgcgtccgaccgcatcaaaaaagggcctcccatctgccacgtcagcacggcgagtatcctttagacggcatggtgtccatcggcaaatatccacaattatgggatgtcttccccttaaattttactttcgcggtgtccctgagctaaaaccataaaatttcgatgtcctgtaacaaaatttgccttttttctcaaaaaaaaaaggggggatgcagccgtcgatcagtggtcacccagagattcttgggttatagtggttatcaggtacgatacgttggatatcacgatagcacgggctaactaggttagcaatatcacataggagaaaccactgtgtaaactaccggtgaggtgaattgagccagtttttatagttgagggatactctatgtctagttttacagttgagagatgaaagtaaaacgcaggttataattgagagatgtacataggagcaacttgtagcggaaaaggaagtcacacctctccatgtcatccacgtgcaggccacatgaggagaaaccctagctaccgatcgcaccaattcccgtgagagcaggaagctgggccgtcgtcgggaagtcgggcggtggtgtggccaataccaaacgatggtctccttcttcggcaagggggagaaggagcgcaactggcagatccaacgccaacaccaccaaattccccctccccctctcggcgactggatctgatgccccttcaccagatctggcaggggtcgtagtcaatatggcaggggtaaaggtcagcctgtgagagggttgtcatggttggcagcgacagacgaccggaacaggcggagcgaaggtcgtgcatggccgccggcgagaggtcaatgcggcgtggagtggtgtggccggcgatgacgtgaggccgcctggccaggggaaacaggaggcccgcgctgcgtgtcacaccctaaaaatcttaaatatataaattattgtttaattggaatttttagaaattattttaaaagcctacaagctaaaccctaattttctaggaaaattttcaacataaaaataagctagataaaattttattaaatactatgcttgctcctctattttctagatttttctgggaattatttgagcaagggaagtatttttaataattgaaacatcatttcacaaattgttttattcaaaaaagttcaaaaatctttctctttggtcattgggccgaattcggcccaatactctctctttctctctctccccgcgcgcggcccacgccggcccaagccgctgccgcccgcgcccctctccccagccactgacatgtggggcccacatgtcagggccgtcttccacctccggccggccgccgccgagcccgaaccctagcgccgttttgcgccatcgattccgcccaaatccgagcccaattccttcgattgattgaggggttttgttcctctcgttctcctctttcttttccccccagaatcaaaacaaatcgttgcggtttggatccgaatcgaattcgtttgtttttatccctaaaaaccgagtccgagatcttcccgactcgattcctttcgtttgcggcttgatctcttcaatccgagctcatataaaggttcccctcgtcgtcctctctcgtttgccccctctctcgagctctcccgtgccccctagcgccgccgcgacgcgtcgcaagtccgccgccgccgccggccgtcttcggcaacgtcgccgcgccgtctccgccgtcgccaccgctcgccgccaccaccgttaggtgcgccgtcgtgcgaggaagctcggccgcccctccattttcgccgccgaccaccggagcaccctcgtcgccgttgagccgaaccgccgccgccttccttctcgtcgccggccgccgtcgtacatcctttgactacgtggtgagtaccaacgggttcgtctcgttgtcctctacgcgtaggtggtctccgtttccgccgccgatgtccctagcgccggcgagctcgtcgtcccgagccggccgtcgtgctgacgtcagcatgacgtcaaccctagggctgacgtcatcagggccagggctgacgtcatatctctctctttttcctttttctcggttttcaaatagattaaaacttcggaaaatcataactaaataaccgtagatccgttttaggtggttcaagtttctaaatttttctaaaatcaagatctacatgttaaaaatatccacatgtactgtttatgcttgtttttgtactgttttgttgattttgtttatttgctttagtttccgacgttccggaggagagcgtttccgttgaggaaggttctgaagtgtttgtggaagcccaaggcaagtcacacagatcccaaacaaccctttgagcatgttgattccgtttaaagctatcattttatttcaactatgcattgttttcgaatgtcatcgggtggtgaacctttcccagttaattaatggccgaagatgactttattttcctatgggttataacttgattagcatgaaccttatatattggattggttcagctaaatgctttatatataggtttgcttagccatgcttagaaacattagctaattaaaaggggttaaatatgaattatattataattgttattaattatggttttatttattggtagctcacgatgattgatcgtgtgatgttaattaattgataattaaaacctggctaaggtgggttgtgagcatatggttttgatggttgtgctcatgacaattaaggaccggttcgcgagctactgttgtgaaacatttatcgtgccaaccacaagccagcgtgggcaacagctttatcttttgtatagcgtgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcggagtttaaactattcgaatagccgtacccgcggtaatgggtgagttgagcaatgtttttcgtgattagtctcacactactcgttaatggtaataatgtggtaattaatttagttcctggtttggaatggataattcctggtttggaggtttaatttgttcaactggggttggttgttcaaatgtggttgggcctatgcaacatgggtgtgttgtatagtgtttatttaatattgattaattatacaactgtttttactattctcttaaatatttattaaatgctgttttctgcaaatgagctataatatgccatcctttgttatcctgtgcacttgcatatttgctgtgtggcttgttgagtatgttatatgctcattcttgcaatattcattcatcagaagaggagtacttcagtgaaggtgatgatttggaggattaggcttgttcttggttaagttgcctgtggagtggagttgccatcgctgttccgtagtttgttttagttttgttttccgctgcgtagaatgttattgctttgagaggaactatctacctctgtaatattttattatttgcgaatattcgatagttaattatttgtactctattatcgatattgtcattgtgtgcctcggttgattcctagacgagggtttaacacacatgtaagcgtttggaattttggatagaaattccgggcgtgacactgcgcctggggcacaagcaggaaggtcggcgttgtgcaagcagcgatggccagatgccagcgtgatgacggcggacatacaactagagcggggtggcgaggacaacgagaagccacgaccaacgacaagtcgacaagatgagcaaacacggcatgggtaggagactggatggtgctccgagtcgagatccagcggcagcaagggcaacagggctagtgacgcgactcgagacggggatgatgcaggtagtccggccaaggtggcggtgatggtagccccgtgaggtgggcattctagacctatggcgagctttgatgcagatgctagtcctcttgcggcgacggcgcattgccgccacaagatgaccacgttggcgggctaaagtagggaagaagggggccatttttctctctcaccctctccctctctaagccaactgcgtggatgaaattggagcacgccgaatgtcgggatcctacttgatggccaaccgatgacgaggcgttgacgcggtggctgctgttttcggcaagcggtctcgacacgagaggggaaaaagattacgaacataaccccagcctgttcgggccagcaattgcaacacttgcgggtgccacatttcccttgttgcatgatctttcttgccctctcgatggatttcttcggtcgaaaaccatgtcccgatcgactttccaagtgaaaatccttgtagagatgtcgctttcctgctttacttgtagactcgtggtgtgaatatcttttacttctcatccctttcatgtttcctggctaaaatctcccagagctatagacatgtaatctctttagtgctctatcaatgtaaagaggatttttactgtccttgagagtggccagtaccaaatcgtggtcgttcaatgagcaagatcgaacggtcgagcatgagcggtaccgctactttgcgagaaaattgggattatactatcgcaaaagagtagtttcgctgaaatgctatcgctttaaactgattcattaaaatgctattctaaactgaaggtgttcaccaaaatactattttcgctcttttaggtaaatataaatgtttttacctaatttcaacttttttcggaccaaaatacccttgacgcgggccccacctgtcataccctctccactctctctttctcctcttcctctctcgaggatgccgttgggagcgcgaggtggccggcgggtgggcatggcgagggtggagcggggcatggcgacgcggggctagtgagggtggggcaggtgtggcggcgcgggaccaacctcatcaccgacgacgacgaagccactgccgacgctcgccgacgctcgacggccagcttcgtcgaggagcccgtcgaccagtggctcttcatcgtcgcatccggtgcggcttccgcctcctgctcctcggtggcgacgatgcggcggtgatgcggtggaggaggcgcgaagaaggcggcggaggcatgaagaaggcggcggcggcggcgcgaagaaaagcatctagagcgccttggtgcgggggatctccgcggctcccaccaccgcctgaagcgctggcgacacgaccagggctacgtcagccctgtagacgccgtcttcttcggggccacggccgccggggagttggacgccgcggcggccgcgtgcatggctacggtggcggcagcacgcagtagcggagcgaaggaggcggccaggaggggcgggcggagggcggcgagcggggagggggagagggacagcaacgcggcgtcggccactactcgccttccggccaccggtgctctcgcccgtcgccaccctcttcttcggggtcgcggtcgccagggagttggacgcagtggcggccgcgtgcacggctacggtggcggcgacgcaccgcggtgatgcgaaggaggcggccgcggagcgagggaggaaagccactagcggagcgaaggaggcgagccagcggcgctccctcgagagaggaagaaggagaaagagagtgtggagagagtatgacaggtgggcccgcattaggggtattttggtccggaaaaaagttaaaattgaggaaaaacatttctattcacctaaaagagcgaaaatagtattttggtgaacacctctcagtttaggatagcattttagtgaatcaatttgaaaggatagtatttcagcgaaaccactcttttgcgatagtataatcccaattttctcctactttgcatgggggtaccgctcctccttcggtgtgcgggagtagagtgaaagggtaaatatgtactttcgcgtttatcctcttccatgatgctctcgcctctcatttttgcatcgtcaaagccccaggcggcgcggcgccgtcaggagatcggcgatgccccaggcggcggcattaggaggtccagccaggctctcgacagtggtgcttatatcagggtgatgctcttgccagcggcagttaggatcttaatgaaatctcaagaggcaaatatcaggggtccggcgaagctctcggcggtggtggtcacaagctcggtgatgcccccccccccccccccggctacgctcatgggctactgggctagaagatgctgccagttgcatggctgacttcccgtcctttaatttcagcgaagctcagtagctcacccacctatttctttcgtggcacaaatatactggtgttgatttttggtggaaaaaaacttcgttgttactcttgcttactatggttattggatcgattaattactgttatattccattaagcaataagcatctagccaatagccggctcgggacggcggcaggcacagcggcctcgatgagagggcggtgggctggatgcggcggcgcctggagcggcctcgatgcgccggcggccgcggcagcctcgttgtggcggcagccgcgccagggtcgatgcgatggcgccgcggcgagagaacaggcttgatacggaggcgccggggaagcttcaatgcaacagcgaggaacggatcattagcacgggcacctcattttcattagacggtcctacccctattaaaccgatggttagattagattggtacctcatacctcatggtacctctttaaggatgggaaagatgctccaatgtaaatgttgcactatcttgtgcagtttgtttaaaaaataaatgtaatctttttagggatgtgtaatgaatttttagggatgtaaatgtaaatgtaaatgtttagggatgaatttttaggggtgtaatgagtcttttaaaaaataaatgtaaatgttagggatgtgttatgaatttttttgtcctcttttaggatttgggccatggaacatgggccatgggccgtttgagcgagacaggtttcccatatggaaaaagtacaccgaaagcccctcaacttgtcatcgagttacaaaatcatctcccaaccgcaaaaccagatatatgacatccctcaactttaaaaaccgtttactttagatccttcggtggttttgatcccgattttatccgacgtggcggctaagttagcgtgggacccacatatcaggatgccacatcagcacactctctcttccccctcctctcccttctctctgtctctctagtctagtacttcatatgcttagtattgttaaaattgccagttcctgaaactgcacacaaatttattccacctacctattcagctatcccttacattttgagggtttctttggaacgcagggtaggatgtcacgtgtcctacgaagaaaaagttcacctgaaattacagaacatcttgtttgataaccccatatgaaaaacatagacactagcaagatctcatgttatttttcctccataattcctatgaaatggcaccttccatacgaattttaaggaatttcttacatatattcctttgtttcaaaagatcacatagacccccccccccccccccacttcaattcttcaaaattcttccaagtttcatttgttccaaaggagccatgaaaggttatatggtattttaggacatttagcttgcccaccccgcttgcattccttgcattcctactgctagttacagcggctcaaaaaagggcaaaggaatagcgaaagttaaggcggaagtaccaaacatcatgtttatcagaaaaacaccttatcacaaaagcatcgcatatgagcttctagacaatttaacagggcctgaatataaacggcacgctgacagtagcatatttccaaacgtacacaacaatgtcaatcaactagaaataaatatataaatatatattattatatctctctctcacacacacacacacccctgtttagaagaaatataaatggtgcagatgtagagttaaggtaaatttcacaggatgttaaaagccagctactcatgttttaaaggaactggcaatgagacctgactgttatatttacatgataatcatatatacaaagtttctaaaccgaaccaatcatatgaacaacagactgtttaattgatggtaactattttcacaaggattagctgcagagcaggatgaggctgatgaacagccaacaagctaaagggcgcgcaatgcaatcaatttgaaagttaacgttagaagagtgcatctggagagaaaaggagatgaagtggcgttgcaatttggacctaactgaggtcaatttcaacacgctccggtgtccccctctcgctttcctgcgcgacgagttcggtacctagctgccctttgtcccctgcaccaaacgcatagagttttcctgaatctgtcagtgcaaatgtatgtgcattccagtaaatggagttagtgaggctgatctgagcaaccctttcatttgttcttttcaaagaagtcaccaactccgggctaaggacattagtgtgcctattattaccctggaaaaagaaaaaaatatacatcaagttcagaagcagagagtaaagaaaaggtttattatactgattctaattcgcagagagaaatgcaaagttataaaaggtatatgagcaaatgtgtttatcttttcactgaagattatcattgtgagtaaggatgagcagataggtgaagagctaaaagaaaatgaaattcacagtagagggttaatagaccctcaatcttttgacaaaacggaagacagacattactgaccaatactcttagaaaataacaatagtagattgaaatacatactgtgtgatttaattggtaaattgcatttagtgtagcatttaacaaaaattatggaactgtgtagagaatcatagagcattgagctttgacagcctattgtgaatatgcagacagaatgaaaatataactccatgtttttgttaaataacttcaagtattcaaaacatgaaaactagtgcctaacctcagttatagtgttgtggccaagacttgatgattcaccacatccaaacgagtaaacatcacctttatcagatacaacaaatgtggtgtaatctccagttgctacatggacagccctcacattgactaaggactcaacaaccttaggaacagactcacattcctcattaccgtgacccaagcagccataccgcccccatccccaagtgcaaacacgcccatccttgcctacaacagcagcatgccaagcaccagcagcaaccactactggttgtatattcaaagcttggaactgctcgattaacctagggtatttctcatcggttcgagaaccatggccaagtttcccacctaacccacaaccaacagaataaacagacctgcaacaaaaataggacaaaagcattttaatagttttatcatatctataacagctggtgtataggtaaaaatattcaaaacttgcatactggttcacctgtctatcaaagcaaaagacaaattcattgaaaatgttaaaacaatttttcatatgttataacggaataagagacattagttttttttattattttatctgatcatacaaaacattaaaataatacagtagctatactacatgcaaatgtaatacttacttgacattagttcacctattagctaattgttgtcaaattaaccaaggctgaatagtgaagagtgaggctaaatgcaaataacgtgtggtttgtttattaaaaaaaatagtatatcactaagccatacttcacagcattgacaaaaagttgcatgtttgggtgaaaaatcttacatgccacttggttggcatgccagagccaggagatagcagtagcctgcggcaatctgcacaactggaatgttctcaagagggcctgctagaagatgaggctgaacatcatttggctctgtctgatgaccaagtttcatgtcattcccccaagaaaatgtatacacatgaccttcccgagataaaactgcagtaaagaagttcccgattgctgcctggacaatgtatatgtccttcaatgattccaccagctgtggtgtggtgacaaccctagaaccttgggctgcatattccacttctccaaatgaatcctttccaaatgcatagaccctaccagcatcactaacaagcattgtgcgtcctgctcctgctgccgcttgaataattctaataccctgcaatgatctatacgagcaccaacagacatttagcactcttttaatctacatttgtgtcatgactaaagttatgataactgtatattctagaagcacctgataatccgtggcctccactcctcttctaaactaccatggccaagttgaccagagctgttggacccaaaagtatacactgcaccgcttgttgtcacagcgatgctgtgaccaggtccagcgattgcctgagatttttccctccggcaacatgcttcacctgccattataaacctaagaaccagcttccaactcccgccgcaacgttgcttaaacatttctctttcttgttgagtcataggtttaaatatcgcccgtttctggcacatatccaacgctgcgagttctgacattgacaactgaaaatcgggagggaaattggcaggcttccggaaaaacgagcatgttgcctatcgcaagcacaaatttcatcagtggcaatatcaattctacattggagaggaagaacaaaacactacttgcctccaagtgagcgaggtcatcaggttccagattgcatgatgtgaggacatggaggacaattgatgggtttgcagccaaggggaattctccaggagcagagccaccaaagcaatggcgctgtgacctctgaaacgactgctgcaacggagaaacagggcaagagcatcatctatgataaggtggaggggtagagaggaggaagctccactgctcgtcgtggcgtccatctgccacggctgcgacttgcactgccttatgcttttatctcaaacttgtggtgttcctggctctccagaagtccagagtgaattaagtacaggaccattctgtaatgtgcaatgcattaatgtaatcaagacatgtaactacaatcattaattgttaagtaacttctctaacaagctcatcagcacaccttagtttaacacaattaaacaataatatgttatattattcatccgaatcagaaaagtggatgagaaagaatccatccaacacttgtaaacaaacaatcagagcatatcaataattgaaagcattcccaaagtcaatgcaatcaacagagcatatcaccctgaccaaacatatagagatgccatattcttctggatggcaaacagacactaaatcagatgcaaaacaacctccaaaaatcaaggaaacaaaggaagaaaacaactgaaatctcaaaacagtgcccccaaacccagtcaagaacaccattagacggttgtgaggcttgcaccaagaaatgattgatgcagaacaggaacatgtaaaatggtaaaggacaaagagccacttccaccccctcacaaaacaaagcatattcctcccaactccaccccccacaaaagtctacctttcttatcctatccaacaattatcaacaatatccacagttaaccagtacacacacaaacaagcaagattccaactgcatcatcggcggcaaaagatcacacccactaacatcctaccagtaaagaaagaccccaattcgagtaaacaacgaaggatccacgctaatcgccccgattctgatgaaaggatcaccaaaaccgagaacatcatctttaagcagagaacaccaatccgaacagacgatcatcaggaccgcgatcatcgccatgatcggctccaatcatccaacctgacatctaattgatcggcacaccacccacaagaaaccaagaaatcctcacccgctaattccccccttggttcttggaccaagaacacaaaagaatcaaaccccctcctcctcaccagaggcaaaaaaaggatcaacgaacacgcaccaacgggcgggtcggccagtcaatcaatcgatcgggaattcttggggttgggggaggaggttggagaggcgtgaatctaaccgagaaacgggggaggagagagagagggagaggatgagagcaggcgagcgacggacagggacgagcctcccaataatgatgatgtgcgtgcgtggagaagggagagagagagagagagagagagcagaggagagagagaaaagcaaagctgcaaaaatacgcatagaaacagcaacctctctctctctctctctaccgtcgtcggctggttcttggggaggagatgaggtgtcgacgaagagggaggaggcgacgtcgaggaggagcaaatcgcagcggccaccgaggaatcatgcggtcggaattacgggaatgccatcgatgtcgctgacaggtgggttatggagggggtggggcccacgtgtcggtgggctgcggtgggacgggtttggtgagtttatcgtcgtgctgttggggttgggggtcaattacttgcgagccggatttgttcgatggcgtcaagcaaacgtccgctgcaaggagtatttttgtcactgatggtcatactattgtttattttctgtagggtaagtgtgttttactcataaaactatttttttcactactggttataggtcctggttagatttcaacttttttctttaaatttttaacttttccataacatcgaattttactacacacaaacttctaac

SEQ ID NO: 46783 - DNA, 8369 bp, Oryza sativa
cattttgaccgtagcacaggtaaaacaaaaacaacgggttggttgaaaatttatgtcaaatttacccttggcaatgatttggaaatagagaagaatacaataataggaaaacatacgaataaaatgccatgttggttggatttgtatgggatttcatgacacaaagaaagtttcaacaccgtagtttgattggcacataagaaaaatgcagaattacatgacactggaagaagaaaacatgaggtggaacctcgtacttattttttctctaaaatttctctacaatagaaatttcaaaagaattggtagggatgtttttcataggattatttctcatagaattcttgtttttttttcctttgtttcaaaggggctgagaaaataaagtgaatatggggaaaggcttgaatccacaatacaagtatctagagtaggggtaaactactaatgaatggtgttgacgtattttaaaacaaatgatttgattgaaattgacaattattctaaatggagggagtattttcttctctcaaaacatagtttctaacatattttcctaattagtgggaagaagatgcgtacgcatactacactcacacctgagaatgcactctctaagagacgaacagcatgtgtgtaaatttttagtgatagcgtaaccgcgtgtgcgtaatattcctgagcatcgggatttaaacctaggggataaaaccttacaccatggattcgctaccacaccgtgtaatgctttcccttgagcccctgcatcttgattcacattgaaaataagaaactgccgtttaatccaaacagttgagttgtcaagtactccctccaatttcttttttaactaaaaacaaagggagtacaaaattttggtgggtgcatcattcataattttcttgaggaaatgtggacagtccattgaaaagaagagaaaacgggtaggcagtcacaagcaggaagctgatcagaactgttgcaagagcttattcttgcacatttgcaatcttcttgtttaaatttcagtacttctatattattcaaaaatcctagtcaatcagaactctcgagcctgaaaactcaaggtagtgcagtagtggaaagacctgctgctcctgatcgatacggttaattgatcaaatttaatttgtgctactgggacctgctggattttcagcataaatttctctttcaagaaccctagttgcatcttttgaaaaccggacttttctcgtaactcatttgagaatataaatgtttgcataaaaatcacgtgaagttccttcagatttcccagttccaattggtgttaagctcatttcacttcaggaaaaaaaaggcggttaagtgactatgatgcacaatgaagatatcacatttataatcaaatacaaaattgaacattattcatatgcaaagtgggtatatttgaaggagattaatgcaaacaattggaggcatttcaaataagcaaaatgggaaaaacaattctaagtccatgaggcaatctccttctactttctactccgtataaagcaaataacaaattcactactgtataatgattgaatgtttacaaattacaagttaggcaacttacaaacaaatatcagtgtgttctcaatgttggagacttggagtgagtttgaagtgttcagaaaaaagagggggccgaatgctacatgatccacctttccgttctgtatctatataaactagatgttccagtgctaccaaaatgttttgtgctgctgggaagatccccaacataataactactcgaaaacttgttctctatcctgatgggttccactttcttaacaggccgaggacccaaagaatttagatctatgagggaaccataatcttggcatgcctccattacagtgtcgtatgattttgcaggaagctcaagcccttggttgcaagccctcatgtacatctcataggcaagcctgggtttaccatcttgtacaagagcttcaatcaacatctgatatgtaatttcatttggctcaatgttctgcactttcatcctatggaaccattcaaaagcagagccacccttattgtttctcacgcatgcgctgattatcgcattgaacgtaacaacagttggttctatctttgctgacagcataccacgaagaacagaatctaccatagcatggttccccttgccaatgtaaattgatactaagattgtatatgcatgtaggttcggcttaacgcctaccttgcacatgtgttcccaaactcggagtgcctcatcatacagctttcccttctcaagcgcactcagcagcgctccgtaagaaactacatccggtgtcaacccttgatctatcattctcttaaatatatccactgcagcagatgtttcagctgctctagaacacgcaagaaggacggcattccactctctgcttccaggcttcaagcccttctgttgcatcttatcaagcagccttacaccccacctccaaatgccccttctctttgcagcattgagtagaatattgaaatgtgacatgatgagctcatacgacaagttattcggtttggggcctttgtccaacaaatcctcataaatctcaagagctgcccaccacttcttagccttgcccatcagccaaatcagatgattgcacacagataagctgatcacgccatcaccacgctcacggatcctttggtacagctccttggcaatggtgtaatgctcctcacctgtacatgcccacacaagccgctcgtaatctctcctgtctggcttcaccccagcttcatccatgccaagaagaactttcagcacctcacctactggattctcaccacccacaagagaccgccgcatcgccatatagcagacacggacagtcagcttctcaaacttgacaaattctcggtcccaatcttcatgattcaccgccaattcacccttgttgtacatctcccttagcttggtgatgaacttgagtgccgcgaatgcatcgccagccttcttgtaggccgacatcactgtcgagtatgtcgccgcggtgggcaccaggccactgccctcgatggtgtcaaacaccctgaagacctcatcaatcttgccttgttcgacatagattgacatcagagtgttgaatgtcacaatgtttgggggaaccccctgtgcctccatgtctgcaagcacatcgtggatcctcccaaattccccactgttcttgaccgcgcccagcaggcagttgtagacgaactggttgacgccgccgccgccgccgccactcccgcttcccctcttgaggtgctccacgacggcgaacgcggcgtcgaggcgcctctccttgcccagcccccggatcaccgaggtatacacctggagcggcaggtgctcctcgccgccgccaccgtcgtccaggaagcccttcaccagggtctccacttcgtcggccgtcctggcgtcccgcagcgccgcgccgaccgcggcgacatcgacgtcaccgcctcccctcgccctcctcccgccgccgccgccggtgccaccgtcagcaccgccgaccgcgaactgcggggtcctagaacggaacgcgtcacactcggaaagccgctcgtccatttcacggaggatacgagggttgagtacaggggttcgggagtacctcggcagcgaacctgcggcggggcgacgaaggctggtggtggagcgggaggtggaggtgcaggtgcggcgggcgcggggggtggtgacggcgagcggcggcggcggcggtggcggaggcggggtggaagacggcgaggggggaagccattggggcgctggtgtggccgctggaagagaaggtgggagggggaagggaggctatctgctgctgcggtggccacaagtttccgccgacttggcgtgcgcgctcctgcagtagacgacaaacgttggcttgtgttttgtggggtcaagttggatgtgcgtcaatgttggatggctatcggcacgcaccgtacgtggtgcgtctttgagcacagtcgtaatgtggaatttttgtccattttctatgttttattttatgagagcctggtatttgctctaggaaaatgcttgtttcttgttactcatatttttagcttctattttttgagttgtgaaaaggttgatttctcaagtataaaaatttggagtagataatactagtgcctatgtattatggaggggaacataaaatacagggcatgtttactttgacgccattttcaaccttactaaattttggcattgccaaaattttagcatagttttcaaaattttggcaacttaccaaaattttggcatgatttcttatatagttacaaaaatttagcggcaaactaaatgtagccacttttttttgacaactttaccaaaatttggtaaggttgaaaatggcattaaagtgaacaggcccacaatagactcgtataaattctgacaatcaacatccaccgcaaattagatccgtgcatgtaaaatctcttaatgacaagaagagctaacttcccacttgaatcacacattgatattacaagaaacatgacaaagggatgacttctaatagtttgataagttgagggataggtttttacaagttcaaaaatagagataaggtaatcaaactatgtcaagagttaacatataagaataggcattatcctttgaaataaaatcatcataaaactattatggaatttgtgcgcttagtagagatttgccgtatatccacaattgtctgcatgcgggattttagcatacagtattttctatccacttttattatattgcatggtaggagcaatttaaatactatttagaaattttaaaaaaaaacatcactttctttcttagatttatttttactggtgtgaagacactgaaaactatgcgagtgatttctaggtcattctcctatgcactccatgatttagggggaaatatcctccaaatttgtccaaagtagtactccctccatttcacattatgacattataagtcatttttgactttttttcttagtcaatttttaaaaatttgaccaaatttatgtaaaaaaattagcaacatctaaaataccaaagttggtttttattaaaactaacatttgatatattttaataatgtatttgttttatgttgaaaatttcgctatatttttctataaacttagtcaaacttcaaaaaattgattagaaaaaaatagtcaaagcgacttataatttggagtataattttaatttaccccaaattaaaaacaataccatgcctaaaatggctacacaaacataatcactcccccctggcccccaattgcacctagtattgacaaactagcactaactcccgccatattaacgttgctgtgcctcactccaattcccctctcctatatcaaaaggagagattaatctatagttgaataaggtcggcatgaaaaaaaaatataaacaagaaataaaagtgctactttgatgaaccctcacatgtgcaaaatctttcctcagcacaatggtttaggagaattgccgaagttgataaatttactaccacatctttcctcgaagcttatattatgcatgaaacattgccagggataacatgatgtttcattcaatcttttatatattttttttgtcaattgtcatatttaatttgctgggtatttcttagagtgggtcaagaagtacccacagatgaggacacaccacctatgtgtgcaaagtacttaaaatgcccaagcaagacaaccttagacggttttattgatgatacgagtataacaatgccaaatgtagccttttgcggattaacttcacgagtaactccatttaagtaataaaaaagagagacttgaaatatcattgaccggagaaggtgtgacttgaaactaatgcatgaattgccatatctagaatatttaaagatatgctattagaccaacaatatgccagatatgcaattttgacaattttcgttcgaaattcacatgttttgagccatgtcaaaacaagatttagcgggacaattttaacaaaattggaaaagttcaaatttcaaatgcgaagtgcaaaaaaaaaatccctatgaagggtatgatgtttgtttttttttaaaaaaatagaatttagatgcgattttggacccctatctattgggaatttcctttagaaaggagaaggattcatgggcaaaaagatgatgaatcttcagcccattgagctcattttagacggaattaataatgtgtgttgatggactttacattatgttgcgataaaatgtggatgttatggacttgaaattgttgtgtacttgtgttgatgaaaatacattgtacattgatctgtcttcaaaattaggttttccaaatgatacaagggtcatgccacagtttttcattaattttttgctatttttgcccatcttccctacatattctaatagttttcaccacttcccaatcaatttctccagtattgcatcttccattcatattctacattcaagcatttgtatatgcgtttgttctatttctagtccaaaacaaattcaatgaatctcgtacaaatggaatggattccaattaattaactttgaatgcattccattctaattttagaagttatacagagttcaaattcaaattttggtttgcgaacttcctttggattttgtttgagccaagatgatgtggtaccactgttcatggtgtgataataacaatttgccatcccaccacgagtcatgccacgatttcttttatcggtatcacaacattgctagaaatatgtttttaagaatttaattaattagagttagtacgattttttttaattttctatacttaccacattttgctgttcacatgaatttcatccaatcaaaaaaaaaacacatttactatagtcacttctttccttccaattcaaatgtgagtgtaatcggagcaaaacttgaaccagagtcactaagcccgtgaccctttttttctctttacaccccacgtgccagaatcttcagtgtcaaacaacccagaaaagctcccttaatccaaatctctaaccccccacgctaaaaaaagcagggaattccccagcaggcaaggcagcctcatcactcaaccgattactatttgatttgataataataaaaaaacaaacagaaaagaagaaaagaaaatcatccgatagcctctcctctccccccttcccctctctttcgataaagcctccggagggcaccggagggcgtcgaccaccaccaccaccaacccccatccatggcgtccctcgccgccttccatccggccgcgccccgcgccggggcgcaccacccgcgccgcccaacccggccaccggcctcctccgcctccgcctccccgcacccccgcgccggagggcccgcgccgccccgcgcctcgcggtctccgcctcctccgcgggcgcgggcgccgcgtcgccctccccggccgcggggtggggccggtccgacgcggcgtcgtcgctggagcggtgcctcgccgcgtccgggtccgccgcgccggcctcggcgcccacccgcgccccgccggcgatgaagggtgggaagcagtacgggtcgttcggcgccgtcacgctcgagcggaaggtcgacctctccaagggacggaagaagatcacgcccgaggtagggtggctaatcatcatcatcatcatcatcctcatccttttcagagataggtttagggggttcgggagataagatagccttcgtgttgttctgaattggatggtagagaggtgaggatatcaatctaaattcgttttgaaactggatggatggactcgaaggccaaaatataatggataaggtttgatgacgcaatggctcatgtgtggggtttgtagaggattattcatgatatgggagcaatttcctgtttgtatctttcagcagaataatatgttcccctgaatttgcttcgaatagagtactaggccaattactatagacttaatgttatacccaaactcatgttatttctctgactgatgttgatctggtggtaggttgggattcgtataactatcgtatgtccaacttcaccgagtgcttcatttctttgctctagaaaaaaaaagtaccgcaccattttgtttttatgaactagatgaaattatcctgtcatgttgagacaagcttgatgagctgttagcttaataagtcagttctgtatgcatatgtatatttttactttgaaggcaaaatatctgttattccatcgtactgccatattaatttgtgagtttgatgactggattgcatatattcatcatatgcctcttcttttaaaatgttgcagctggcaacaggt

SEQ ID NO: 46784 - DNA, 2477 bp, Oryza sativa
atgatgattactttgatgattttgatgatggcgacgaagaagaaggtggcctttttcggagacgaattgtcattcaggaggtgaaatcctaaatatttataatcaaatacatttatttctaaatactggaaaatattgaaacctatgtgctgattatttcttcttccattgtaccagcttttcaatagagagtttgtggatgctgtgatgcaagagtggtgtaaaacgatgagtaatttgcctgctggtctccgccaagcttatgagatggtaagatttcatcttttgtttctcatggcatactttggtaccaaagactgaattgcattgactgatcatgatatatgttatctagggtttggtaagttctgcccagatggtccgatatttggcgatatttgcaaggcctactcattctaggtccttctcacgagctcttcctggatggctttccagaggtcttgttggaaggtaacagctagatgtccacacttagtttcttgtctactacattgtgtatgttttttgcatataatatttttttggcattcattcatatgccttctaaggcataattcatgttgtaacaggcataaattaccttgttgtactatgattagattgctaatattttcttggttgcacattttgctgcaaggaatatacagagagaaaagagataacctcactatttctaggtttattcatataccttttttgttgtaatgccccaaccacccaatttgtgagaagtttcgtttaccagtcaaactacgaaaataatatttttgtatataccaccggaacaatgtttcagcttgctgcttcatgccacactgcaccagctgaacatctggggaattagttaccaaggaccacatgttgaaacattgaccagagtgggaagctctttgaaacaccaaaatggaagtcttttccctctataccatatccgttctattccacagctgtgaccgtaactcatcattgtttcctccaaattccacatcttgcttgccccgtgcaacatgactgctagctatttctcaggtggcaccccttagaagaatgctggcatggatcccatgtatagacatggacttgcctcagcaccatcacctgtgcctatgtgggagagcatagagtatggtttggcacaatcagaacaggactaggggtggttgatctcatttgaagtagggtgcaccttgccatctgcacgtttctgttatccatggcattgtgatgtacttgttgatgctattccacttctagttgcacctttccatagtacaccactgaccattatacagacctcacctctgccatggcgtgcggaagataggtaacatgctgcagattttgcttagtagggaagcattgataggatgtatatctagaattcgttgtggaggtgggataaagctttcattgagtacaggcggcatgaatactattggcaacatgtgcagtgggcaaccttaacattttaactcaaccccgcatggtttatttgcctagctggtggaaagtgccatcaagcagcagttttagtcattccagtggtatatacaaaaatgtgtttagcgactgcatatgcaaaaagcagctaatttctaacagtatgtgcaaaatctgctctcatgaactaatgaatcagagtggaggtttattttagtgtttatacttttaacgtcagtcctgcagtatattgtctgttcctatgtattcctggaagtcttgtgctcatattttgtcgatagtagccacacagtttctgtcttaaatgatatggagtatcattgttcaatattttactgaacaaaaagaatggcaagcaaaaactattgataacaatagatgtaggggtaaaccttgatgtgctcttagctgtatatgctctttattttaaagaaatcttttctcatcatgtaattatttacatcattttaatttactcatgctcattgaatggccttcatagctgaaacaaaagaagcttattttaaataaaagtttggggaagggccaatataacatatttggaatatgaaagataaacaaatatgtagtagcttgggtggcactataacttatttgaagatgataggtgacacctagctctctttgcctcattttgtttgagggaggggtgttttatgctggcagtaggaatggagatttagttatttggacttaaatgcaagccagaaagcaaagttgagatgttcccctcctttattagaaaagcgtgttcatgaatactgtctcaagaagtgctttttcttcttatttggttttatgattgaaatgactgaagttggtaaccataattttggttccatctatataggatatatagatttatcacttagcttgtaggttttctgaatttaaaaccaaactgtaacatatttcttgttttggtaccttaagaagtcttaacttccaactttatatcaagcttagcttgtatt

SEQ ID NO: 46785 - DNA, 18397 bp, Oryza sativa
  unsure (1)..(18397): unsure at all n locations
gtatatggttttaggttatgcctttgaaatttagggattgttaactgtcccctgatatatgtactattcttgtgagaaatgcttgttgaatttctttatttagtgataaatcgtatgctcatgaccttccacagttgggttgtggttagagttcataattatggatatggctgtggctgcataacgactatgtgaacttttcagcagtgctttgtttgtatcttgagttgttgactaaaagttgtatataggagctaattgtgtatgctagataatttgatcttcattatgcccttgtttagatccaaactttttcttcaaacttccaacttttccatcacatcaaaacacataaacttccaacttttccgtcacatcgttccaatttcaaccaaacttccaattttggcgtgaactaaacacaccctatattataattcactttaattttaacagttgcatatttctgtaataattgctttctttaataattccatcggttcacactatttctattgcccgtgttccagtcttccaggagtgttttaattgcattttatgggggccacactcttgtcactaatcctggtgccatttgtattgcagattgacgaatattcagattggtgaatcatcgagacgcacatggcttggggaggaagctgatccacagtactcagatcggctgctgagagcatataaaagaccagtcgaggttgctggagaccaacaagattcaaggtggtttatatcgaaggatgcgattgtatctggccttggtcttctcggcatcaagcaaggtggaacagaagctgcattgtccaagccccgcaggaagagagttgtccgaaagaaagttgcctcaacctgaatttagttggatgttgtctaatgctggaacaattttgctttagttccactacgccgtattgagttctacccagcaaggcgaacgagggaaaccgtagttggcagccagccttgcagtctgtcgtggaaggcatcgaagcggtggtggtggtcataactgggagggttcagaactggaggccctttaccattttgtatcttttttcttctcgctttctgataagaattgacatcccaatttcttgtactgttgtgagccaagtagactcggcatagttgtagtcctggagattgttaaagatacagtcgttaatatgagcaaaaccattccatttttgatttaggtcatgtagttgcccgatgtattgcttgtagcattacaaagttggatgcctctttatcgtcagatccaagtggtgtatcctggaagcattatgggctttatagccgtccgtttaattgatgtttgctgtaaaatgtattactagttgtgtcaacatcatcgacgagcgaactggaaatttaggggatgtttggtcgacgattaacatggtcaaaccttacattaggggatgtttggtcgacgattaacatagtcaaaccttacattaggcaagcttaactaagaaattctgtctttgaaaattagtatggttagccataagcccatagtaatagtaactaaacaacctaagaaattgttatctgcctaaggtttatcttggcaagttgatgcatctaaccaaataatactccattttgatcaaaagtcaagagggagtacacccttaataccccacgtgttatgagctatctaaatgtctaacatagacaaatgtttaagttgtatttaactaaaatttaaaatcttaaatcaataatactattgaaatttgatatgtaaaaataacatgaacatatttgtcacataggttatttccattaatttttattaatctatgttcgaaaaagtagtgataatgtggggacaaaagaatattttaattttcttttgttgttccaatcatgtgcctcatcatataaatttgaaattgagttaaatccgatatatcccccctcaactatgtgaaaattatgatttacccctctttagctacaaaaccagacactttatataaacaaccttgcagactaggcaaatcaccctatcctagtaaagagcggttctcaatcctacacgaaacacttacggcaatatagtttataaactatcaaagaaaacgctcgaaaaagatctagtccactcacatgttagtctaaaacatttcttcaataaatttcaaacttaccagatttcatgtgttttgtgataacactccgtgcatgtggatacaatgagataaatgtaacaacttctaaaagggcctcaattaatataaagaaatgtgtgtactcaaaatctggatgcacacaaaacataggctgaataaaagcttttgcttgctccgcaaaagaagaagaacaaacctcgtcaagaaagtgttagcatgccagtaattagctttattatcttagtggaacagaataaccatgatgtcggtgacacattttctaacaaaagcttagcgatcgacattcgacaagaaggctattggccacaaaagtagtatatgtgtcagacttattcagctgttggacacaattatggctgttggtgaaagctgcagatattgtacaccacgaatcgtttacaaatctgcccaagttcactatacaatcccttcaataaaaaggtttattatataaaatggtcattaactaatatagcttaaggtataaaattgttggaattaatagatgggctaaggcccactcgaagattatttctttggaaaatcataaaagcccccctcatgggatggcgtgcatgaggagtttagtaccactttgcttatcctaagagagggggacctccttaaaagggagaatgccctcctacccacttgaagcatgtgtggtggagagaagaggggaaacacatgcgcactcgcctcgtctggcaggcgcgcgtgcaagacgtacgcgtcatgttacgcatcgaatggtccgtaaaattggctcctcacccttgcgcagatgcagcttccttttacagttttgttttgctgcgggaaatttcgggaaaaatccggtgcgtgaaaatggcgtggagtctggataagttacacgcgacttatgttgttcggttacgcggagtggagatcgtgcgggcgccctaatcaagcgacctatctctatataaaccgagccgccgcctacacgcaacacacgcaaaatcaatctagggtttgcctcctaatctgtgctgcgccgtcgctcgtagactactccatcccgctcgccggcgtgcaccggcgatcgggcgagcaggtctccaaaacctctgccttcgacgtcctgcatcgggagaaggcggtaataaggtttttgggaagcgcttcgtgtgactgctccctgttcgtccgcgacggctcgccttcctcttcgctcgcgtgctgcgcgcctttgtcgacgcctgcaaccgcaagtagttcctgccgagcaactggtctttctgccatctcggtacgtgttcgacatgttacgtatatttgatctgttcatgttttattgcttagtttacatgtgtagatctaatgatgtgttcatgctagtttacatctgcaatgtcatgatttatttatggaataaattaaatcattatgtgcttataatttcaacaaaaattagtacaactacaaaataaatataaattctaaatgttacatgtacaaataaagctaaattataaacattaaatcaacaaatctgatcatgttttctaattaatttctacccatgtatttcatatgtcaagattgtcatggtggaagaacttttgagatccatgttctacttgtgcgtaattaggaaataaagtatttaaaattgaaataagaaggcagtggtgagtaatgagtataaaagtattcagcaaggaaaaataatagaagaatagaaacctagaataaatatgaaagggcaatgaataaaggtggtgtttgaatatctgaacatgaagatggagataatgattaagtgtttcacgtaaaacgagatgataataacgtatgattaattgagttttaatcattacaaacttaaaaaaatggattaatctaatattttagaacttttatatataaagttttcgcacgaaatacactgtttagcagtttgaaaagcgtgccaacttttatccaaaacgggaccaaagtttattttttatgaacattgattttgttaaaaatatatagattggctactgaacgtactttcaattatctgcagaagccagaaccttccacaaacataagtttaaattcagaaaccaaatagtgatgatcacattttctttcatttgtacaggggttctattttacccacgatatgtagcggcagagccaccatcctggctagctcactagtccatgcacaatagaatttttgcttacacgtagttagatttgtctgagctctaaagttttcctgaatataccactacaaacatataatatatcaatacgcccgcttttaggctacttgacaaacatgcttcactcagcctatccaatttttgtactgttcttaatacactgaggtacatagtaaggaagcatgtgaaaatggttattaacctttccttataaaccatatgcacatgattatgctttaactgcacatttggttggatgtagaggctggttttacccatttccctaaaaaaaaaactgatacacgcagccaacgcatcctctaccagccataaaatgtgttcggacattcccttgttcaaactccaagcacaatggctaatttccagcatttgtttaaaaaataagtttcaggcagattattgttataacacctattagctgcaaatcattttctaaaaaataggacatcaacatgatcaaggtatcagtggattcccaattaacatgtaactgattatatttctcccacgatttacaatacatgatatcaaaatccatattaacgttgaaaccagaaatcgtaataaaaccctacctttgctccctccacccttttcttccttttctcctcctcctcttatttccttttcctttttcctcttcttctgatcttctcttttgttccacttcttttccttttctctcctcctggtactagctgttggaattaatagatgggctaaggcccattcgaagattaattctttggaaaatcacataagcccaccttatgggatggcatgcatgtggagtttagtaccaccttacttattctaggagagggggacctccttaaaagggaggatgccctcctaaccacttgaagcatgtgtggtggagagaagagggggaacacgcgctcgcctcgcctcgccgggcagggcaagcggcgcgcttgcatgacgtacgcgtcgaatggtccgcaaaattgggttggcatcccctcacccttgcgcagatgcagcctccttttgcagttttgttttgttgttggaaacattccgaaaaatccggtgcgtgaaaacggcgtggagtccggataagttacgcgcgacttttccggttcggttacgcggagtggagatcgtgcgggcgccctgatcaagcaacctatctctatataaaccgagctgccgccttcacacaacacacgtgaaatcaatctagggtttgcctcctactctgtactgcgccgtcgctcgtagactactccatcccgctcgccggcgtgcactagcgatcgggagagcaggtctccgaaacctctgccttcgatgtcctgcaccgggagaaggcggcaataaggtttttgggaagcgcttcgcgcgactgctccctgttcgtccgcgacggctcgccttcctctccgctcgcgtgcttcgcgccttcgtcgatgctcgtaaccgcgagtagttcctgccgagcaaccggtctttccgccacctcggtacgtgttcgacatgttgtgcatatttgatctgttcatgttttactacttagtttacatgtgtagatctaatgatgcgttaatattagtatacatctgtaatgtcatgatttatttatggaatatattaaattattatatgcctatattctcaacaatccaaaaaccttattataggcgctgtgattttactatggttggttttgccgatgcactgaggccagataaattcaccggtgtgcactttaagagatggcagatcagggtcactctgtggctgacagctatgaaatgcttctgggtgagtactggcaagcctatcggcgttcttaatgctgatcagcagaaagaattcgatgaggccactactctctttgtgggatgcattcttagcgtgcttagcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcaaacaggctcatgagatacaaaccatggctaaggaactcgaactccttaagtgtgtcttacccgataaatttgtggccgggtgcattattgcgaaactacctccatcttggagaggtttcggtactgcactcaaacacaagagacaggaatactccgttgaggggttgatagcgtctcttgatgttgaggagaaagctcgggaaaaagacgtcgcgtctaagggcgatggtgggcagtcgagtgccaatgttgtgtacaaggcccagaacaagagcaaggggaaatacaaagctcaatagaccaccaacttcaagaagcagaagaagaacaacaacaatcctaactaggatgagaggacttgctttgtgtgtgggcaacctggtcatatggctaggaagtgtccacagcgcaaggggatgaaggcacctgcagggcagacttctaagtctgctaatgtgaccattggcaacactggagatggaagcgggtatggtaatttacctactgttttttcagttaatcagtctactaattggtgggttgatactgggccaatgtacatgtttgtgctgacatctcattgttttcttcttatcaggtcacacggggttccaccatcctaatggggaatgggtcacatgcttctgttcatggtgttggcacggtagatctgaagtttacttcgggaaagatcgtgtagctgaagaacgtacagcatgtcccttctatcgacaggaatcttgttagtggctcccgtctgactagagacggatttaagttcgtttttgagtctaataaagtagtcgtgtctaaacatggatattttattggtaaaggttatgagtgcggtggcctgttccgcttttccctttctgatttctgcaataagtctgtgaaccatatttgtggcagtgtggatgatgaggctaatgtttggcactcacgtttatgtcatattaattttggcttgatgtctcggcttttcagcatgtgtttaattcctaagttttccattgtcaaaggttctaagtgccatagttatgtgcaatcgaagcaacctcgcaagcctcacaaggctaccgaggagagaaacttggcaccactagaactcctacattcagatctttgtgaaatgaatggggtgttgacgaagggttgaaaacgatatttcatgacgttgattgatgatgctactagattttgctatgtgtacttgttgaaaacgaaagatgaggctctagactattttaaaatttataaggtagaagttgaaaatcaacttgacagaaagataaaaagacttaggtctgatcgtggtggagagtttttctcaaacgagtttgacttattctgtgaggaacatgtcattatacatgagaggacgcctccctattctcccgagtctaatgggattgctgaaaggaagaaccgcacactgaccgacttggtgaatgccatgttggacaccgtgggactacctaaggcatggtgggggacgcattgttgacctcgaatcatgtgttaaatagagttcctaacagaaataaggacaaaacagcatatgagatatggattgggagaaaaccatcactttcttacttgcgcacatgggggtgcttggtgaaagtcaatgtaccaataacgaagaagcgcaaacttggacctaagactgtggactgtgtctttctaggatatgctcaccatagcattgcatatagatttttaatagttaaatctgaggtatctgacatgcatgttggtataattatggagtctcgtgatgctaccttctttgagagctttttcccaatgaaggatacacatagtagttctagccaaccctctgaaataattcccaattcaatcacaccaccagaacaaactgaacatacacatgaacatgtcactgaggaggatgacagtgaagctcctcgaaggagcaagagacaaaggacggctaagtcttttggtgatgattttactgtgtatctcatggatgacactcctaagtcaatttcagaagcatacgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagctcaggcctgacggtactattgaaaagtacaaggctcggctggttgctaagggctatactcagaaagaaggcgaagatttctttgacacttactcacctgttgctagattgaccacaattcatgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattctgtgcttgtatgttgatgacatactgatatttgggataaatcttgaggtgataaataaggttaaatcattcttgtctcaaaattttgatatgaaggatttgggagtagctgatgttattttaaacattaagctaattagaggtgagaataggattatactcttgtagtcccattatgtggagaagatcttgaatcgctttggctacattgatagtaagccttctccaacaccttatgatcctagcttgttgcttcgcaagaacaagagaattgctaggaatcaactgcaatactcccaaatcattggctcgctgatgtacctggctagtgcaactaggcctgatatctcctttgctgtgagcaagttgagccggtttacctctaatccgggagatgatcactggcatgcgcttgagcgaataatgcgctatctgaaaggtactatagaattggggcttcactattctgggtatcctgcggtactggggggatattgtgattctaatcggatctctgatgtggatgagatcaaagccactagtggatatgtcttcacactgggtggtggtgctgtttcgtggaggtcttgcaaacagaccattttgacgaggtcaaccatggaagcagaactgatggcactggatactgctactattgaggcagaatggctgcgtgatctattaatggatctgcttattgttgaaaaaccggtgccggctatccttatgaactgtgacaatcaaacggtaattgtcaaagtgaatagttctaaggataatatgaaatcgtctagacatgtgaaaagacaattgaagtctgtcaggaaattgagaaactccggagttataacgttggattacatccaaacagctagaaacctggcagatcccttcacaaagggactatcacgaaatgtgatagacaatgcatcgaaggagatgggtttgagacccatgtgagttatactatggaggtaacccagtctatgtgatcggagatcccgtgaattagaacctgggaagaacaaaccattagtaaactagaggagagtaccaatctataccctctctaagtgaagatgcatgtactcttgtgagctgcaaggcaggttggctatgccttaatgagttctgttggctttaattagcgaagatgctgttcagcagagcattcttgaaagaactcacctttgtaagcttgactgttggtcgcagtctatgaagattttaggtgaatcttctaggaagcttactaaagacctagcagtatgacttatacgctccacccgaggggtagtatatagacggtctagtaataaataagactctgagtaaaacttgcttgcacaagacttgcaattcaaggcgtagtccattgttcaagttgtgagtaagtgtagcttggagttctaggtggatgttcaaccttaatcggtctccatcgtaccgctggtatataaacagtacattggaaaaggcaaatctcagtgggattttgagatttggtgggggattgttggaattaatagatgggctaaggcccattcgaagattaattctttagaaaatcacaaaagcccacctcatggattgcatgcatgtggagtttagtaccaccttgcttattctaggagagggggacctccttaaaagggacgatgccctcctaaccacttgaagcatgtgtggtggagagaagagggggaacacatgcgcgcgctcgcctcgccttgcctcgcctggcagggcagggccggcggcacgcgtgcacgacgtacgcgttgaatggtccgcaaaattgactcctcacccttgcgcagatgtagcctccttatgctgttttgtattgctgcaggaaaattcggatttgttctgttgttggaaacattccgaaaaatccggtgcgtgaaaacagcgtggagtccggataagttacgcgcgacttatccggttcggttacgcggagtggagatcatgcgggcgccctgatcaagcgacctatctttatataaactgagccaccggcttcacgcaacacacgtgaaatcaatctagggtttgcctccctactctgtactgcgccgtcgctcatagactactccatcccgctcgccggcgtgcaccggcgatcgggagagcaggtctccggaacctttgccttcgacgtgctgcaccgggagaaggcggcaataaggtttttgggaagcgcttcacgcgactgcttcctattcgtccgcgacggctcgttttcctctccgcacgtgtgcttcgcgccttcgtcgacgctcgcaaccgcgagtagttcctgccgagcaaccggtctttccgccacctcggtacgtgttcgacatgttgcgcatatttgatctattcatgttttactgcttagtttacatgtgtagatctaatgatgcgttaatgttagtatacatctgtaattacatgatttatttatggaatatattaaatcattatatgcctatgttctcaacactagctgcacatgctcctccctattgccctcctcgccccttctttcttcttatgcttgggcatgcaatttttatccgctattaggtatgcattgttccacatatatttgactagaagtgcatctcctctcctgtactagtttgtgcaggatagaaaaatgtagcgcacatttggttctctaccttaccaatttataggtagtaccaacatctagacaaattttggcactatcaatcttttggtaggacaatgttaactaatattttcgaaaatagttcaaatcgtttggtaggataatgttagctaaatttttatagctcaactagttagctaaacattatttttggaaataggcctttgaatccaagtgagaaagtttcaccataaagaatctaactagttgagctatgctcattacgcataagctaatattcccaacagtaaaaataaaatcataagaatcaagggtttgagatttattttgtactcgtaggaaagacgaaagagaaagagaaaaagaaaaaggaaaatatgaaagaaaaaaacattagaggaaaatggaaaaggaggaaaaggaaaaggaaaagggaaaagagaaaacaagaagaaacaagaaaaacgatattaatagaaacaaaatttgtgggaaatcgtcagaaaaaatgataacaaagttttgaataatcaattagtcaaactaaaactattgttttgagatttttgttaagctagaagtaaatgaaacgaacaatatttttataatgttgcaaagctgaaacttagaaaaccaggatacgatggacaatacctttagaaaaaaacaaaccataatatgatggacggtacctttagaaaaaaaatatggtatcgactgtggccctaaaggatgtagggtaaaagtattaatacatactttactcccttcatcccaaaatgtactagattggacacaatctgacagtccatattctatgtttagacggagggagtaacacttttttgcactcaagtagtatgagtacttccagtggtgaactagaatgaaaatgaccaggggtccttttagtattgttttctacacacagggtaatatatatacaatacgatactacctatatcttaaaatatataaggaattatacctatatatctggacaaaaaaaatttaagacatagttagtatatagtaataacaatatatagtatttaacttaagagtcataaaggtgcagtaacttagcgccttagcttatgccttagcttattgaaatagcgatcgatcttacataaatgcacaagaaaggggaaacagattctaatcccttgagtgatgtcccttgacacctttttcttccaaattcaatgaaaggttatttttttaaaaaaaatattaataatatatagttagcaacgcctatcactccaaaaaacaagtttaaattcgacctacacattaaaaaaagataatctagatagaatagtaccactattatttatatggtgaatttatctttttaatatattctgagttgtgtttgtactaactttgtgaggtggtatatatatgttgtacgaatgtcgccaagtattttagaatattttaaacaaacgggaaattttcaccacaagttagtccgttaccccactatgcaattaggttcatccagattttgctttgttgtctatttgtcctctcatccaccagcgagtaagtcggtggggatgtgaaacaaaggccctgtttgtttcagtttaagattgttgtaatccagattattaaatcagattactctaaagttgaattataataagctacgagttatttatttctcaagattattggaggcatttaagggtagtgggtctttagccactcaataatctggaaaaagctcctccagaggagattattagattatactaatctggcttatagattatacttcctccgtttcatattataagactttctagcattgtccatattcatatagatgttaatgaatctagacatatatacgtatccagattcattaacatctatacgaatgtgagcaatactagaaagtcttataatatggaaaggagggagtaataatcaatcataataatctacttgtttgtttcaacttactcctaataatccagattataataatcctaaattgaatcaaacagggccttagagtatccatggatgctggatgggttggagaagaaggctttatcaaatttaattgcaattttcttttatggtatggtcagatataagatgccctaggcgactttgttaaaaaaagaaggtcagttaccccactaaaaaatatgacaagattacaaatgacagtgcagagactaatgaactttggaatatgcttttttcctctttgccgtggcccaaaagagactgagagccaatgtttttattctggggcattttactatttgccactctttgatgtggcatttaactctttgccactcatatatttatgacatgtgcacgtcaatgtatctatgacatatgggttcagctagaaaattattaaacaccatatctaaagtagcaaatagttaaatatctacttcctctatcccaaaatataagcatatttagctatgatttatagccaaaagttattacattttgagacggaggtagtatttatcttttcttgagaaaaggtattacatggagctttgaacgaaaccataacaggatgacaggcccaaatgttggcagacccttgtttgagcaactatataagaagtctgcccctcggattgcacttgaatccatccaaacaccccaccttaattcacgtcatccaacattggaaatggcgaaccgagaggagccttattctaccactggcggcactgctgcaaaagctcctccggtggcgatggacgccaaactgctgatggcggaatgccctgaagatcgcaaacttctcaaggagcttgtgcacaaggaagacgcttcgaagatgatggtggttttggcgtcaaccaccaaccagcctgctgcagagaagcctgcggcagcccgtgcagtaatgaatccgctgctgctagcagcagcatcctttggtgcttgcgaggttttctactttcttttctgcagagaagacgcacgagagccgctgccgacaatgacggctcgtgcatttcacgccatgcttgctggggacgcctccggcgccgatgggcggtggccgtcgacccatcagcaagctctcgacgaagtagaagaaggcggcgccggtgccgccgttgccgttggtcatcagtccactcgacggctaccaccacctgacgcgccgctcctggagggcatcaccgttgaaggtgacaccgcgctgcacgtggtggccacccatggtaacgccgccaacttcttggagtgcgctgaaatcatctgcaacagagccagacgcctactgttggcgactaacgacaagggtgacacggccctgcattgcgctgccagggccaggaggttggagatggcctctcgtctcattgctctagccaaagctagggaagaccacgaagtcgaacgtggccaagcagcatcgtttggcaaggtactcctgagaactgaaaatgagcgcaatgaaacagccttgcatgatgcagttcgcgccggagatggtgacatggtccggcggctaatggacgaggacccagatttggctttgtttccagtacagggcacttcacccttgtacctggctatctctctacggaatggcactattgctgagatactacatgagaagagcaatgggaatatatcctactccggaccacatggacaaaatgcactacatgctgctgttcttcttcgacatacaggtatactcgcttcacaattaattccatgttccttttggaccttatactttctagaaaaagtgttttcatctctcgagagaatatctccacacatgaaagcaaaatttaactcatacaagttgtaacaaaaataacaaatataactacaagtgtacgataactattttcgatttaatttgttctttttgttgtaacatgcagaaatttaattcggtcttgaatatttgtggagtgatatatttcatattaatctatgtagttattttttaattaattttttaataactatttagatgacatgcaagcaacgaggggacatcccctcaagggataaaaatccacatcattactttctcagggatgaaaatccacatcattactttctcgctcattggttgttaatttctctgcaaatgaagttgtgtgtcgcttgctgtccccatatatatatttccacaacccttgaaaaaaagctctcttgtgtctatgttttttttttttagtttcctaacaagtttttcctgtcgtaattctacagaagttgccaacttcaaagcagaaattagtttttcttttacctaatcttgtgattacttagtgtctaaaatgttcttccatttacagcggtgttagaactactattgaaatggaacagccaccttacaaaacaaggagacgaaaatgggagtacacctgttcattttgccgcatcttttcctctatggcatcgaaaattccattggagacatccttggattattcgtgttccccatagtctctcgatgttgttaaacactggtgaggtagatccattctatcaatccgacaagaatggaatgtttcccgtacacgtcgctgctgccgtgggggcagaacttaccgtcgcttttttgctcgacaagttcccaacagcgcgggtttgcgtgatgccaagggaaggcattcctctatgtcgcagttgagaaacagagtttagctgttgttaggttcgcttgccggactacgtcgttacagtggattttgaacatgcaagacaaggatggcaacactgcactgcaccttgctatccaggccaatcaccatcgattgttttgtgctcttttagggaatcctcaagtcaatttagatttaacaaatcatagtgggcatactcctctcgatttgtccagaaggatgcttcccagagggatgaaatatacggcggtacgtacgtatagcatgcatgaaatttcctttattatttcaaacctttgccattcgaagcaaatttacaaatgataacacatggtaatatacaaactcaacattcctctttttcatatagaacactgaggagctcatatatttgacactcaaacaagttggctctgaacactatcacgatcgccgggatcacatcgaagaaatctatagccgtcgtgtggtatcaaaagaggatctggccgaagaattagacaagatgcaagaatcgacacaaacactaggcattggttcggttctaattgtgactgtgacgtttggtgcaatgtttgctcttcctggaggatatagagctgatgatcacccttatggaggcacaccaacattttctgggaggtatgcttttcatgcattcatgatggctaatacgttagcattcatttgctcgtcaatagctaccatcggtctcatgtactcaggatcttctatggttaacttgcggacaaggcaatataactttgggataaccgcatttctcatgaccaattcagtcacaagcttgacaattgcctttgcacttgttgcttatatggtgctagctcccgttgatcataaaactgcagttgtaatctgtgtcttgagtcctcttgttgtaatatatatcaacatcgattcttggataaaattggctgttattgaacaatcgctaggcagtagaatggggttacgttcgacaccgccaagggtcatacggatgatgctatgtaatcttttatttcaattttggccattcatagtcatctttagttttagttggattgtatataaaaggacagccacacacctttgatgtgaccaagcatcaaaatgtttatagggataggatttgcgtacgtgcattcataggggtgagtgtgtgtgttgtgagtgtctgtgttatactgtgtaattctgaaaataggtggtagtcccacaagaaatggagtcatcattgttttcttttatggcgacaatgttttcactcaaccatactgaagatccgaatacagtcatcaaactatgtccattcacaaatattttttaattatggcgtatgttgcatttgttgaagataaaacctacgtaaactagtggatccatttgtacattttgattactttcaaccttgaagtcttaattattattgcccacatatatctctattattataaaaattaaatatgtttttgccggtattttggtacgtcatccgtatatgagtcggtttttaagttcgtttgcttttagaaatacatatccgtatttgagttggtttttaatatgtttcacttttggtaatacaaaaggaaccatataagaaatctgtttaaaaaaactcgcatgctaacttgacacgatcggattcctagttgcagctcatgattttctaaaaaaaaatatatatatatccaagcgaactcacggagtgaatttcatcttaattaaaccatataacaataataagattaaaatagacttcacccgttacaatgcacgggtattttttcatatatatatatatatatatatatgtatatatatatatgtatatatatatatatgtatatgtatatgtatatatgtacacacacacatatatatatatatatatatatatgtatatgtatatatgtgtgtgtatgtatatgtatatgtatgtatatatatatgtatatatatatatacacacatatatatatgtatatatacgtatacatatctatatgtatatgtatatatatgtatatgtatagctgnatatatatatatatacacacatatatatatgt

SEQ ID NO: 46786 - DNA, 2975 bp, Oryza sativa
agaggacactaaacacagttctagatattgtcctccaggcatacactgcaaaatgctaactggataatccaaagcagcacaacaatatttaggtctcatcctgtaataccaaagttttggcttggtgataaggcaagcaactgtgcccaatatggaatctactttcgaaatttaagtgtgctaattacgaagtgtcttcccatacttctgctattactagacagttgtgcatgaaacctaacatcatagtttgaggtggaagatcatgtctaggaggtatcgtgtttgtagagatactgtgttgggcatggaaaatagctccgaaacaccactaacacctgtttgacgtatggtagtgctttcatgttcagatacagttaattttattgttgcaaattttaaggtggctttgtccctcttcgatgcaaggagttgaagagagatttttataagagaaagtaagaatcaaagagatgatacttaaaaaacaagcagtcaagcagtcatgtgtcgagccaaagtcatcgtattggttctgcttgattcagaatggttacaatgatctttttgaaactacggttctgtggtgcaccaatgaatgattacagttctgtaaaacattattattgaatttatttctaatatttcgtttatattccacatcaatgtcaatctttttggtaacgtgtacctcaacttactacctgtcaacattcatattagggatctataatctgttctgaagctaaaccatcaatattttgttgtataggcagcttgaacaaaatactcaaaaacaaactgtacgatactgaggtaaaaatattcagcatagatggaagccaggcattacattatcatcaataccatcatgaaggtaatggtagtactcataggaaccatcaatcaatgatataattcctccagatactgcagtaaataagaaatgaaaactcattatctccctaaaaaatatccataggatttctaattatgtttaaattaaaatatagagaaattacgaaccaccgctagatggaatctctctgtggacatcccgaagcaatgatgaacctgaactcgatggtggatcacaatgaaaaaaagaaaattattttcaaaatagaagtgtcaagaaacggaaatcaataagcagccattagacagcaccaaattaatttcattaaatccaacattcagcattattgtcatattatacttttttgaagttggaaatgttgatatgtttttctataaacttggtcacacttgaagtcgtttaacttagggcaaaacaaaaacatcgtacattctaaaatggagggagtataacattctaacaacatatacatatcaccataccactttttgatgctttcttatctgtccctcctatggaaaaatttagtgcatttgaaattcgtaataaaggacgatctaagggaagttgtagccgtaagtgcagatttcttctcagttcacctgcaaattaggtaaagttcatgaaatagattatctcgatgcacgctatgctcactggaagtaattacgaattctcaaaaaaatattagcatataaagaaaattgcatactttgcttttcctcaatctccccatatcttgtgtcatatatagttgttactgggattaacagtccaggaggaacaaaatggtacggagaaagctgaaaacaagggcaataaccatttgataaaaaaatattcagaaaaaaacactttgcacctgcaatcaatttaatataaaataccagcgaaatcatattaaatgatgcaaataaattaaaacaaaagatacatgcacggcaacatcctatataccatgcaacctttatcttttacttgttcatttggtattaaaagtccatgttccaaaaaaaccttgataataaaaggaatacatgtgattacataatgtcacacttgtggcatgccttgtacgctttgttcatgacaagtcaaaatcactagatgacgcgaatgttatgataacttccagattgattgtgtttgcagtcattacatagctgacacgagatataagatgtcaaacattcagaacacgactaccatcttttagcacctgagaattatattcaaactagaaacaaattaaacacggcctagaattttacaagttatccttgctacaactcttgttaggtgaattggtggagtcaaaggaacaatgctgctgctgctgcaccatctttaagcattcacactactgctagagcatctccaatgcagtcaacatggttcatcaaaagaagcatatgcgtaacactgtgcacccatctaagagctcaatcttactaaggaagcacaggtggttattccctaatgtccgcacaaactcacaagagtgacttcatgcaggcacggctaaattaaatatgctcctagaatcacatgaagccatgttttgttttgtacactgcacttagattgtaacatgtaaactagcaaatagttgtgcaaaaatgtaatcacgtgcactgcatggaaaaaatatgtgcaattttgtaatatcgctttatttcttttgcacagtgcatgtgatcatattagtgcaaaaaaaaaatcatgtgcacatattctacatttatgatctattttagaacatcctgaaatgcaccaaaaaatttggaagagctgggtgcccttgcggtgaaaagttcttgtggttcgcattccataactgctgctggacagctaattgccttgccaagcgtgggctaacttattatgtacctggggttgttgagttgtgagctctgatacaatagccttcttcataatgctcagctgatcagctaatcctggaataacaagctcagacacagcagcagctacagggaaatctactgaagtgtagcaaagtatatctagcttcaagttgattgctctcaggctagccaatgcaggtgctggcaaaaagaacaagagcatatttact

SEQ ID NO: 46787 - DNA, 5284 bp, Oryza sativa
cctgcgccccagaaaggtgctcacagaatggtacaagaagtctgcatcatcctactatagaatgcaccaaatatgatatatattactaggcattttcaaaacaatataacttcatgtacttcacatttctatacatgtcagtcaggcaatttgaaacataaactttcattgccagatattgaagctaggtatacttaaaatttgatgccttcatgaacaggcgaaaggtaagtgaaccaagctgacaatgtccatactccacattcctcattcgagctccaggaaacatattctcacaagctcaccaagaaataaatttgtatcaaattggaactaacaaccaatcacaacatggaagtattaagttaagtatcaacttatatggcaggtttagttgagtctaagcttacctctcttgtcaatgagaggctcctctttgctgggaagaattttgaacaagatacaatatttgcatcatactcctctgtgcttccatttcgagataaatggggaacagaattcagatcattgccatgcaagataatagaataatgtgattcaccaggagttgttcgtgggccttcgattaggtaagaaacatgaggatctctgagcttagaagctgttgattcaatgagtgaataaaaccttgcttcaatgcctgcaaaaagtgacacaatacataataaacaatttggaaacatttgaataaacatttgccagaatcaaaaccatacaggtgaagtaggcacatctccaactttgacaacacatgaagcaatttggtccttgcattgctaatagtttacttaggtccttctattcatatcatccaatggaagtattccatctgttttattaaatgtaatgtcttcaagtaaactatcatggtgatatttgtgttgtacaaaccatgtgaatattgatcataacaaatacctgcctactgaaatttacccttaacacttcacaatccccacatcccctactccctattaaaaaaaccattcatgcagcttattataccattttgctatgtgaaagataatcataccaaacacaatttgcttgatgacatcaagatatttacagcatgatcgtgctgtacctaagtcttaagatatttacaacatgatcgtgcattcgtgctacatatttcaaataatgcatgcaaagtaagaaccatcatgcttgcactgcaactatcaaaaaggatttcagtctctgaagctcaaggagaggatcgaacaattaccagacgtatcatccgaaggaacatagagcgggagcttcagcagcagctcgcagcggagaaggcatcccttctcccacagcaacctcccgggatcatcctcccacacaacctccgtcacttccaccgcctccaccccgtccccctcagaaacaacaaaccgaatctccccggtgcccaattccacgcagcccccgaccatgccatggctcgccctctccccgtacagcctctccctcaccgcccgggccagctccagcgccccgccggcatccgcgctcccgacgtgcaccgcccccacgatgtcgaaccccctgacgagcaatcccctgatctcctctgcacggaaccacgagattgtcaagcgagagagcgcactggatagatagaggaaggtggcgagtgaggcgagagggttttacctgcttctcgctggagatcgggggaggaggcgccgtcggggagggagcggagggcggcggcgacggtgagaggggggaggaagcgcggggagccgaggagccagcggagggaaggggtgggtggggagacgagggacttcttcgggcagaggaggcggaggagggttggacggcggcgtgatccgccggcggtggcttccatcggcggcacagtcaatacgctgcctcacttcccaactcccaaggctcccaccgtttgctcgccagttgcgtttcggcttgggctttttttggcctacgggcggcacagctatgggcttcttgggactgtctatccatttgttgaatgatcccaaattttttatacccttagatttatatccaacggactataaaagaatggggatatttcgtttctatccttactttgatgtctaatattgattttacccctactttttagggttttcgtttttaccctcacttttttgaactgaatgcttgttttgcccctactttggatggtgaagttaacggtgttaagtaattgataaaatgatatttataccctcttatgtatgtacattaaatatgttttttacccattttatacatgtagatttggaactttatttttgggagtatatttaaaattagatgacacacattgactaatataacaatttggacaaattatgaatttgatggaattttgacaaaatttcagcattttgatagaacttaaacaaaattttgacaacattttgtaaaatgtaattatctgttccctttaaatattagtcaatgtgcttcatttaattttaaatatactcaaaaaataaagttctaaagctatatgcataaaatggggacaaaaacacaattaatgaacatatatgagagggtataaatattattttgtcaattacttaacaccgttaacttcactatccaaagtaggggcaaaacaagcgttcagtttaaaaaagtgagggtaaaaataaaaaccctaaaaagtaggggtaaaatcaatattagatatcaaagtaggggcagaaacaaaattatccctaaaagaatatagagtaaatttcacaaaactacatgtttcatggttcaagttgcagaaaagcacacacattctgacacttgtcacttaagtacatatattttggtagtttagtttcacaaaaccacactatcgatggatggattcacccctgagatgacgtggttattccatctaggatgaggacgtggcatcatattaatttcatgcgatggctggttataggatgccatatcctcgtcctaggtgaaacagtcacatcatcttgcgggtgaatctatacatcgatagtgtagttttgtgaaactacacaaccaaaatatatgtactcaagtgccaagtgtcaaagtgtgtgtggttttctgcaacttgaaccacaaaacgtgtagttttgtgaaatttactcaagaatataactaatacatatttacttacacattatttttatcaaaattacagtgcacttacatgtcatatcaactgaatttacaaatataattttagttatatagtactgtaattttatattttaaagaaaataacaaatatatatttaattccacaatatttttatcaaaattagaatttgcaaatgtaatttcagttatataggactataattttatattttaaagaaaataacaaatatatatttagttacacaatattttaatcaaaattaaagagcacttacatgtcatatcaactgaatttacaaatgtaattttagttatataggactgtaattttatattttaaagaaaataacaaatatatattgtatttacttacacattatttttatcaaaattacagtgcaattacatatcatatcaactgaaattacaaatataattttagttatataggactataactttatatttcacgacgatgacaacgagaggggtggcgtcactcgctcgctaaacagcgttggtcgtactgccggtggccagctcgatcagaggccaccttggcaccgtgcttctccatcatcgcgcgcgcgggctagctaggtgacataggtcgacgtgccagccgaccggcgggctgcatgcaacgtttgaccttgcaaattgccactcgcatcgcaagacccaaaaaaagtgtcaaatgccagcaaaaaaatcacacgagagatggatagcaaaaatcgttcatggtttagctcttggacatgaaaaaaatgaatcttccagagaagatgctactcactcaatttcaggttacaaatagttttgactttgttcaaaattaaactgttacaagtttaactaagtttataaacaaatatagtaacattcacaatactaaattagtttcatcaaatcaataattgaatatatttttataataaatttatcttggttcgaaaatattactactgttttctacaaacttggtcaaacttaaagtagtttgactttgacaaaagtcaaaacgacttataacctgaaacggagggaaaatattcattgcagttgagtaagagaaaaaaattaaacaacgtgaaatgtcaaaaatacccttaggcccacttatcatatctttcttcttcctcccctttgtcctcacaaacctctttgagatatgatgactacacaaggtcggtgcatcgactcctaaatgacaagagctcttcaacaagtataggctataagcccctctttgtttaggtttatatgtcataagtctaaagctaaacgaacaagcagcttttgatttgtttttttaaaccataagccactttaacactattaagacaaaagctatgtttgaagattttttatttcttatgtgagatagaggtatggttccaacaccaaacttaagatattaaatctactaacttataaatcattataagccaataagctaaccctaacactactggagtctccaagtctggagagggagaagctccctagtgccaaaaaggcaaaaacccatggaagcatcacctaattcgtctatggagccatgtgagatgagcatcacccatggaagcacatgagaaatacggaaaaaatacggaaagaactctgtctggccattgatttccgctaatcattctggaaagagaattaaaggatgcattgcaaatccatgcagatctaagtattatgcaactcatgtgttacatgtgtagtccataggggttgcataatattctacaagagtgaagacataagatatgtggaggggatcattctcattcattcttttatcggtacaatagtgagcctcctctcctttatataggaaaaagtacaccataggtccctcaacttgtcttcgagttacaaaatcatccttgaaccacaaaaccggatatgacatatcccctatgtcgaggagtgaccctctctagcgggaggacgtgagacccccctttgtgagttcggccaaggaattgggcgcgatgatcgggagcgcgatgtttacttggcgaatcggattcgcctagggttaggctagcgaggtgaatagtgatcgagacagagacaaggtattatccaggttcgggccgctgtggag

SEQ ID NO: 46788 - DNA, 3687 bp, Oryza sativa
ttggagacttcgtgggctcacgccgtggggcgcaccgacctgcatgtcgatcccctgctgctgatgagataggacatacctgcccccacgccgcctgacacaaggtaggacgtgggtgcgctgctgcctgtcccgtccgtctgtcaccggtcgcagaccggtcaaggttgcctggcgcacgtctctcattgggcggcacatgaccagccacatcgcattaaatgcaatagggggcggttggggtgccgcccatgaatacgcctggcagcgcccgcgtctccgcccgctcaatccctcacgtggcggccgagcgagggcctcggggtgacgccgcctctcgggcccgaggggtacgacgagatcccccgagcctcctggggagacatgggcaccccttggctattcactatccgtgcatccgatcccccgatgggggatccgggccacgcggccacgtggtagaagggaaaggaccccttcccctcagcgtaggtatccccgggcctatattaccgacaccctaacttacaaaaccagtgcaaactaggtccctcagcaattttaactccggttttatcctatgtggcagctgactcagcgtgggacctatgtgggccccacgcatcagcctcttcttccctcccctctccacctctcttcctctctcctcccttctccaatctccacgggcggcgcgtgggggagcagctgcactggcggcagccagcggggcaggagctgggcggcggtgcacgagctccttgccggacgaacgctagaccggctccgccgcgcccgccgcgaggaggtggcgcgccttgtcggctcgctcagccggagtgccgccgatggcgtttacgcaaatgacctgagaatttgagatcattgccatccacatgttctccttcaagccctatcaacaagattgacacgattaagctctggatcgagatatgatcgatcgcgcagcaccgacgaactagccgctgatcatcgagtcaaatgctcacatctcataagctccaatccacgtggacgaatcaatccattaaacttatatacgcatgcacatcacgcatgaacaccacaagaggacatgaagcttcacctgcaaatctctctataaatacatggcaaaaccatcaacctagctagcacataacaacttacacatgggcctcatgcacgcactcctccccttagcagcagcagcattgctgctccttgccgcgccgccgccggcgacggccgacgaccaggggcggatcccatgtgattcatggttattcacgtgaatgcccatagaattttaccaaaaaaatatatatatatataggtatgttatgcatatatacgtaaaaagttagaggaaagtgcagcatgtatagcccaaatgaaaaaaagcccacttattagcagcagcccgtaaattcctccccaccttgccccagcgaataagcccactgctactggcccaaaaagagactaaaccctagtcccaagtccacactccacccaaatcctaatccatgcctccactccccgccgacgggcgacggcgcattgagggtcggcgctcggcagttcggcgacggcgcgtcgccactggcctaatctccctggttctgggctccctgtcccggtgtccccagtctagttctcactcctcccaatccacgcctccactccgcaacgacgggcgacgtcgcgacggccgatggcacatcgagggctcagcgctcggcagcttagcgcgtcaccaccggcctcatctccctgactccctgtccctgattcgacgcagcatcgccatcaccgaagcccagctgccgaggccttccgctgccgccgccgcgccgccgagcggccgaggcgtcgtccggtcgtcgcctcacacctgaggcctcgacggcgactgccgacgctgagcagctgagggatcaagatattggtaatgcaattgaactaattaatacaaagatgcaattgcagctattgcgtgaggatgatgaagatgaatggtaatcttttctgaaagatatgccacttctttttgtgtgaagcatggcatcaaagttgttgatatggatggcttctacaagccggttggaagatctaaaagattattcaaaaaggtcaagaatttccctcgcttccatgttgacatgttttatgtttataagcatcattgatagacaacttcgagagtttaatgatagatttgatgaggtaaacacaaagttgcttctttgcatggcgtccttcaatcctattgattcatttgctgcttatgacaaggaaaacttggttaagcttgcacaattttatccaaaggatttcacaaaattagatacaaaggatttgcacaatttatttcatttgtgatgtaattcattcaaaccatttataatttagatatctttacttttgtgctactgtttgtacctttaaacatgtcattgccactatgttgttatgctattatttatactttaaattttgccagtccaattttttgagttctgtaagattttttttcaactttgaataccctttgctgaaatcctggctccgccactgccgacgacccgggccttgccgtctactagggccgccacaaggaagaaggctccctgagagaggcctgcgacaccggccactacaccaccgtcatcatcaccttctacaacgtcttccgctacggccgatactcgtcgacatctccggccacctgctcaccgccgttggcgctgacatcaagcactgccagtccaggggcatcaccgtgctcctctccatcggcagccagggcggcggctactccctccacatcaacgcctccgttgccgacatcgccgacaacctctggaacgcctacctcagcagccaccgcgctggcgtgcaccgccccttcggcaacgacgcggcggtggacggcatcgacttcttcatcgatcagggcggcgccgaccactacgacaacctcacccagctgctcaatggctacaaacagtattacatcgatagggcttgaaaacgccgatgtagtcctgcaggttgaacgtgctggggtgagctccgccgtctcggcgaccacgctctgcatctcctccgtgtcgttgtcatcgccggtccaccgccggcccatcagcatgcgagagacaatgtcgctggtgaggcccatcagctcctcccccgccgaccgtcgctcgctcgccgcctgcgcccagcccgcacaccgctccgccacctgtcacccgcgcgcggctcctccccacgccacctgtgcccgccgaccgccgtccgtgcagctactcccccgcgcgccgcccgtggatatgggagaagagaggagagaggaagagaggtggagatgggagggaagaagaggctgacgcatggggcccacgtgggtcccacgctgagtcagctgccacataagacagaaccggagtcaaaaccgccgagggatctagtttgcactggttttgtaagttaggggatgcgtcattgtcacgccctgaagttcccctcccttgctttaaaatttgtaaaataaattgccggaagaaattgtttaattaacctagagctaaatccctaattaataaatgcaaataataatcagaatcggcatgtggaatttttcttggttccccatgctctaatatattaacatgagtttta

SEQ ID NO: 46789 - DNA, 3094 bp, Oryza sativa
tttttccttttgtcgccgcactctcccgagcctctattgccgccgcgccgctctctcctagcgccgagccgcgccgccgcccttcgcgccgtgcgccgcagccttccgcgctgtccgccgccacctcccatgccgccggtcaccgccagtgacagtgagcgccgccgccgctagccatggctggccggccggcttggagccgagccgcgcccagcagccacctctctctccttgagcctctgaccggtgggacccgcatgccggcccctctccttccccttgtgccgctgacatgcgatgcccgcttgccggcgcccaccccttgctgatgtcatccacctaggtttattgcgcaataaatcaattaaggccttttctttttctagtaaaaatagagataatcttctaaaaatcatatctaattcatccgagctctgtttaagtccattcaagtctcagtaaattcaaaaaaaatgcaaagaatccattaaaaatggttttgtttcttatttcagtagtcttatatcatgttttgcttgtgtgctttgtttgtcgcgtagatttcggccgtttcgtcgatccgcgggctctcgaaggcgttgctgaggtctcatcagcgcgagaacaaggcaagtcatgcattacaattgatcatattgtactcaatttacaaatatgtcgcattttctattaaatgttgcattattttacaatatcatgtgggatgggtcctattctcagccatatgttgttcacctcatgccattgataacttcggtattaaaatgactagatgttggcttaggagatgcttagccatgcttagttcaactagcacacaatggaggaaatacattaatgcatagacttcaggttctagtattgatgttggattagtgccaccgcaatggtgttaattaattaaaatacactacatggtgggttgtgggtgcatggtttttctagtcgtgcccatggcgattaaggaccatttcgcgggatgccctggaagaacttatcttatttaccacaagccagcgtgggcaatggctgggattgtagtgtagtgtagctttcctctagccgatgtacccaggcaagggtgggtgtgatggagttgggtcggccggggtgttcggttgatcggctttcggattcaccatggtacgagaggggggccgcccgttgcctgctggggacgggggtgaaccctgaggtgtggtgcgatctgttagagggggttatgcgaagggtcctgtcacgggctctttccggtatgtcgtggtgcatgtcggagcacgaaaacgtgttgtggggccgtgtcttgtgggttataagttcatgtgccttaatttggttttggtgattaatgacaaatctagttatatgagactaacatttttatgagcttttctttgactagtctcatttggatatgaaagtaaaaatgattagaggtatgtattaaacttcacatattctaacttggtctctcttgtggatccaaaatatagtgtgagctccctcattgatcttgattgattatgtgcatatgtgttcctttatatccatatgtatgcacatcttgagggggagcttattctatattttgtttattataagatttctatcttgatttgaaatcatctttcatctcatctctctatattgtttatatcggattattatctatcacaaaagagtgaaaagattgaaagatcttggattaaacaatttgtgtaattgttgctttggtgatagatgataaaccgatgtttatgggattaacctctcttttacataagttttcaacaaggttatttcccgataatgagatgtggtagatatgcattctttggtgatggaccttaatcatgacaaggatgaaattcatggagataaagtgatatgtatcacttcttatctcctactttttgataggttcatatatatgatttccatgttattgttatataagtgtgggactaatgtttacttgagccttatcttatttagtctcctttacattgagaatatggagatcatgaaggtatgtgtttttttggtttatctttgtcattgctacatgccttctccatgtgtataggataaacccattagttcttcataacttatgcatacacttgcctctcttgtatatttatttgtatgcatatttttagggggagcaaatcctatacatttattgtgcatgttttagatccacgttgttcacctattatttatattggatctttgcatttgagcttgcatacaagtatatgacacttgcgatgttaatgaatactcaacaaacatatccacatctttcatatgcaaccggttggtcaccaagtggaggatgacaaccgatttgttggtactaatgttcttctttgagatgtgcaaaggaataggtctaattgtgatgaagctaatggatgacaccatgggttgatggtcaccaagccaagggcatcgccgtgtcgacaagaatgaaatcaagcttgtgatgagaagaaagtcttgacaaatgatggtaaataccttggtataaacatggttgaatcaaatggtcacaagtgttgatctcgactcaagcttgaccccaagatggatggcgcaaggcaaaggtataatgtagctaagaatgttttcttagtcttttcccggtcttggtgtttggtgtagaccagatctgctagataggcgccgtactatcaagaggggtctatgaagcgagcttgtggatgatcttgtgccatattagttcatatgcatgtaggtgcatttggtgggcttgtctagccaagtgtgatgagttttctcaagtcctaaacaagagagaagtgggcatgtccaataggagtgaatgacattttgtggatatgtacggtggatatcctttggagtgtgagccctttatccttgacttaagttgtgtttcttggatagtttttcatgggttggatggccctttgaataagctttccatagagtccaagaacgccaaattccgagacccgagtcaagagatatcgctgttttaccaacggtcggttgagcagaaaagtgacctgcggtctgaccgtgg

SEQ ID NO: 46790 - DNA, 1699 bp, Oryza sativa
tcctagacggcttgtggaggagttgcccggtgacctctccgagaagattgtggaggaggccggcgccgtttgtgagtggtttggagttcaccaccttcggagtgaaggaagaactaccctagtgatcgaggcttgggtagtcctctccgtgggccggctcccatcttgcccaccccttgacgaagggggcgtgcggtggcttcatggttgagcggtggagttaggctcgcctcaacggggattaggaaaccgatgagtttccgaacctcggtaaaaaattccttgtctcttgtctcatttatttgttgcatttacatttgtgctatttacattcatagagacatatttgagcctatatcacttaggtttgtaaaacttaacttagttgcttagttaaccttacacctcaccttgcctagcaacttaggttagttttgtttaagtgccattaagttttaaaactgcctattcacccccctctagtcggcctccttatcctacatgggtacagttgtacacatctgatcagagtaaaactattcgatagccgtgcccacagttatgggtggtcgaccagatttaccgtaattagtctcatccctagtttagcttaatgaactggtgtagtttaggtggttggttgggcctgttgcaacgtggtgtagcgttggacagtgattggttaatattgcttaatctactatagctgttttaccgctttcaactactgcttttaaatgctagctttatgcaaatgaacctttagcctcctttggatatatcttgcatcatacctcctcttccggtatgacttgctgagtacagtgggtagaactcagtcttgctctctcttccccacaccagagttgaagttcttcccagttggagccgtctcgaagaagttggttttgtcgctgccgtcaaggatgcctgtggaatggagtcacccactgcaggagtcaagtctttaggcttagttcgcttttaccttttccgctgcatttgtaatcttttatatttttgtaagacgtggatctgtatgtcgacaattgtcgtttgtgtaccctggctggtgctggacaggggtttaatgcacattcagcttagaaattctggttcgtgaatttctgggcgtgacaagttggtatcagagccgaattgaacacgtagtctccttagtatctcacctatcaagcagttcgtgaagatatgatggatgctattcttttgacttcacctctcataaagttgtaacaaatattttgtgctctaaacaacaccaataaaaatgtcatcaactaactacttgtagattgcgttgagcattacaactttgatatagagcatctctccatccgaactcaattgcaaacctcaaaaaatattttatcaaaatagaactaagagtgtgcaataaatatttggccaccctaatcaaacttaaatgaaaaaagcattcaactataaagttgtagatctagtcgagaactacaattttttagaaagtttatcatgatcctacttcatatgaatgagttctattttttttcatattttagtggtgctcctatttataagggtggtttttatttgaggctagttttgttgagaatccaccttgtaaaaacattttccccttttttcttaaaaatatctaaactttaaaaatttatagaaaattcatgctaagtccaattga

SEQ ID NO: 46791 - DNA, 27737 bp, Oryza sativa
  unsure (1)..(27737): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgacagaaatatatacttttttgtttttcttttatgtatatataaaataaaatgactttctgtcattaaaactaaaatgcagttggccaagtacaaataaaatgtcaataacaataacatgctgagaaattcctgacctacaattttgtctgttgaatgtgttgttcttgaacccaccagtgtttggccaatgatgcatctatgcctctatctgagttccttatttggttgagactttttctgaaaggaaactaactatagctgaggccttatatctttgatcttttaacttcgtcaccacttttctttcttgaaaattacttagttggatgatgttgacaaatcatccctgtgtattcttgtgtatgcctgtgaaagtatttatcctcactctgatattgtgtcttcttggttgtaggcgaatttaatacttttagctgtagaaattaggaaaaaatatatcttagttactagtttactcaaaactcattttactcaattaatgtatgtaattttatttttgagcataatacaaaggtatcgaaagggacaagctgtttacatagagagccaaagagagttctctacaccatctagcgaatacaggtaccttacagcttgtctttctcatgtcttgatccttctatgcattttcgttactggtttgctcacaaccatcctaaaatgacatcttagttattactggagatatgacatgaaaattttaactctctgataaggtgcctctatggccctggagcaccaaacatatttatttgatcagtatgcaaattgtctgcattggaattaaaatgaaagaaaataaaaggacaatattaagatctatctagtaatagttctggtcaatgatatgatatttaagttgccactatgggtagttacttatttcaattgctagaggcgttttgggttcaatttcccatcaatttgtacatgtccactttgtttgaatactcatttttgtatctttctgaatagaattgaataacccttgaaatgtcattctttggttgatgctgcatttgaaaaatacatttgcactcatcacttgttctgtgccacatttgaaaaatacatcttgatgtccttttgcatgatttttagattttgtcttctacttttctgctaaacatagaaatttgcactcatcacttgttctgtgccataaccattctatgatgaattgtccttagcggattccgatgaacctgatgttaatttggttctctgagaacatgctatgacatgtctgaaataataaaatttctgagtcatgatcacttatatctgactatgtaaaatggttttgagccgatgggttcacaagtccatttgttctgcattagttgtcagcagtgcatttagctttgcaacgtaaaattcttgatgctatttaaggcagggatttacctcttttttttttgctagtttgcattttatggatcacttgtgctttctacaatctgattccagtgttttgtattacatcttgtttccgctcatggtctgatcagtgcagttattatgttatcaacttctgtttggcacatgcacttcctctgcttcttctctcttttgggatgttgtgaatcagaggttttccaatgtgttgctttcatcgaagatctgtggttttcacttctcttagtggtaacctcagcgtgagcttgagttgccatcatcaagtcatttcattctttagaatatgaagattttttgtttgcgttttttgttctcaacatggtttttttttttggcatgtcctatatgagtttggtgtcccaatggttatgacaaaatgctaatgaaccaaggctgcaatgacggttcaaaggatgaacttatttaacaagagaatattgaaatcaaaactgttgtttcatgtagaatgttttatgtgcagaaatgccttattgtatcacttatctgatcatgtttgttatttaaaaactaagacataacactggattggtgtactaagacatggagcctctaattatgatatagctgatccatttctaaaacttcttgttaagaaaacttatttcctaaatgcaaagttacattgattcctgagtatgtgctttctcagaagaaataaacaggtgccaatgcaaccatttagcacagcagaattcctgtgcaaacgtagtcttatatgactcaaaaactgagtaaacatggacacttggttgcagagcattatctgtaactgcatttgttcctagatacaaaggatttacctgtcttttctttctgaaggactgaacaacaaccaccgcaacggtgcatcacgcgcggcggaattactccgtgatacacagctcctactcccacgaacacacagagttacagaactgagcataccagtggtgataaatccaactgggcagtgttctcctgtatcgcaaccatcaaccgagaacaaagaagctaaattattcctatctataaataactggccatgactgacatctatttcttgtaattaagaaaacttgtactcctatttttttcaaaactctgaaagcttctatttcttcctgattaatgcgcatgtgctttctagtttctactaagaatcgaagtacaaatgcaactgtgcagcaaaaaccagaatgtcgctgaaactgtaagcaacatggacattgagtagcagaggcggtggccggagttgagggcgaagaggcagcgtcggcggtggtgactacgatccaaggggggattggccggcgagacttgatggggatggctccgccgttggggaggagcctcaccgtcaccgggagcggcatgtgaggtcggagacggcggcgcgcgataggactcggcgcgtccgacagaccgaccggcggcgactcgctagagaacaaggcggacagaatgtacgagcccagattttttgttacggcccatggacagaaatttttgtcagttttggtttatttcttaatttcctaaaagggtaaattgtaaagtgatttcgctaagtccacgaacttgtaaaacgtgtatagagattcttaaattttatttatagtactcactctatccgaaagtttaagaactctttcatttttttggtttttccaaagagataagcccattttacaacctccaagcttcgtctaaaatacaccctcgtccattttacgggaaaaaagagagaaaggagggagaaagagaaaggagggagaaagagagatgagagctgacatgtgggtccaagggcatttttgacatttcacgtgatttctctctcctcacccggaaatcattattctaatcggcgcggtgtccattggcaaattaccacgtttatggagtgtttttccccaaaagtgactttgggcagtatcccacggctaaaactacgaactcgtagtgtcctgtagcaaaatttgccaaaataaaaataaggagagtcaccacttcttcctccatctcttatcccctttctctccttcctctttctctctctctatccttattcctcccaggtcaggtcatccccgagctaacatccccgaactaaaaaaaaaaacctgaattaccccctttgtggctaacggggccattgctggcatctgattggaatcacaactagcggaagtaagtcacggaaggtcggagatgcactatctcaggagcaggaggcagccgacggcgaggtagcagaggcggtggccggagttgagggcgacgaggctgcgccggtggtggtgactacgatcgaagggggggattggccggcgagacttgatggggatggctccgccgttggggaggagcctcaccgtcgctgggagcggcgtgtgaggtcagagacggcggcgcgcgataggactcggcgcctccgatagaccgaccagcggcgactcgccggagatcaaggcggacagaatgtacgagcccagatattttgttacggcccatggatagaaaaattttatcagttttggtttatttcttaatttcctaaaagggtaaattgtaaagtgatttcgctaagtccacgaacttgtaaaacgtgtatagagattcttaaattttatttatagtactccctctatctgaaagtctaagaactcttttattttttggttttttcaaagggataagttcattttacatcctccaactctttgcttcgtctaaaatacaccctcgaacttcaaaaccgggtatttgacaccccctgaactttcaataccattcattttatcccctctagtggttttcagcctgattttcacctatctagcgctgatgtgacggtccagtcagcaaatataaataaaaggcaaattttactagaagacactacgagttcgtggttttagccttgggaccactgcccaaagttatttttgggggaaaacactctataaatatggtaatttgccaatagacaccgtgccgattaaaataataatttccggttaaagagagagaaattacgtgaaatgtcgaaaatgcccttgggtccacatatcagctctcatctctcttcctctctttctccctcctctcttctcccagtcacggtgaggtcgagcacgtcatcttcgtggtttccctggactagccggcgcgcctccacatcgccgccaaggtcgccgacggcatggcgttcatgcacaacaccctgtgcggcggcggcggcggcgacgccgacgacgtgaacgaaaacttgtcgttctcatcctcctacgaggaggacgaggcctcctcgttctgcggcggcgccatcgtccacggcaatctcaaggcctccaacatcctcttcacgggcaccatggagccctgcatcagcgagtacggcatcactacgccgccgtcggtggcggctccatcctctggcgccgctgtcctccgcaccgacgtgcgcgtgtacgacgtgctactgctggagctgctcacggggaaggccacggcggcggacggcgccgagctggcgcggtgggtgacggccgtcatccgggaggagtggacggtctaggtgttcgaccgcgcgatgctctcctccgtcggcgccggcgacgccgtcaccagcgagcagcggatggtgcatcttcagcatgtcaccatgagatgcatcgacgcctcctcgccaccgcccaccacgagagaggtcgctgcaatggtgaacaccgtccgcgaggaagacgacgggtcgctctcctcgaaggcatgagtgacactgacgcggacggacaccaagcacttgagcggtgtgtgcagcaatacaaaattccacacaaaattcccggtaacggtgaggtcgagcacgtcgtcctggtggctctcaaggacgcatgctggctggtcggtgactgcgaacgccctgtcggggacgacgaggtgctccgggagcatgtcctgccgctcttccccttcaccaacttcttggacagctgggacagcgccagcgtcgtcgtcatcgacgatgacgtcccgtccgccggtgtggcgctggggggatgtggccgctgagcaggccgcgtgcactcagggcgttgccgccaccgcctcggcgagcaaaccgtgaccgggagaagagagaaaggagggagaaagagagaagagagatggagagctgacatgtgtgtccaagggcatttttgatatttcacgcaatttctctctcctcctcaaccggaaatcattattctaattagcgtggtgtctattagcaaattaccatgtttatggagtgttttcccctaaaaatgactttaggcagtgtcccacggctaaaaccatgaactcgtagtatcctgtagtaaaaatttgccaaaataaaaatcaaggggagtcacctcttcttcctccatctctcatccccttctctccttcctctttctctctctatccttattcctcctaggtcatccccgagctaacatccccaaactcgacgaggagagcggtggcggaggagctcgagcagggcagtcgggcgacggcaaagctcgcggacagcaaccacattccagatctggcggtggaagtggtgcgcccatgcgggcgacgacgagctcgcggacgccaatgccatagttgtcggcgagctcatttgtggagccacccccacccccccaacgcccagagctccacgcccttccgtcgccgagcctgccacaggcggctgcgagcccgaatacggcgcaggcggctccaagcgccgccgccctcgcagctccacaccacagccgcagccaccgcactcgcagctctatgccgacgccgcagtcgccgccctcatagctccatgccgccgtcgccaccgccgccctcgcatctccacgccgctgccgccgccctcgtagctctatgccgacgctgcagccgccgcccttgtagctccacgccgccaccgcagccgccgccctcgcagctgcacaccgccgtcgctgccctcgcatctccacgctgctaccgtctccctcacagctccacaccgccgccgccgccgccaatggtcacgagggagagaagaacgaatagggcagggtgaaggagagagagagaggggcatccaacgtggcaaaaaccacagtaaaaacaacccagggggggggttaagtgtccggtattgatagttcgagggtgtattatatccggtttttgtagttcgggggtgtattttcgacaagcataagagtttgagggtgtaaactagacttttccctttttccaaaagtctaaatcctatttgtagtcactatgtgctaaattaatttttttagtggagcccaataagttattgtactatttattggttgcatattcattggttttgtcatatgatgaatgaatgaattaatcattggtatagatagccatatggtccgaggcctgatggcctgacccatggcacggccatttggcccggctcaagcacggcatggcacgactggtgtcgggcctgtgctggcccggcccgatagttgggtcatgcctgggccgatgccttggcacggtggactggcctggcactacacaatcgaataaaaatagttgagggaccaaaaaaaagacttaaattaaccatataagacacggtccaaagagtatagggatacataatatacttattccagccatataaggcacagtccaaacagttgagtgaggaaaataaacttattctatagagaagcacgatgggctatcgtgccttcaggccggcctggcacgacccgagacttattgggccgtgcttgggccgtgcgtgcagcccgtgggcagacacggcacgggccggcgtgttggtcgggccgtgccggttcaactaacctcggcccaggcctggtcgtgcctgtgtcattccagcccgggcggcccatttggccatctatactcattggtcttgaggaaaaaaaaatgtcttagacttttggatagagcgtgtatcattctggtccaaaatccagccaattcgagaatggcacgtgtcccgatgtcccccggtgtcacaggtacaaaaacagaggcgaacgatctggtccgtccgtggggcgcagctgctacgcagaacgaatcaccgccgtcagatgaatgaacaagtaagtgcatagttctagcattgtgcgtttctttgttcgagattggttcttgtttcgttcgaatcttcttcttcctcaaacagattcatggttgctctctgctgctgcagtgctgcacgctctgtgttcttgatcttgtgctctctgctcaaacagattcatggccgatgatgatgtatacgaacaagagattttacctgctctgcgaccaccatccatgatgatgatggtcacgcttggcagaaaatcgccctccatatgaggctctccacatttgattttctttctttgctgattcttccattttccctccatatgagcctcgtttctatatgatcttgcctacatggcaggccacatttctattttttttgttagttatttttttctaccttctccctccctttttttccttcttcctctattcggcaagaggcagcattggcaacaacagttgactctctctctctgccgaccagttggcacagttgtcgtcgctatggatttctcacagcgttgcctaacggatcgcactcgtacaggcctccgttagcacccatgttctccaaacttgaactcctccactaactcagccccctcctccgctccacaggcccctctgcctttggtggtcggcgccatcactctcgctgcctccttctctctgcattgcttgtttcattaaggattcctccggcctgccaccgatgctaccgttacctgcggccgcagtcggcacatctagcggtggaggaagaagaaaaaagaaggcgagaaaaaatgggacaaaagggaattttgccatgttatcatccacgtggcataacacataggtaaaaccatattcatatgagactttgggctaggacgatacaataaacgatgtttaggggcctcgttgcacgctttgcaagttcgtggatctaggtgaaatctctttacaagttgaaggactgctagtaccatttacatgtcataaatagtctttattgacctagctcaaatatggcggagtctaattttctccctctagcgcaaaatcactctcctcaactattagaaaaggtttatttttgcctccccgaatgattttggcaatggtttttgttcgctgcggcaacttgtgtcaccacctatgttcgttgtagagaagcgccatgctcacctttaaatagtccgagtaacccttgttggtcgtgctcgtagcaaacctagccgctaccatataacttgctctctgcctcacgttgccaagccaccattgtctcctattctacgccttgatgccgccattaagtttctatgtgccttgtgaccccaatttcacccttgccggagctcgattcaagcccgggcaaaaatcaagaatttggccttcgtgaagtaagataccgggttggtgacttagtataggagcagcaattctgtaataacgagctaagaaagaatgagaaaatagtcaagctaacaaaccctaaacctactctaagttgtcaagaaatagcacaattccagctcaacgacatctcaagatgttttagtcgattgtgtacgcactaatcctactaaaccgaccttatgatggcattgacccataattacgtgataatttgacaacatattccctccattccccaattgatcatcatataatttttttaggttattcccaaatgatcatcatgttagtatccactccctaaatctaatcattattagtgtattagagtaaatggacattggtgcatgcatccatacacataactctttacaaccaacatataatgtcttgatttgttattggctaggaactaggagggatggtgcatgcatcaattttgttactagagtatattttatatgagagagttattggctttccttgattttggtacatgatcaattcggaacggagggagtaatcaactacttgcatacatctataataaaaaccatatctctcatgcaattagcttgaaccccaaaccctaaattagtagatatgtatgcgcaatcagcttggaccctaaacaggtagatctatacgtatgcagccagcttgaaccctaagccatagccagcaagcaaatgagcaagacaacaaacaactttcatcacccaagcaagcaaccgagccagtgtaaattaactttgaactctgaaccctgaaccctaaacttgtagatatgtatgcgcagttagcttggaccctaaagaagtagatccatatgcatgcagccagcttgaaccctaaaccctaggcaacaagcaaatgggcaagacaacaaacaacttccatcacccaagcaagcaatcgagtctgcatctcgaactagcaatacattcaatatccatggttgggcgtctcacttggatggaaggcatgtaggtgggagatcagacgagtcaagagctcacctggatggatacgaccccttgttgcagcacatatgtatgagatggaggagaagacgtcggcaacagcgatggcgttggcaattttggactgtgtactccactactcttgtacttagaacttacaactatgggtccatttaatatgtctacacgatctacatgggcaaatgtcttaagacacctcccgcaaaaagtgtttgcactggtagacaacttaacaagttgactgtgtaaattattttcatgggtgcctcaaaagacaccacctatgtttgaaatatttaaaagtttgaaaattcatatgaacttcaattgaggtagacaacctatcaccgtgctcgtgctaaacaaatcaagctaatgataaaccacttggcccacttgtcatactctaggcttgtgctaaaaaataatagttgtggtgggccctcttcatcaccgccgagaaggaagcactaatggctaaccctatcatggagcacatgtggggcctcccgcaatgctttatccgccaactccacttccgctgacacctcctctttgtcttccgatgcttggcctagcttcagcctcctatgcctcgaccatcctagcatctctcgtgtttcctccttgatggcatctctcgcgttggctactgccaacaccgttgtggccacgcctgctgggcccgtctcctcggccttggcctctgtctctgtgccctcctctcttgcctatgaatccatgccctcggcctcatcgtcgttgtcctttggtggggacctgttatagcatttttcctagcggagcacccgcagcgcttgatggtggtaggagcggcagcggcaacatactctctctctctctctctctctcacgcgcatgcgctcgattgccgaggaggaggcacatgcgctcgacggctggcggcagagacggagcatgaccgtgcggccggtgttggaggcgggctcgccaccatcgccgcctgccatgccacgccgccgcgccatcgccccacgcggatgccgcaactctgcacggctgcgcccaggagcacagcagccacgtcctcctgggctccgcgcctctgcctgtcctcttgccaactccggcgaggcgggccactcgccgccaaccaaagcttcgtccccgccgctcctatcgccccctacagcacactcccagccacgccccctccccgccgctctcaatgccgaccggttccccctcccatccaccaccttgctgctgagcacccgcagccgccggcgggcacctccacagtctcaatctcctcctgcccggtaaggaacaacaggatgtcgccgctgccaagcgggctctgccaccacgagctgccgttcgcctcttgtgtagctccatctcgtgcgtcgccgctgtggacgcggccaccgacactcgtgcgccgcgtccgcagtcgccgcccaccctccccgccgcgtccacagtcgccgcccgccctccccgccgtgcccaccgcgcccccagcggcaaagagagagggggtgaggtaggaccgtgggccccgcctccgcctccgccttcgcccccacccccgcccacccgccgccggcctcgactcctcgcccgtcgcccgtagccgcctccgcccacgcccgccaccggcagccgcctccgcccccgcccgcccgagcctagctcctcgcccactgcccgccaggcgccagccgcctcctctgtgcggatagagagaggggggggggagagaaggagagagaaaaaaagctgacaggtgggccccatcggttttatttattttttgctgattgtatcgccacgtgtgtgccacgtaggctaaaaaccgcttcgaatcgagttagggggtatttcatctggtttgcatagttggggtgaagaatgtcaggttttgtagtttaggggctatttcggacgaccgcgatagttgggggtaattcgtactttttccaaaaaaaaaaaaagctaatcaagcactatatctatttgtgctaagctactaatcgacaatcttgagggtaaagaaaggaaagacataaaattggcttaagacaatttacttagccaacaattatccaattaaccaatcacgtctatgcgatcacgctacaagaattggcgcggcgaccacgtaagtacgacaccatggatcgagagccggccccccaaatcaccaatctcaaagcaagagaggggagtccctcccattgtctgtcccaaactacccctatgccccacctgtcaggccacgtctacacgtacgtacagtcgtacacaaacaaaaagcagcagaggagaggcttcttgcccgcgacgaaacgtgccccgggcctctcgatctggcgccatctcggccgtccgtccgatgcgcccagatgatctgcgccgtccgcggcaacaacgtcgcgctatttatagaccaacccacacagcttgcttgaccaaccactattcctccctctctctcccactttggttatctcgtttctgcttgcgctgcatgttccagttgcagtatagcaggtagaatagaactagtttttggttggttttctatagcttttccccttcttggttgatgtgttcttggcatctttgccatatggtcttgggtgtgttcgatctcctcgatctccctggtgtgtgcttcgtgagaagatgtggagtggcatgccattgccatgaggagagcttgtgctgcatgcgttcgtgtgtttgttgatctcgattgcccaagttcttgctttcttgtgtttgttttctctagatctttgctgtgtttctgttttactttccgagtgtgcatgcgtgtgtggttcttgctgtgatttggtcacaaagaaacgctcagatctgaggcacgcactggtgctccatcgggacacacgttgctcgatccgtcttgggcttggatgaacattttgcgtcatcggtacacacggcgtgatttctttctttctttcttgtgcgtcttttttgctggtccgtgagaaagcatttttccgttgctgttcttccacgatcggtacgattcttgccaggattgtttttaccttccctgcgtgcgcgtgtgtatgatcatctcctggattttttttttgtgtttttggtttcttgcctttgtgctctgccgctcgcagttcgatctgcagctctggtttacatttccagaactagtaacgttgttcgcggcaacaacttgtctctcttctttgttgctttattttgccattcctaatttcttcacaacctgtctcgcatcttttagtctgttcttcctcttttcttcatctctcttgttctctctctctctccaggcatgtacctggccaagccgccaataggtgcatgccatgatgccatgcgtggtcagaggcacagagcagcaagtttttttttggcttctcttgcactgtccgggagatcaggatcagtaaagctgctcttctttttttctccctttgggtctctctctctctcgttcttctgcaggcaaaactgcagtagtacatctgcttgctcttttcttaccacctgcttcttttgtatccctgatccctgctcttctttttgtaacttgattatagtttgtgcatgcaaacatcagcaccacaatttgctcttcttgccagcacaactgttgttctgttctcccattttttctgtgatttactagttgatcttgttcttggctgcaatctttcaatgcaagcagctttaatttgttgctttacattccttgattcggtttcttagcagtaaataatcttggttccgtttgtagttcttgggggcagctatgattagttcaaaatatactaggttgaataatgatggaccagattgatgttcctgtgtggaataacatgtacggtccagacgattacaaccacattgttcctctcgatatgagatgccctttgaaataaaatgccatcttctctgctttctttcttttttttttctgagttaatcaaatcaattaattggttctaggttgaattctgatcgacgaaccgtgtttaacttctccggttcgaacgatgaccacctgtgcaccaacacccacagttatttctaatcctttccaggttatttcgtttcttgaattttatgagcccagtgatgaacaactgatgctttgatcctccgcacaagctgcgctgtggaaatgatgtgtttaatttagattgttctgagggtgcagttgcttaattttctgcttttttttggccttttcatctgcagaaataactgcagctttgaacggtgcgtgccttgggcgtgacgaaacaatctgggccgttggttgtttgcgcggagcaatctcaggcgtccacgtgtcgctatctgtccagctttactgttcggcgccttgtctgtactctccccgttcttggtttgctttttgatcggcttcctttgtgccagaggatttgtgaccaacgttctcgggttttccctgtaaatttcttgattgatttgcccgcaaattttgattgcagcgccgatgatgagttcacaaatgtactaggttgaattctgatcgaagaacctctcttggttcgaacgatggccacctgtgttcctctcgatctgaggcgctgcgcgtgactaatcatcaccaatccaatggattcagtttttttcctttttctgattgccatagtgtgctgatgaatttgtttccctgtgattcccttacgttgaagaccctgaagcaccttttggccgcgtttgaacttgattcagtttttgatttttcaaacaatgaatttgaaaatccagccaattcgagaacggcacgtgtcccgatgtccccggtgtcgcaggtacaaaacagaggcgaacgatctggtccgtccgtggcggcgaagctgctacgcagaacgaatcaccgccgtcatatgaatgaacaagtaagtgcttagttctagcattgttccatagtgtcctgttgtccctttatccttgtaaataacttttatttctcttaatagaaaaaatgtgctccttgcgtattcccgaagaaagttctggcattgtgcgtttctttgttcgagattggtttttgtttcgttcgaatcttcttcttcctcaaacagattcatgtttgctctctgctgcactctctgtgttcttgatcttgtgctctctgctcaaacagattcatggccgatgatgatgtatacgaacaagagattttacctgctctgcgaccaccatccatgatgatgatggtcgcgcttggcagaaaatcgccctccatatgaggctctccacatttgattttctttctttgctgcttcttccattttctctccatggatgattgctctgatgaaacggacgaggccgatgatgtttatgtataaaaaagcttttacctctgatccatgcgaccatccatggtggtcggtgttctgacagagaacacctcccgttatgaggccctcgttttcatctttgtctgatcaccatttttcttttttctttttttgccttcttcttaggccgatgatgctaatcatgctcctatggtcttgaccaagaagctgaggattctctaagaatgtttcccaagagctgaggcccttaattactctgcagttctagttggctagtgagatgaatcgacgaagaaaggtacagtgttagcagtgattgcgaaaccaaagactttcctgagatgcaagcctgtgggtttgcgtttgtgacgtctctttacttggatgagccacactgcatctttctcttgaacttgctatgctgttgagctttcatgcctgcctgtctgtcattatcctctgttttaactgctcaagggatcaactgtttttgccgatgacggatctcttcgcactgttgagattctaatcgtttcttttggactggccggtgatggatgaaacctgagttgtacagacactcttaagtgagttgaatgaagtgcactgacacacactcacattgcgtctctgaggccatggataagcttccaagtttcgtgttacatttagccattcggatgctaacttgtttagcataatgttttcacttctttctgtactcattgaacagttttgatgcaaggatcaatctcgaggagccagctacaggtatacttttgacataaagtttattttcccgagcatgctaatgagaacttgccttttgcacagcggcaatgatgagaatgcaattctatgatgtactttgatttttctatgatgtactttaattctatgatactctgagccatgcatttgttttgattttttaggctgaacttcccctatctcgatctttttgattttttaggctgaacttcccctatctcgatctgttatccatgcgtggttagtagctacatattttttaccttgaccgatgacaattgcgtccattcatgatggtcgttgaacactgttaagggagtttttcagtcatgtcagatttctggcacgtttgctgtacttgatgtgcgctgatcctaattcttctatattttgtgctttcacttctatatttctttatgaacaacggatgccaaatgataagaaaaggatgcaatgatgaacagatttctcgaagttatgttgaggcatttcaatttttcccgttgtcattgcagttcttgatgtattgtcctgctcctcaactgcttcagtagtatcattgagacattatgcccagattttggttattatcattaacttgatgtttgccaataataatattagtcatcattaatttgagatagacaactgcaactcttatctgtcaatttaatcagatttggattttagtctggccaatgaggcgacatcgttccaaaatttaatcaagtggccaagtgctcatttgaagtgtaattttttgttttgtttaggccaataatgatgactatatttctgtattcagtagaatatatttttcttctgtttctgttgctagacctgcatgttaagtccactacgctaactctggtttggtcctataattgttgttgatgaccatctaacttgtatattttccagagcatgaatcagaacacttccatttgggcacattgaaatagatggtgcaatttatacagtaactcagttaactgtcatgatcatttattctgtaaaaatggcttgatgtaactgatctgctcaatcccttataccaatatgcttgatttgcttccttcttgggccgatgatgcgaaccatgctcctatggtctagacctgtgaggaggatttcctaaacatatttcccaagagctgaggcccttagttaccaaccttctttctgattttatgttcttaagagaatgtagttgctttgtgcttcattctctttcttgacaggtttgcaacctcagctgcaattccttgtcttttgaattgtctgtgcagtgggcaatgaaaagaaatccattcgatgatgtagaaatgaatataacctcgcaatgctttgagccccacatttactttgatcttttgattctgaactttcatcctattcttgcaaaatgttaatttcttgtacttgaggtattgcagttgctcagggtgcactaaactggcttctcaatgaactgctgagagtagctagtgctctacttgttttgccctctagaagccttgatttgtcccacaacttcttgtggattagccagtgatgaaacaaaatgaagttcatctaagaatctctcaggccttgaattagcttatatgatactttgcaattatcatgttaaaatttgacagctctgccctgactttcttactactctgctcaatagttgtttgtttgattggcttgaaagcttgttcttgacatacttttttgtttttcattttatgtatatataaaatgaattgactttctatcattaaacgaaaatacagttgactttcttttatgagtttctcagctcttatttttatgcaactgcaactgttggagaatttatacagtattcagcaagtgaataccttctgtgccttctgtattgtttgcaatgatgacaaaaacgattggatgatgtactttgattaactcataaatcgcaatgctctgagcgacacatttgttttggttgtttttttagtctgaacatcccctagctcttgcactgcagaccaaaaatgcataagagcggtttagtagctgcatatgtttgctttgataaaatggatgaggccaatctgcaccatttcattgatgtcacctccgatttcgggcacatttgctgtacttgatgtcttggcgaaattatacagggtgccctcatatggaaggttgatgaatgaattgggaatcaccagtgctctactcaagtatctttttcggttcatctttggtttatccaaaaatctttgtcggatcgcctttttcatttttgccttcttcatgtggggtggatctttaaagaatatttcccaagagctgaggcccttaactagatttggcctcattaagattctttctgatttatcttcccaagaaattgtagtttccattacaaaaaacagagattgcaacaccgccgatgaagtgcttcttgagaaggtacatgtcttcagttcttggcattgcatcgattttatagagttcttggctgttattcactttgtgcaagtttgttcatgttattcacttggctgttattcaccttctctactcccatttcgtcttcaggctttcagctctgtgctcttgccggcgggcaatctgagctttggtcgagtgacaggcggcgcagagctttcgtggacctcctagcgcggtgcagaccaatccacacagcacctgagcctttcctctgcattttggtggtcactgcagttcatgttgctctgcttttattggcttctttgttctactttgtccccgtgtgtttgtgagaaatatgcagtgttttgccagtgatatgaataaaaaatattggttgaatttttgaggtgcaagcctgtaggtttgcgtctatgatatctcttgcgtttgttggaactgtatgaggtacactgcgtcctttcttgcacttaatttgtataaaacaagttatgtttagctttcatacccgatcgaactgacgaacccgttgaacgggtccatggatctcttggttttcttcactttatttgagccatctctgaagaaatgcagcataggaaacatccagagtcatgaaaaataaaattctgatttttttaagccttttgtattgcaccaaagtcttttggattggccagtgatgaaactttagtttttttagtctgaactttcccagctcttgctgctgcatatcaaaatcacatttgatgtaattgatgtctcaggaagagtccctagttctcttcctgagctcattcgattctgtactagggactcttcctagtacagaaaatatagtgtccatggaacctgttgtacggttcgtcaattcaatcaggaaatatagtgtacactatattttccgtacactatggacctgttgtacggttcgtcaattcaaccagtcatttatggaactctagccatacatacactataggcggaaatatagtgtttgacagtgatatgaatcaaaaccttggttgcttcttgcactcaatttgtaccggactagtagttcggtttactatgctgtttagctttcttgccagttattgtcctctgttttgccgatgatgaaagaacctgattgaattgacgaaccgtacgacaggtccatggatctcttggttttcttcactttgtttgaggcatatctgaagaaatgcagcataggaaatccagaagtcacaaataataatctgattatatcttttgtgggccgatgatgcaaaccttgctcctacggtctaacctgtggggaggatttgtaaagtatatttcccaagagctgaggcccctacctagttatcaaccttctttccaatttctcattttccaggtgttcacataacagttgttagtaagtcaatgccttatgtatcttttgtattgtttgtacagtggctatgatgaggaaaagattcaatgatgtattatgattactcacacattgcaatgctctgagccacaaatatactttgattttttgagtctgaacttccccagaaattgccgctgcatatcaaattcacatttgatgtaattaatgtagttagcattgcatcaaatgcacaattgcagtttttgatgtcttgtcatgttcctcactttctcccgttgtagctttcttcttaaattattaatgctagagtatacttttaggctgacgatgtgccatttatttgcatatcgggcatttgagttcaatagtatctggctttcttagttacagcaactttctgttatgtctatgtagccatagtttctttttctttcttttttggattgaccagtgatgaactgtgagttgtactgatactctggtgagttaaatgaagtgcatttgacacatgcgcgtctctgaggccttgaataagtttcaattaactctgatggatagcataccaacttgactgcattcttcacagtagtctcacttccaactctatgcatttgttcaatagttctgatagtctgatgaagctgatacatcaacaaaacactgatgataattcaatgcttaggtaccggcagcaggtaaacacttgattccttgatctgtatcgggagttattttcacggtattagagaaatatgaagtggttttttccattatccaaagtgagaacttagtcattatctaggtttgaggcacaatttactttgtttttttttccaatctgaattccccctagcgcttgtttgctcgatttcatctttgtttgtggcaatcactctgcctcgatcgcgggccgatgatgtgaaccatgctcctacggtctaaacctgtggggaggatttccaaaccatatttcccaagagctgaggccttagttatcaaccttctctctgatttcacattcttctatgctattccttgaccggttttgcaacctcatctgcaataccttctgtgtcttatgtattcgtttgcatagtgggcaaatgaaaacaaaatgaatataacctcacaatgctttgagtccccagattgatcttttgactctgaacattccccctactctgaactaatctggctttgaatgaacttctatgatatttgcactacactggccaaatttctagcacacattcttctgtgttttgtgctttcatttctatcttccttattgattgaaatgttctgattgccagtgataaaactgacacattaatgaaccactgactggtagttcagtgatctatgtataaatctcatcaattttcttcacattttgaggcatcaatgagttggctctgataccttttttctttggttttcttattggctatttggactggttttcatgcacccgactgcttatgacccatcttttggtttttgtgtgacgataatgcaaagaataacaaatgtagcctgaatagaacttctgttcatgatgatacaccaatgctgaggctccagcaggttgaaaactatcagaaagtattttttttcttgagcatttaatacgaacaattccattagggcacaatgatcagttgttatttgccattattagacttctgcatcttttgatgtgtttgtatacttgccaatgataagaagacaatgcaatgatgaacaaatgagtttaatcttgcactacaagattcccgaagttattttgaggcacacatttactttgaattttcccaggttgaattttgtgccaagctctctgcccagtttgcattgttgctttacagtaaaatagtttttcttgttatgatattaaggttttcaatgtgtgatattttaagcttcttttccatataaagatatatgatttttccttttaagccaatgatgcaacacacacagttcgagattgaaacaaattggctaattgcttatttgatatgtgtaaacttcagtttcattgaggcctacaccgacagatgattcttattccttaagttgccatattggaatttacaatgaagtgccgatgatgactatcttattgtactttttgatgaaccttgagaatttgttatcctatgtctgaggtgcttttcctatatattcgtttttttttactttctatgatgtctatataaataaaatggctttctgtcataaaaaatgaaatgcagttggtcaagtgggataataagtgtactatggctttctctcctgttcttgaccccgccagtttttggccagtgatgcatctatgcctctatctgagttccttatatctgtgattgagattgtttctgaaaggaaactaaccatatctgagttccttctatctgtgatctcttgatttctttgcaactcgtttttcctcttgaatagttatttagttggatgattttgacatatcgttattcttgtgtagtgtctgtgagaccattaatcctttgctctgatatctgtcttctccgttgtaggtgaattgcatatttttcgatatttcagcataaaacaaaggtctcaaccgaagagagttctacaccatccagcgaatacaggtgttcacatagagagctgaagaaacacaggtatcaactggaactagctggttacattgagagtcgaagagagtctccttagtaaagcttgatgctgcatttgtaaaatacatttaaatatcatgatttcatttttcttgatttttggaaataaatcttttctgtgtgttctccttatctgctaaagatagaaatttgcattcagttcagtgcaataaccattctatgatgaattgtccttagtggattctgatgaacctgatgtcattttggttcaatgagaacatgctatgacatgtctgagacaataaaatttctcagttcctgcatttgacattgtaaactggctttgagacaatggcctaagtcaacttgttttgctttagttgtcattactttgttcttgatgttatttgaggcagggatttactttgtttttgtaagtttgtaatttaccgatcacttgtgctttctgcaatctgattcctatctgctgtcttcatgttttcgctcatggtctgaccggcacagctgctatgttctcaatttctctttggcacatttaccctctctgctctttttggattgtaatcagaagtcttcatctgttgctttcattgaacaacttttgtatgtcttatggagtttggtgtcccaatgattatgataagtgctgatgaaccaaggatgcaatggtacatttcaaagaatggacttatttaacattaaaagtgacacatgaatattgaaaccaatgctgttgtttcatatggattgttgccacgcaaatggctggcattacattgtcactgtttggaggactagtgctcttcattgaaatttggaaattaaactttgaaatccggttttgccaatgatatcatctttgtaaatatacaaagataagagctctcttgtacaaggcataatgggcaattgatacttattttcgggattgtccttatgtgcaattatttgtattgcttattttgggattgttgtattagttaaatgttgatactctaattgtgatataacagatccatgtctataacatatatcatgaaaatttgtaactattttcatagctcaggaaacctctatttcttcctaaacgcagagtcacagtgattcatgcaaatgtgctttcttcctaaaccaacatctgataaaacatggtcacttagatgaaaagaattttacctgcccatattttctttttctgaagaactgaacagcaaccactgcagaattatgcccgcgatgaatccagatggttgtattgcatcacaaaccatcaatctttggcaagaacaaaaagagataaattaaattaaaatttactcctgttggccatggttggcatccatctgttaggggtcacaaccagagtaagtaacggaggggtacgaaacgcaccatacggcgaggcatgaggcacccgacggcgaggtagcagcggcggtcgccggagccgagggcgaagaggcggcgccgccgcgtcgggcggtggggggcaagagggggatcggtccgtgggatgtggtggaggcttggttgcgaggtcggaaactgcggcgcgtttgagtactcggcgcctccgactctgagagacggcggcgcacccgggaacaaggcacatggaacgtacggccgtatgggcccccttatgtgatacgctgcaggcagtccgacagggaagcagatcctcttgcttaaggatgtaactagtgcctcatcttttcccttatacttatacttatcagccaaattttaaatttttacctttaaatttggatctgattttgaggttttatcattgaagtttattttttagcatttgcatttatatcgttaagaatatacatatcttaatcttaactaattaaaatattagtattttttctttcgtcacattattttcgtccgtgttagtaaggcttccgggatgatttttcgtccatctcccgtcgtttgcatgattgcatcacgcgcaacttctctctacttgagtccgattataatttttgctggtcatccgcatcacacgcactttcccaacatcatcggactcttccaaaaatctcaaaagaaacacatacatacaaacaaatcataaaattctctccaagacatccaatccaatctctagacaaatcatgacttcaccaggcaaagaaacataagcaaaacttcaaccaaacaaatcgaggcaagaacaaaaaccgtacagatagctagagcctgcacttctccttcctccatatcatcagccacccttcccaaccttagcattgatgttccgctggtcccaccacccacgccagactggccagtcgtctcctccaagactccctccatggaaccgcctcctcctccgtggagccatcgtgctgtcctcaccatccttgccgtctccgtgccgtcttcaccgtcctccttgccatcgtggcggtctcgagctcgggggttgttcgatctggcctccgccgccctgcgcctcctcctccacctcacaggagaggagaggcctcactgcacaggagagagggccggagaggcgccagccgccgcccagggaagagggcgaggcgccagccgaagcgaggagagagggattagcactggccgccgcgcaagggagaaggagaggcgctggtgcagcgctagagggagagggagaggcgccggtatagcggtagagggggcgccggtatagcggcaaagggagaggagcgcggacacgaagggaaaggagaagtgcgaaaggataaggggaagggctcgctccactccctcgagagtagggatgaaaacggatcggaaatggacgaaaactagctttatcatattcgttttcatatttttttttcagaatcgaaaactcggatacgtaaatgaaatcgaatattatcgaatacagatacggagcgaatacgagatggaacgaatacggtagcgaatatttaccggtatataaaaaacccctcaaattgagtttattgatcaaggaagagatatcgcttattattttagttcaacatctccaacatttatatcgtcaattttgtagacggtcccacaaccctatgtgaaaattgattttcatggctattccttttagagatccatatgcaaatataattatcattttctattgccaggaccttttactagatgtataacttacttaccattgtataaattggagttgttatttattttacttcacatcttcgaaacttgtaatatttgttttatactttaaatgcttttaaatacaaatattataaactacaaagtggtagatcccgttgagctctacaactttgatatggaacacatctccatcagatgtcgtttgaattgtagatatgagattttgtaaaaattaatatggtatattataatgaatatttatactccttaaatgacctcaaataataaaataatcaataagaaagttgtagatctcatcgagctctacaatgttgatataaagtttgtctccatctgattccgtatggaaaagttatgtatatatacgtgtttttttctaaaatttgctcaatgtctgcggatatccgaaaaaaaaatacggatagtttccgactgttttccgattccgacagatagtacccttactgtattcattttcgtttccgagaaaaaaaaatccgaattcgtttctgaatccgagaatttccggatagttccgaccgaaactatccgaatcccaaaaatggtccggacggacggaaactatccgaaccactttcacccctactcgagaggataagtgcaagattttttttttgctcatctcgtgctccacgtggctcctacacacggccacgcggcttgaccggctcggctacatgagcgccggatttcagcaacacgaggccctgtttagttcacaccaaacttctcccaaactctcaactttttatccatcacatcacatccaaaacttttctactcacataaactcctaactttttttcaaactaccaactttccccaaacttctccccaatttcagaaactaaacacagccgaaatcttaagaaataatcgtagttgatgcaagccctcataaactccgaactgtcattgctggcctatatgcctgttccagtcttataatattctgtcatgctactttgttgtaaacaacatctatactaatataaaaaggaggagttcacccctccaatcctacaggtgaaatcgatatgttcaatccctaccaatcctacggtgaactcggaaacccggcccaacacgcagaatccccgacgcagcataattcattagcgcgatgacaccgtcgccgcaaaatcctccgcgctaaccccgccgccgtgccatcatccacacgatgagccaatccaccaacattgccgcacatatcctaccactgcagtgcgcctcctctcgtgaaatcactttctctcgctgcaaaccgcatcctcccaccacaaatcgcatcctcccctcgcctggtcttcctcaaccgtagtgccggcgagaggcctcctccactacactgtgctcaattctctggtgaactctgccaaacccatcacgcaaaggcgcaagggcctacttggtgtctacaagaccaagaggtaggccaaaccaagaaacccacccatcgttgcttactggaccttggatagatgagaacctcctctagaccaacggtggcattctgctctatctatgcattgcattgaaggatcctatgctttaccttcccatgtactttatgtcttcttgtgctctttgtttccacaagtgtgcaatgcaggcatgcatggaaagtgctcgatgaaatgcttactcgatggaaggacgccacacagaggtcacagctaggagttcaaca

SEQ ID NO: 46792 - DNA, 9484 bp, Oryza sativa
cttgacgtattaacgttgcatagcaatttcaaggcgtagattgaagaatatggtaacaatcactctcgctcctctaatttctcagcatctgtacacgatatcgtggatgagcaccatatccaacgatgagtaatttcgaaaggattcattgtacgactttttttctacacagtacatgcatgtgactatgagatgttttctcatgtttttttcatctttttccttacgaacttgcagagattgaaaatatactttattcatctgcatgattatttcatatgcaggatggctttcattagccataccaacaattatgtaggatgatgtgcagcaatttcacctcatccttcaaaggtaatttgttttcctcggaccctagtccattaaagctataataaagattgaaacatcagcttaagttaccggcaaagcatatgcatggttatagccttctatccgatctaatgattgtctgcttccctttatataaaggtacagagggatttcccttacccaaatgggttggaactaatcaactaattagtataacctatggaccacttcgtgcaaaattttaaattctagtttgataactgaaatagttaccctccatgtgtatttggttaattcgatgtagcaagttgtggtgtcattaagttaacctcatatttctcttccatcatttcgacaatggcatctgtacaatcttccaggtgtggacaagggtcaagatgtgcaaattatagcttgtgatggttggtttggtatagcagttagagttggacagttggtcatttatgttttgacaatggctatttgaaggaaaacaaaatgcaaattttttgctccacaaatgctgttttgttgtgtaacactgtaacctcacggatgtgggcttctttggtgaactgatattgtggcataattaatctccatgtctttgctactgaattgaagagagcaagcttgtaattgtgacatttgagttgataacctttgcttcagctatcttccaatcacaactataattatcttttatgtctgtgtacatccaacatagatcatgatattaatctaccctttatgacgatctattataacatgatcatatattagcatgcaaaccagattactattcatctatcatttagcttcctatcaacttgtctgctggaggtcacatgctagaccatttttaaattttaataaatgcttcctaatcgattggaagtcctatttgtgatattttttttcttttctaggctagaaataagatcaataagtatatatacacatgatggcatatagatgaggacttcttttgttgttgtgctgttgaatgcagagtaccatgaaattttagacaaccggttctttctttctttttagcccatgcaggagaaagagtgaagtatgacattggcccacattctagggactggagccagagtcaaaagtgattggaagatagctaaatctaaatttcaaaaaatttgcaacatgaatgctatattttaagtattaccacatgtttcattatgttattatagctaaaatacatctattatataacactggtttcactcatttatatggttatttgctgttcacacagaagatgcacagttgaaataaatgcccctacatggatatgaaaatttgctttgtcctcctttatggttcataaggtcatgtttacagaatatgtccactaggtcatgtgtacataatatgtccattgagagttgcattttcagtatgcatgtatggaggaataatagatcaatatgctaatgttgtaacactccatgtaggggcatttggacctcggagaaccaaattaatgtgtgccatatttaccacatcaattgaaaatccagaaaatgcacaagtttcttgggaatttagactttcaattaatgtgtttatgtttactctcatggggcatgtttgttgtttcctttttaggattcactgatgtgaatgatttgaaatcaacttaggaattatggtttttgttttgatttagctgaagataagtgtaatcttaggcttgaggtcatcttttgacccatgtagtaagcagacagtatgttgatgaaaaagtcgaacacactggcctgggagatctgcttaacttctgtgcaggtccaaagattgatgagatgcgggcgtgccagtcagtttgatcctgcaactgacaagttatgtaaacaacagataaaactgccgatcggctaacaagccgatgtagtgattccagctgatgacgataccggccgatagcgatagggtttaagcaatcggctatatgtccaatgtagatgatgatatacaggcaatcggctgatgtaataaaataacaatataatcgagtagaaaccaatcggctagaaacaatatataataagcactgatccgaatggttaaagcacacatcggttggaggtccgatgtcatgaaatccacgagattagattaaacagtgaaacctttgttgtcatcggctaaatccaacttatatgtatatgcaatccttgtgagccgatgcaacgtccaaataactcatcggctgaaaccccgatgaaacccttattggcaatcaagaagcaggctagagattatggttgtaagcatgacttagtagatcaaacttaactgatgcagcactaagtatgaaaagaaacataatatctagacaatcaagccgttgactgagttttcagggtggtagatgtctaagctaatctaatctagcaacgcgatttagccgataccggcagaaaccctaaaacaagaagcagccgatagagctaaattgatatgctaagactagattaacaaagacatgataaataggtagacaaatatatcatccaaaccagagtaatctaagaggtcgaatgtactgatgcagctttgaacgacgccgacgtagacgatacaactgcctaggccggcggaacattggacttaccccttagccggagatcaaacaccgatgcagccccgcgtcaggtgccaagtcccgccggacgataaaataaagtagaaaaggtaaaaggtggcgatgcgccgaattgtattgatcgttaagatagattacatagaccccgagtgtacatatttatacctatgggttgatacaagtccttgtcggacaagaaagaaactttcctaaagataaaaggaaaagataaagtccttataggacactaaacacacttttctaaagataaaaggaaactaacaaactattcctaattaatagataacttgctatgccgcattctctttgaactcggtctcttctagataagcttcctttagtagatcaatttccttaaccgaatatagcaagaatccgacaactgacgacttgacaactctcatcagctaatctcaggacttcgaagccgatgctgactctaagccgatgactactccgggcttaccaaatttcaatgttaacacagtataatcagtcttttttttaatttattctcttgtgtgtgcttccatatatatgatgtaggtgttgtttcttttttctgcaccaaacagtcatattctattcttttctcttgaaacatatagcttggctcatagcctgccatctgttggaactatgttacactggtgttaattttctgatctagagtcatcttgatgaaacacaagacataagggtgtgtttggataatgggaaatagagggtgggattgggattgggaaatgaatgaagggttaggattaaatagaagagagagaatgaacggttaggatttaaagatatcttttgatgggtggtaaatcatttccctttcccattagccaaacattacctaaaagttgattacttgttttttttacatgctaatatataaaagaagaatgtgcattgcacgtgcatgattactagtttaagtagtaaaggtgaagttgttttgttgagattcatgtaccattaaagattcgttacgttaacacattaatttttcgtcagtgtcctaaaaaaatccctcatccacaacatccgagatgagagtacaagataaaaagaaaatcatccagagtccgcagcaacaaccaaatgcacaagcgattcagcgaaaattcattgcaaacatagatacaaaatccaataggacaatcaagcaaaagaggaaaaaaaataaaaacatcaccggaagccgccgccaccttcgtagccgtcggattcgatgcaggaagcagccgccgccgccgccacgcacgtagccatcgtcgctgtcggatccaccgcgggaagtcgtcagcaccgtcgtcaccgtcggatccaccgcgggaagccgtctctaccgcctcgggccacgggaagcgaccggcgccgttggtgctgccggatctacccgcaggaagccgccatactaagaggcgccaccaagaggggaggagagggggagagggagtagcagagagggggcggcagaggaggagcggcaccactggtcgggagaggggaagggagggggagaggcaccaccaggaggggtggggaggggtgcggcggaggaggagcgacgccgctggtcgggacaggggaggggaggaggagaggcgccaccggtcggggaggggccgagcggaaggtggagctcacggtcgggtgaaggtgtgattagggttagagtgttgatggatttagaatcaatctgagctgtccatcaaaacgaatggctcatatcgatcccgcatcgggccggcctccatatcgggccacagcaccacacgcgcttcatgtgctggacgcgtaatagcaggctgatagggtctaatgggccttttttttacaacttattttatttctataaggaatttttttaatggctcatatcataaaaaactaaatcctaatcatctaataattttatatttgttataattttagtttacccgttgcacacaggtatttacttattaaaattgtttacataataaaaaaattcttgacatgtcccctctgctcttttttttctatgtccttatctgctcttttttcaattattatttccctcattgtctaatcttctttcatttttatgtctacttattaatatttgacctcaaatacaatttgtaaatcaaaaacaatacttactctcacaaaattaataagatttattaaactccacacattttcctcagataacaatacacaggtatattcccacaatgcaaagtgggtatagtttaactggataggtttcttatggtggaaccagtcaacctggattcaaatatttgatttgacatgggtgctcgaggcattcgtggtaacgtcgtcaatctcaatgttcacattgtgagcgcgtttatactatgtgtttctaaaaaaatttatattctcgcaattcaaaatacattgagtatgaaaattccactcgtatattattacacttacctacataaaaaatacatattttcattcatgatacaaatttccatccgtcgccttttgggcaaagacaatcgcattgttcgtccatccattttctctcgtgctacgaatcatccaaactaacacatcatatatattccgcaaatatatagcagattatttatcggacatatctaaaccaaacaacacttcttgtcactgtacacactccgtaatcaccaggtgcaacgcacgggcacttttgctagtgtgtgtgtgtgtgtgtgtgtgtgtgtatatatatatatatatatatatatatatatatatatatatatatatatatatatatatatatatatatattcttgtaaataggttcaacatgctcaaagattagtgatagattaatatgattttttaaagcaactttcctatagaaactttttgcaaaaaacgcacagtttaatagtttgggaagcgtccgtacggaaaacgaaacaacatctccctttctccagctgccggtagttgatatacggcatgtgaagacatgagcgcctcattgtcatgacattgatgaaactatttgtgaaagaaagttaaaaaactaaacaaatattttagaatttggcggctggatgttttgggtggtgtccgataaaggctagtgtcgtccctggtaaggaccgagccatgaagttaagcatggaacgatcctagtacgaccgtacttctcgtatgggtataaatctagcagagtaaatagctgcgcggaggcggtacccaagaagtggtggtttcatttagatgtgtgaataggcggagagcctacgatggataagcatatgtgggcaaccaaattaaaacctaacttaactataacttaacgcatgtgtgagttttcccttcccagtaacactagaactcctctcactgctagaaactgtgtatgcctgcatgagggatcaagttcatggagcaagtactgccaaagtgaggttattgaaatgctttgctgtgacgcgtctcattcgttgggacttcggatcatgtgttgggcaagtcacgaagtatgggtaaaatgtacatccactacagtttgagtaaaccaatctatttgaaaagccgtgctcgcagatattgagcaccgggacatgtattacacttggctagactcttaacttttaaaatgatgaaacggatgttgcatgatgattttgtactagtagatcaacttctcgggaagcgagaaggggtaaccccagaaaaccatgatgactcagtggcggaaagctatccttaaaaacacaatagatggtggacagaatgtcgctgattaatgaacaatggaactaaaacttgattagtctatgctttcttaggcttatgaaaagaattgcaaaattggtggtggtggcttgaatatcttccatatgcattgttgttgcagtgacttgttgagtacgaacggttggtattcaccctttctatttacaaattaatcaggagtactatcaggaggttgccgaagatgatagcgttcagtaggtcttagatacggtcgttgcctgtgacaataacaataccgctgcattaattctgctgccttaccttaattctgcttttgaatacattccaaactatttggttctatgttccagtctatgcctgtgggctctatgatgtaataaatcgcgcaagacactttatgtatgtgcacttgacaaaatcagctatgtaatcgtgagtatcagactactattaacatgaatgattcttgttataaaaacaggggtcgtcaccactattcctttttcttgggtcttttttccatattacaaacttaatagctgacatccttttctttcaaaatctggtcagaagcaagccgttgatcctttacgcacaagagaggaaactcactaggtatggatggagatcgttggaaaacagtgtagttataatattgtgaaacctggtaactaagcagcagctaattggatcaaattaccatgttagtggcaaggcaaagtctacgttgttccattgcatgtagcatatacactaaaacagagatgcacgagaagggtttttgcataataaaccatttttcatgacctacagagagaacagacatgaaaacaagtacttactcacagtttactacacctgtagcaagagataaaataatcatatcatggttattttgatctgtctaaacctcatcgagtaagggtcgatcctgaactgcaaacttgattatgaagtttcaggaataagtacatgaatgtcttcaggttgccagaaaaccgtacatagattgcaacagcataggacaataagtgcaaaatattggatcatgacaatgacatggcacaaatcgttgggataggatattctcagtaaccagcagtaaaaaaataaaatggcacttcctgttcctaaccttttctctttttttatctgaatttaaattaggaatacatgaaaaacttcacatccaggacagagttgcaaggatgatacaattacaaatgcacataaagtactacgtttggatccagatccaaattcaagataaatacaggatatgactggtaatctagcattgaaccatgaccaacatatatgtcctcaatacaacaggcaattcaaaattgaacaataattaacagacttcttttcaaataaaacgaaaggcagaaccattaaaagctatctgcaatctttcccttcagcaacagtaagataccagcatgggagcaacgttgaatgaggctaaatcctcagcaaagcacaaccagaaatgctccctcgacaatgtgtcattggtgatcctggtagccaggttggtctctcactagtaacattcaagatatcaacatcagatagtggcttgatgcactgatttcttggcccaggtccaattactccaccaaccagatatatgttgtctcccaaaccaatcatcccaaaacctatcctgctttggaattcagatgcacacgacaccatcttatcagggaaattcacaccacgctgcttcataatgcaactattgctcagcacataaagctccccacgaaccattgccatcggaccttgcagccaagagtagtcctcaacagcccaagcattgccatcttcaagaatctgcactgttggtaggcctttgtgcaatacatgcatcttaccctttatgacaagtccagagcatgcagagctgtgtgcttgacgtaggtcagggagaggctcccacgtgtcagcttcagggttataaatctcagcctttgatattgatttgcggcaatttgtgaagcccccagcaacaattatgttcccatccagtgcacaacaggcaaacattgcgcgagctacaagcattggagccctctggacccataaacgacagagaggatcataagaccaaacctcattgcttgcaaagatcctgtcatggtctccagtaagtgggtcaactcgatcactgccaccaccaattacatagagcttgcctgcaaccgaggccactccaaaacgagcaatattcctaatctgagatggcatgacaggaagggttatccacttatctcgaagagggtcataaagctgccacatgttttcaggttcaaatgctaacacacataacaggtcttcagtcgcactaatctgattcctaactttggaaagctcaccatttcgaacagatgctctccaagaatggcagaccatttgaagaacaggatgggacaaaaatggcacccgtgcaaggcactgaagagcaacttcattagggagaccatcaattagtgttgacatcattgagcactcaaagatatgatctcattatacagcaagaaagtcgcaagactgagcctgaaaaataatcaatatatgaagttatgattaccgtacatgaaaaactgccaggattttcaaataaatgatcagagtttcatcttaaagatatcattcaaactgatactcaatgaaaaatgatatgatgcaaacaaaagcagcactcaaacttgaaaccaacacataacaaacaattaaggcaac

SEQ ID NO: 46793 - DNA, 25978 bp, Oryza sativa
tcctgcaccccaacatgatgcatccagtctcatgattgtctacctagcccacagtagaggtagcaatatatatgtgggaggtctcttccaaaatatatttttaccaaaagtagtttattttatttggaagtaagttataatgcctaaggatagaagggattttattccagtaaacatgaaagccaatatcaaccatgacacttaatatgcatctaatatgttcttcaaatttctgactgtgaatgcaatatatgatgacaaacaacaacatggcatcaggggaaaagattagccaattgattatgtacaaaagttgatgaagtggcattgtacttctttaaaactcaatggattttcactcatgttccatatatatcctctaagacaaattggtgttcggtcatctccatttgacgaggaaaagcagatagcatataggttacactatcaataggcattcatccacagtatttctttcagtggccactaagttatactatgaaggaaaacagtgcattaaagaatcagaataaggtcattttgcgtcaaagttttcaacttttcactgaacatatcaaattacaataaatagaataaatatatgcataaacgaaacagaaagcgtgtaatctaaaaggcccactaaaatttggcattctcccacatttcatatccgttactaacatgaaattagaaacaaactaaaccgaaaagaatccaagatagggcaataaaagattgataagaaggaagatttctcgataaataaggaagagggtaaattacagttggtgtacccacaatactagttacatttttcagatagagaatataagctaggtataaagaaactaagaaataaggtcaggtagtacagatacaaaagcaataagaattaggaaatgaattgcatagcatcttccagaatggttctttcttcgtaacaaccaaggatttttgacatggatagattactaagagactatcctagtacacagttacagacaaatcaccggaaattgaaaagtgcaaggtgttccaaaccagggggcggatccaacttgggacatgggggttcacaaacatttcggggaacaaacaaactgttacttgtattaaggttaaggctctgaaattaagggaagagcttcttccagatctagaatagaagctagggttaacgaacgaacgaacgcaagcaaattccagtcccgatgggagagagagagagatgaatcagaaagaggctcaccaggatcccctcccctcccctgctctgctcgccagatggagatcgccgcccccgactcgtctcttggcggcgcaaggagcggaggagacgaagagacgggagattttcttttcttttacgccacaaagggaaggggaagacgctgcctatttctttcgtgcgtgtcctgctcttactcacaagtctctctatagccttatgttatgtatatgcaaaatcatcctgggcccactagctagctgaagcatatcctggccttttcttttctcatttagactaaaatctaccataaacaattctattttatacatgtaactttattcgtataaagtttacatatactaactttatttacatagtaattttcagtaacattttatatgtaaactttacacaggtaaacttttcacatgtaaagtttatatatgatttaaaattccttctctaaataatagagaaaaatattcaaagataaattttgctgttgtgttatgattcaaaaatgaatacatattttgtgatcacaaaataataacaaactagaataaaaaataatttcacaaaagaaataataaaagtaaaaacaaaaatgaatgcatacgatgtggaggcattattgcgagtgaatttgttactttcgaatgagcatatgtggaaggctatgagtaaatgaaaaactccacgaagtaaatttgttacttttgaaacgtgcggagatactagaaaaacggaaaactcagaaagaaaagctagacggtaaatattttactaaaatgcgaaaacagaaaaactatatagaaggaatgaataacagaaaaatcaggatggttaatattttgccgggccattgatgaatcacggatgagatggaaaagagaaaaaagaaacacagaaggtgaggtggtaaaaaaaaatgaaaaaaaacgaaccgggtaggatgcggaagaaaggtggggtggcaaaaaaagggaaaaccggaaggagagggcgttgtgtggcgctcgaactattattccgcgctgtagcgcgcggaatgtaaaataaaaggtgtttttgattattattctgtgatgaacaattagcattggagattattggtgttgatatttggaatttatttgtaaagtggttttggagatgattgaaatttacaggtgattgacagggactgctgtctgttgggtccggtcagaccggcgcagcccacggtctcaccggccgactctgtgtcggtttcggtttcgggttgtttgtttggatatccgtgattgtttcatgattgtggcttctagatggatactatacgtatgtaatactgttgtttgttaacaatgagtcaagttggggatagcttgatctcggaatatggtttctttgttctttctatgtgtaggtcactcgagatgccgggagagtatttgcggcgatggaccgggagtcggcttggggataagacgaagtccgtggtggtcagagatcatgcgggatactaaggctagagttcaatgcacgtggttggtgaagtttccatatggcatacgatggatgtattctgtgcgtatggaatgcggagttgaatttggaaggagtccaaatttggtatgattggttatgtaaagtttatttcttgtacgagaaggtttcctatgaggattaggacttctagtatgagtttggttcgtggctttaggctgcctacctcatgtataaatagacagggagcgtgaggctttccggtatcgcttttgagagcaattgagttgatagttgagttagggtttcgagtttagtcaagatttttgtaaggagtgttgttggtgcacttcgtaaacacagagagaatcaataaagttgtcatccactttaagagttcttcgatttatgtttcatcgggtttcagcggtctaaccggcgacacaccggcggtcagaccggcggcatcgcggcggtccgaccagcggcattagggcgatcagaccggcggcggcagtagacgacaggagctgatccaggcggtcagaccggagttactacctctgtcagaccggaggtattcaggcagtcagaccggtgcaattacttcggtcagaccgcgatccatcgaatttgagggtaacttttatttccgctaaaaattttggtttttgggtatatcaaccattcacccccctcctctggttggcttagttattgtgattcgatcctacaagtggtatcagagccttgttttctcctttggattttaaccgatctagagtttttgccatggctgctaagttttcaactaagccttatgttttcaatggaacggatttttctcattggtgtaataggatgcaatcttacattatggctgaggattatgatatttggagaaaagtttctcatccttatgtggtccctgaacgaattaatattgctgctttaaaaactgattttgaacaaaatagcaaagctcacaatattcttttgagtgggatttctcgttcggattatgattgtgtttctcatcttcaaactgcccatgagatttggattgctttgagtaattttcatcaaggaacaaataatattaaagagcttcatcgagatcttttcaaaaaggagtacattaaatttaagatgaaacctggaaaagctttggatgactgtctttctaggtttaacaaaattttgagtgatcttagtctgttgattcttcttatgatgctaattatacacaatctgagatttctcgccactttttgaatggtcttgacatgtctatttgggagatgaaagttacatctattcaggagtatgttgatatgtctactttgactttggatttgctttacacaaaactgaaaacacatgagatgaatattctttctcgtaaagttgattctaagttgagtgctttggtttcttcctcaacttctttggatgttgattcttcttcatcgaagtcttccgtatttgctttgtttaatgccatgtccgatgatcaactcgaatagatcgaggaggaggacttggttttgttatctaacaaactttctcgagctatgactaatgttaggtacaggaaaagaggtggaccaaatcgttgctttgaatgtggttctacagatcactttcgttcgcgatgtcctaagcttgggagagcaaggagggaagataatggtgatgagaagaccaatgacaagaagccgaagggtactttcaaagggaggaagatcaaggagactctcaataaggcttttgatcaagtctacgctgcgtttaagccactaagcgatgtagatggtgatagtagagatgaagataagggaaagaacatctccagtgtttgcttcatggcgtgtggtgaatcggattcagggtgtgaagacaatgaggtacatacttttgaggaagctattcttattttaagtgcaaaaaataagaagtgcgagaagatgtatagaaaataggaatttttcattgaatctcttaattatgaaattgttagattaaattctcttattcctaatgatgatgattacaaaaattgtgaggttttaatgaatgagatttcaaaaattagaggtgtcaatgctgcacatgatttgaaaaataagtcttctctggctcttggatttgctttgcacacacacactttggatgagttgtttttaactaaaaagttgttgcaaaaatatcaaattgcttttcatgctagtttgatgtttaacatgatttgtgctaaaaagttaaaacaaccacatgatgttttggattgctcaacatgcacattaaacaagattaaactaaaagatgttttaggtcgtgttgagtacatggaagatgttgtgaaaaacaatgaagtgctttcttgccccaaatatcgtaaaagcaaaggtgtcatggtagattgtgaaaattgtgctaatttggaaaaagaggtttcttatttgaaaagttctttgcaaagattttatgaaggtaagaaacaacttaacatgattttggatcaatctaaagtgactagttacaataggggtgttggttttgatgttcatgattatttcaccaaaaatcaaccaaatgttttgagtggatcaatctaaagtgactagttacaatagtggtgttggtttagatgttcatgattatttcacaaaaaatcaaccaaatgttttgagtatgactgaacgtggtgaaatttatacaaaaccaagtgaaaagaaaacagtttttaaatctgctggaattttgccttctctttctgcaacactaaaagtaacaaaaacaaatctttcaaaaccatcttcttctaaagaaaagtatacttgttcttttttggcaaagatgacatattgttggtttttgtttcagattggctcataaacaaaaaaggagagagaaattgcttttacaaaattaaagtggcaaaaatctggttttccctcgaggaaaccggtctgaccgcagtgggtcccgcggtcagaccggctactgagcggcggtcagactggcttcggtcagaccgacggtatagcagcggtcagaccggcccccggttagactggctgtactcggcggtctcaaattgtttttgcacgtggatatatgcctattggatctactggtcgtgtgtcttagtactggattcctaaatttttattatcatctaaccccagtactgaggcttcgacttctgcttgtgtgtacgctttggtggcaaggaaggagaacgtgtggatcgtggattccggttgttcgcggcacatgaccggtgataaaaattggttctcctccctcaaaaaggcatctaagactgaatcgattatctttggtgatgcttctacgagtgttgttctcgctaaaggtttggttaaggtaaatgagaaatttgaattgaagaatgtagctttggttgaggactaaaagtataatttgctttcagtttcacaaattgttgatgaagattttgaggttcactttaagaaaactggaagtaaagtttttgattcttgtggtgattctgtgctgaatatttctcgctatggaagagtgtttaaagctgattttgataatcatgtttcacctgcgataacatgtttggttgctaagtttgataaagatgtgatgttttggcatcgtagacttggacatgttggttttgatcatctcactaggctaagtggtttggatcttgttcgtggtttgcctaaacttaagaaagatcttgatttggtttgtacaccgtgtcgtcatgctaagatggttgcttcttcacatgctcctattgtttttgtgatggtggatgcactgggacagctattacatatggacattgttgatccagctagagtgcaatctgttggaggaaagtggtatgtgttggttattgttgacgatttttcttcatattcttgggttttcttcatggcaactaaggacgaagcttttcaacactttcgtggtttgtttcttcgattggatcttgaatttcctggttctttgaaaagaatccgaagtgataatggtggtgagtttaaaaatgcttcatttgaacaattttgcaacgaaagaggtcttgaacacgaattttcttctcctcgtgttccgcaacaaaatggtgtttttgaaagaaagaatcatgttttggttgagatggctagaacgatgttggatgagtatcacactcctagaaaattttgggcggaggcggctaacaccgcatgctatatttcaaatcgggttttcttgaggtcaaaacttggaaaaacttcttatgagcttcgatttggatgtcaacccaaagtttcacattttgcgtgtttttggtgcaaatgctttgtcttgaaatctggaaatttggacaagtttgaggcacgttctatcgatataatgtttcttggttaccctacacattctcatggctatcatgtacttattttggagactaacaaaattgttgagacttgcgaagtttcttttgatgaggctagtccaggtactagactcgatattacaggtacattgtcacaggttcagggggaggatagttgtatttttgaagacgatagcgacgacgatgacgacaaggtcggctcggccggtcagaccgggcgccaggccggtcagaccgcaagcacacctccgggcagaccgcctcaggacgagcggtcaaaccggccagggtcgtcaggttcgggttctgttgacgctgatcgagattgtcctccagaggctacaacttcgaccagtactggtacagaacgtgaaacaactttagaagtcgctgctactttgcatattcaacgacgacatccaccggaacaaataattggtaatctaagtgagcggaccactaggtctaagataacgactcatgatgtttgtgcaaattctgcatttgttgcttcttttgaacccaaagatgtgtcacatgcattaattgatgaatcatggattaacgccatgcatgaagaacttgaaaattttaagagaaataaagtttggactttagttgaatcaccttctggacataatattattggaaccaagtgggttttcaaaaataaacaaaatgaggatggtttgattgtgagaaataaagctagacttgttgctcaaggttttacccaggtggagggtttggattttggtgaaacttttgatcctgttgctagaattgaggcaattagacttttgttggcttttgctgcttcaaaaggttttaaattgtatcaaatggatgtgaaaagtgattttctaaatggttttatacaggaggaagtttatgtcaaataaccaccaggttttgaaaatcttgattttcccaaccatgtttttaaattgtctaaagctttgtatggtttgaaacaagcacctagagcatggtatgatagacttaagaactttttgcttgcgaaaggttgacaaaacgcattttgtttttaagcatggtgataatcaactgttcattcagatttatgtggaagatatcatctttagttgttcaactcacgctttggttgtggagtttgctgagactgtgcccaaggaatttgagatgagcatgatgggtgagttatcgtactttttaggattgtaaattaagcaaacacctcaaggtacatttgtgcatcaaacgaagtacacaaagaatcttttgagacggtttaagatggagaattgcaagccaatttcaacaccaattggttctacaactgtgttggatcctattgaagatagtgaagctgttgatcaaaaggagtatagtagtatgattggatctttgttgtatctaactgtttctaggccagacatacaatttgctgtgtgtttgtgtgcacgctttcagcttctcctggtgcttcacatcgtcaagcggtcaagcgaataatgaggtatttgaatcatacacttgagtttggaatttggtattctacttcatcttctatatgcttgagtagatattccaatgctgattttgctggttgtagaattgatacgaaaagtactagtggaacatgccattttcttggtacatcattgattgcatggtcttgtaggaaacaatctagtgttgctcaatcaattgctgaatctgaatatgttgctgctgctaattgttgttcacagattctttggcttatttcaactttgaaagattatgatcttacttttgagaaagtacctctcttttgtgataatactagtgctattaacattgctaaaaatcctgttcaacactcacgcacaaagcacattgatattcgttttcactttttgagggatcatattgagaaatgagatgttgaattgcagtttttggacactaaattgcaacttattgatattttcactaaacctttggattctaatcgttttgcttttcttcgtggtgaattgggaataattcatcattttggcatgatttaagggggagttttgcacctcatggttttatcaagcaaaaatatgacaatgagaaaaattgaaaaaagagagctttgttctatacatatggcattttcttgtgcatgctagcaatactatgaaggtttatttgtctctagcatagcttgtatgtattctagtctttttgtgagacttagattttgcttttaagggagatgatgcatgacacttaaattttacttgaattaagcaaatatgcaatgttgatgctagcatatggtttgatttataaatgctttatacatatgctttattgaattgttattcctcaaatagcttgtaattgctcattgtgaaaagagaataaaattatgaaaaaatgaatattgaatccttggaaacagtcttgacgacaaggacgtattcgatgtgagcaaaataatgggtgtcgaatccctggaaacagtcttgatgacagggacgtacccgaaataaaagagaaaaatatgagcaaacatgctctagaaaaagaaaaaaaaattctcttagttgttttgtgcaaaagctagtttgagaaagagtgatagatgcaataggtatatgtgtttagtgtttatttttcaacctatgtgcttgtaaagatgttgcattataaatcgtatgaaatcatgaattttgattgttgattcaagcttaattgtaaaatctttggttcatatttatactttaatgcatgcttgttatattattgatgggttcatcttctttttattacaacacatgacatgatatgctatatgtatgctaagctcctgaacattaatgaacataattcctatgcttgatgaaatcattgtcaaaagggagagaagagaagaaattttttgaaaaagttgagagttgagaagagcatgtttttgttcgattgagaatttctttcttttcaaaagtgagagaagttttcttttggattttcaagcacgatgtgtacatttgtacgaagtgtgctttttaccacttttgttttattttttccaaacactaaaatatttttgatgggtttgccaatgtgttcattgagggggagattgtaaaatcaaaggtgtttttgattattattctgtgatgaacaattggcattggagattattggttttgatatttggaatttatttgcaaagtggttttggagatgattggaatttacatcggattaacagggactgctgtctgttggatccggtcagaccgggcatgtgtcgccggccagaccgacatgtattgcgcggtcagaccagcgcagcccacggtctgaccggccgactctgtgtcggtttcggtttcgggttgtttgtttggatatccgtgattgtgatgaaccctgagttcctttcgacactcaaggcagttgtttggcccaatctttcggagagttgatgataactacgatttgagagaaacgttgacgacccaactacaatcgtacaagacgttgtgttgcgcctttgcgatcgatacacctctctgtgggttgttgatcttgccggtgcagatcaaccttattcctgcaagcaaatcgaagaaacaagcaagaacaagataaaatcaatctgaattgcaaataggaatgaatacacataataagttggggtttcgaatacaagcagatggacgggctagccgacatgcgcgctgcaaggaagtagcaatggctaaactttcatctaaacaaaacccaagaaactctaaaggggtacctagctaattataatggtgggaggacgaccaaagggaccctagggtcgtgatccacctggttggggcgcaccccacatgggccccacttgggccggggtcccagatgaagttacatgcctataggcccatgacaggtgacgcagctccttgtttctttgattgcggccaactgagatggagtttggtgataaggctggatccgttggaaggaggactccgaaacctttccatcaagtactcacgggcccaaaacggagctcgaatgcaaatttggcggctgtttgaagtcaacagtgtagtaggtggccgaatcggattccaacacttggaggacttgatcttgatatcatcttgttcatccatgatgtgagcaatggttgtatctgtagtagccatggtcacatcatcctccccttctttacggaaaaccgtcctcggtttttccatatggttctcatcgcgtggtcgatttaaaacaatctgttttatccaatcaaaacaagagaaactcgaagtaatatgattagaaataacgtgtcactcttgcttgcatgttttatccacatgtacaggaggttctaaatccgaacagatgtaaactctatgcaccaaatatattcctctatcattacattggccaaagatgtgaaaaataacattacgaggacttggcaaatcagaatgagcaaatattttgtccttcaaataattgagctcacaagaatcatcaaacagaatatagcccaatgtatttaaagaagattgcaattgaagttcatcattctcgatggacgtgtgaataacatgcttaaattcagtacatggagaatcaagattaaaagtggcatgttgattcactagttgtggaatggatataagtgaagtactatcgcataactcttctttatcacgaggaacaaaatgcaaatcaacttgtgacaaagacaattcagaagtaggttccattaaaatttgctctaggtcggcatggaaagtggaaaaatgtaattcatcagaagcatactcaccttgagtaatttctgcaccatttaatttatcttttatgcactcttcagataatgtaggtgcatcagccttctcttcattcgcgagtgatggaagtgacatctcaaacatatcgttcttctcattttggggactgttctgaacttcctgcaaaacatcagtgataggaggcacaagcatagcttgttgctccgttgggttctccaaaattttgcgctcaacattgcaagcaagcatgaacaattggcctatatgattatatgtcacattaataagcccagcctaaatatcagaattaagccctctaaaaaatctagtcattgtgttctcattgctttcttttaaaccactataagtgatacaaattttaaagttatgaaagtactcccgcacggttttgtcaccttgttttagatgttctaatttctcaaggagagtacgtttataatatgaaaacacaaaatttttcctcatcattgttttgcattcatcccaagtttcaagcttattgccaacagtgtaccaccaaaaagatgcagaaccggtacatttattagtagcagccttaatcatttgagcattagagaaatcatactcatcaaattgtttgtctactgctagctcccaattaacataagcggcggaatcatacttaccatcaaacactggcaatttagattctacccttgcaagatcattatcatatacctcatatgtgatgcgtgaagaagtcgctatatcttgttgatggtgaagatgttgatgttgagcatgaccatctcgtttccccttgcacaatcctgccatggttagtagcaaataagaaacatacacaagaatatgcacgctcctatcaactactaggtagtgacagctgaaatatcacacacactcaagcttttcaccaagctcttacaagttcttaccaaagcaagtggaatggtgacgtacaccgactcaaccaagcaccccaatggagtttggatgtatcgatgccttggcaaacacttgctgtacagctgcaatcaaatctatggagctctgggtaggcttaaatatatagcaaaggaatagcaaatgctcaatccaaagaatgcaaagttgattgatcgttcaaagtcaagtaccgtgctggtccaaggctagaatgtaatagagacgcgagcctagatacaaacagtaccacaatataacaccagaaacaactcaagcacactcttaatatatgaaaccaaactgattttttttgccttctttctttctttctttctttctttctcttttttttttattttctttcttttccttcttttttttctttttttgtgtggcttttcttttatctttttttatgcacctttctgccttttcttctctcctttttttttattttttttaacaaaaaccgactcaaggatcttaatgtaagattacagggactcaaatataaatactaaaattacagggactcaaatgcaaacccaaaattagaactatacaaaaatgaaatgctctcgttgcataggttccgtttttgcaaacatatcttcaatccgacgcacgaaaaattttcacccaagtgtatgggatgtcacggtatagctgtgagggagggaatcggactcagaaatctcggcctggtggtggtgggcggcaaaggaaggacacggcacacggagttcgaataaaaggaaaaatctcatgcaaggaaaccgaatccggttcaaatagaaaccgatccaatctactaccaaaaaccgatctaatctaatctcctccttccttcttcctcacgcacaacatcacatgcgcaccataacggatacaaccacggcacagccatcgaacagaaaccttagatgcaactcaagaactcaaaaactaaccgacagaaacttctgaaaactacaaaaatagaaccatggcagcgagccgattccgttttcgtaggtcccgacgacaacagagacacggaggcaacaacaactgtggtacaaaacgtgaccagaactcgaaattctaaacgaactagacgctaagaccagcaacacgacgtgacaatgcaacaaaaattcaacaaagcaaaaactgcatagaacaatgcaatggcacaaatgtggctaggtaatgtatgaaaatttttttttggctattttctggttataggtaaatgaaaactcaccgagcaacgaaagctctgataccacctgacgaaccctgagctcctttcgacactcaaggcagttgtttggcccgatctttcgaagagttgatgataactacgatttgagagaaacgttgacaacccgactacaatcgtacaagacgttgtgttgcgcctttgcgattgatacacctctctgtgggttgttgatcttaccggtgggttgttaatcttaccggtgcagatcaaccttattcctgcaagcaaatcgaagaaacaagcaagaacaagataaaatcaatctgaattgcaaataagaatgaatacacacaataagttggggtttcgaatacaagcagacggacggtctagccgacacacgcgctgcaaggaagtagcaatggctaaactttcatctaaacaaaacccaagaaactctataggggtacctagttaattataattgtgagaggacgaccaaagggaatctagggtcatgatccacctggttggggcgcaccccacatgggccccacttgggccggggtcccagacgaagttacatgcccataggcccatgacaggtgacgcagctccttgtttctttgattgcggccaactgagatggagtttggtgatgaggctggatccgttggaaggactccgaaacctttccatcaagtactcacgggcccaaaacggagctcggatgcaaatttggcggccgtttgaagtcaacagtgtagcaggtggccgaatcgaattccagcacttggaggacttgatcttgatataatcttgttcatccatgatgtgagcaatggttgtatctatagtagccatggtcatattagattgtttcatgattatggcttctagatggataccatacgtatgtaatactgttgtttgctaacaatgagtcaagttggggatagcttggtctatgtgtaggtgactcgagatgccgggagagtatttgcggtgatggaccgggagttggcttggggataagacgacgttcatggtggtcagagatcatgcgggatactaaggttagagttcaatacacgtggttggtgaagtttccatatggcatacgatggaggtattgtgtgcgtatgggatgcagagtcgaatttggaaggagtccaaatttggtatgattggttatgtaaagtttgtttcttgtacgagaaggtttcctatggggattaggacttctagtatgagtttggttcgtagctttaggctgcctacctcatgtataaatagacagggagtgtgaggcttcccggtatcgctttcgagagcaattgagttgatagttgagttagggtttcgagcttactcgagttttttgtttggagtgatgttggtgcactttgtaaacacagagagaatcaataaagtcgtcatccactttaagagttattcaatttgtgtttcatcggctttcggcggtctaaccggcggcacaccggcggtcagaccagcggcgtaagggcggtcagaccggcggcggcggcagacgacaggagctgatccaggcggtgagaccggagttactacctctgtcagactggaggtattcaggcggtcagaccggtgcaattacttcggtcagaccgcgatccgtcgaatttgacggtgacttttatttccgctaaaagtttaggtttttggatataccaaccattcaccccctctggttggcttagttattgtgattcgatcctacacggaatagtgctaccgctaaattatttggtttggaagacaaacttcaaagtaatttaaatgacatgtaatttaaaatggtgggatcgggatagctctgtcatcacacggggaaaactattttgatatctagagacttgaggggacatcccctcatttatttaaaaactatccggacggttatgagaaaatccaaaaaatttatcaacacacacataaaaatgttatataagttgtatcaaaagtcaactcacacatcgacatatagcgaaacaaattcagcgtataaatagtaaaaatactgttcaaatctgaattgtttttttctcagtgtgtatgtcgaatttaaacttgatttttggtggactgagtactgtcaattgtttttaaaactttccacgtctgtttgtactgaatttaaaagaaaaagatacatgaggagacatctcctataggtcttgtttggttaatcccccgagagagagactgaaggggatttatttcacatctattatgtggaattattttttctcgatcttctctaattctctgtaatccttttcaaaccgaacaagacagaagggattaaattcccctccccgtcaaacgccgcagcgcgcttcacatcacgacggcgagcagcagcagcaccacccaagccgcagataggaagacggagggcgtcagcgccgccgccgaggaccgcgacgccgttggtgacagcgacgacgactaccgcaaggaggacgacggtgtctcgaagtcgaacgtaagcgtgttctcgtcgaggtcgtacgccatcttcctgccggcctgcagcatgctgccgaaggggcgggcccacttcaattcatgggtattcaatgaatacctaagatttttgtaaaaaaatacatatataaaatatatattccatatgcatatctctactacttaaaaagttcgtagtggtggtcttgattcctgacatagcagatgcatctgatagacacgcataatctcaaccatccgattgccatgtccaacggcgtcaatctcctccccatcacgcgctcgctcctctcttgaatcgacctcctccccacgcccactcctcctcctcccacgccgcgtccttcgccctcctccctgggcgaagctcgccccgccgccgcatcgcctcctcaccagccacgcccgccggcctcctccgcgatcgccgccgccctctccaacgcgcctccacctcgcatcggatcgatcatccaccttcgccctcctccctgcgtcgcctcctcgcctcgccgccgcatcgcctcctcagcagccccgtgccccgcgccccgcgtcccgcgtcccgcgccgccctcgaccgccgacgctgcgacccgcgccgtctcctcgctgccgtcgccgcgccccgagtcccgcgtcccgcgccgccctcgaccgccaacgcgggagcaggaggtcacgccgcgtcaacaccgccgaggagccgcttcctcgccgccgtcgcgacgacccacgccgccctcgactgccgccacctccgccggtcacgatcgccgtcatctgaaggtatgtatcccctcctgtcccaccacttctgtcagccgccgctgccgcaatagccgcacgccacaccatccccgacctgcaaaccggccattgccgcccgcacgccacaccacgctgctgcgaatccctggttgctaggtctaggttaccatctccgtcgccgctgcccaatccccaaccagccatcgcagcctgcacaactcacaacatagccgccgaatccccgctgctaggtcaccgtcgccgctgcccgatccccaactgaccattgctgcctcatccctagcctaggtcaccgggactactgctcccccgtccccagttcaaagcccccaactaggttctgtatattgttgatcacgagatgtaaatgccacttttcaatcccaggaaacctagatccaggaggaatcaagcaggagttcagggacatgcacttggcatctgctgaattttttttggcattgatacggtgagtctgtctttctctaaacattagaaaaaatggagaaagaaatggtttatgtatgcctttcatgcttttaccatgtttcgatttcagtcttgatgttctgcccctgtccgtttgtttgctcctgactcctgctcagagattgataaagggttcttccatttgcatatttcagagtaattttgaaaactgaattgaaatggtgtgattttgtgtgagatagcaaacaactcttctgattggcacattgtaatttaagtgcacagttgttataagtaagtcgatagtgtattttcattcaatgttctgcagtttactagcaaatcaaactcagatttttctgctgagctgattgctggggagatattttctgtcaaatggcatcccattagatgaatttgtgtactatgttcagcaggatttggcaggagactaatgtgcatgcatgtttaaaccactgggaattatcatgtgatggcataaagtatttttcttctgcctgtttaaaccactgggaaagaattataatcctcatatttgcttccaatttccaatttaagattgtttgtttggataacaatggtgggagttctgtgccaacatcgtcaacaagatcaggtgacattttcatccatctagctaatgttatatttatcgctcaattgatatattattgcttgctaatatgaggatcactcctccctcaggtccttttgctgatataactaatgtaattgatgccaatttgacgaacaaccatcccgctgctaataaaaatggaactaatgtgccaaaagatcgtgagaattgccagcacaacaacttggactctacaggttgggcgtagcactatattatatgttttgtttctttttaaggcttttgtattaagcacagtttttgtgtgcatgcactcttcaagatgttacaaaactaagtgcgactaaactaaaaaggaagcgtgctagggagtggtatgcatcattgaccaaagagcaaaaggaagatagaaacaagaaggcacgagatatcaggaagcggaggaactttgaatcacaaggtttaaatctctactgcagcatatctaaactctctaaacagaaaactttattattaaattaattgaactttcagataatgggtctcaagctgcgacatcaaaaaaaattactactacggcctcatctgtttcaggttgagttgtcatatggtcactgctaaaaatatgtttgtaaatttgtgccaaaaacattttttaatatgtttgcatttcaatagcagctccgtttggtgatattaaaattgcaagcactgaagatcaatcagtagggggccggttggatgttaatgatgcaggcactgaaaatgtgggttctattgtaacgcctgtgcgtctaccatttactaacagttctgatatgtcctacagtacacccagcgagtataccatgcctctccaggcagaaggtccattcaaataactcaagtataaaatgacaatttattatatttatatatgcgtatgtgtgaacctcagattttttgtgcagatgctcatggagatgtcactaatctcagcgcgtctgaactaaaaaataagcgttctagagagtggtacgcatcattgaccaaagagcaaaaggaagatagaaacaggaaggcacgcgatgccaggaggcggaggaaggatgaatctcaaggtttatatataaatatacgcatatatgtctatatccaaattaaagctttacgaatatcttggctcattattattattttattaattaaactctttcaggtaatgtgcctaaagctacgacgtcaaaattttctactcctactcctacgcttggagatatttctattgtcaccgctggagatcccgcaggaagggaacaatgggttagtaatgatgaattattggacacccctacaacaaagggaacaggtaatgtatatccttacgtgcacttgcaatgaatggtttcacaattgcaattgtttatagttcaatgtactatgttcaaacaggaagtgtatctcaacaacccacgatcacacctagacgtctcccatttacagtgataaacaatatagcatattatgatcttaatgaaggatccgaagaacctttgagctacatagttcaaggagagacacagaacaataatgaaactgattttctagctacgaattcaggtcaggatacacaaagtcgtagaacatcattagagaattcacgaaatcctgtatcccggagcctttcacaagaccagttgcagtcacgtcgtgctggggatagggccaagtatgctgctaaaacaccagaacagaagcaagttatgctagaacgtcagagatcacgacgtcagtctatgacagcggaacaaaaacaagagatgaatgcacgccttagggttgcaaggcaaaatttacctgatgtggacattcatgaaatgaatgcccgtcgtagatcaagacggcaaaatgtcactcctggagaaaggactgctcatctcgcacgacgtaatgcacgctacgctgctcggcgtgacaaaccatgcgctgaatcaattgcgttggagtgccctgagggtagcagcccgtcgttattaaatccaacgccttgcttggaaacaaccgatgatgtgccagctacatcgagccggccaactgagcatgctgcagatcatcttgcacgatcatgcacttttgatgatggtatgatatatgtatgttttcattcatactcgcaattttgtacccttccgcacactaacttttcattccactaaagatgatatggattccttcatggatgatgacacggacgatgaatactacatgtttgctgggctaggtaccatcgtcctcatacttaaatctctctttcacttgtatagatttttgaaaactaaactccttttccgctaaacaatcctaggcgatgatgacgatgacgagatggtacaatctgatgacgacgacacgcaatcaccgacctcttcagttcctgatccgttcgactgtgtgtatagcaacattccacaaagcacaaatgttctgaaggctgagcctgactgtaaacactgtggcgccaagaggttccagtacgaaccgccaggcttctgttgtcgggatggaaagatcaagcttgtagaaaatgaaacaccccctgaactgatgaggctctggacaagctcggatccagacgccaagcatttccgggataacattagatattttaacggccacttctcattcactacccttggtgtaagccttgacaaggcctttgcaaacatgagctcgggcgtgtacacatttcgggcccatggttagatctatcataacatacattcttttggtcctagagagtctggtccagagcatcttgagctgtatttttatgatgacgatccaaccttgagtcacaggtttcgtcgttctccgagccttgaccaggatgtgatcaggactgtttcagacgtccttcggaacaacccgtactcagagacatttagaagtctagggcaggctgatgacctcgcgaactaccgcgtgacactaaatttggatcataggttggaccaaaggcgttacaatgtgccggtgacaactgaggtcgccgctgtctgggttgaaggaaacgagagaaggaaatttgagcctagcgtgacaatatacggtaacgactgtacccgtaaatgcatccagcctttctacggatgttacgatccactctcgtatcctttgttcttccctagaggagagagtggttggcatcaaggtcttccaaaggacaaaataaccatgaaggctgcaaacgagcgtcatggcgatgatcctggtaagtttatctttgtactatgttactaagacaattgataatgccccattacgtgactgcactaacccaaatgtttctcacgtgcagattgtaacagcaggatacgggtctctgtaagggactactactgctacaaattccagatgcgccgtgggattttcaatcctatacttcacggcggacgcctattccagcagttcgctgttgacatgtacatcaaggttgagagctcccgtctggactatgtgaggaacaaccagaaggagataagggccgacctgtatcaaggtttaatggacagcatccaggctggggagagtcgagcaagcgcggtcggcaaacggactgtgttgccagcgtcgttcgtaggtggtggccgaaatatgaagcgccgatacatggatgccatggccttagtacagaagtatgggaagccagatgtattccttacaatgaccagcaacccaaagtgggatgagattactcgagagcttgagcctggccagacaccacaagatcgtcctgatcttgtggtccgtgtctttcgagccaagttagaggacctaaagaagcagttgtttgagaaacatattcttggcaaggtcattgcacatgtttatgttgttgagttccagaagaggggtctgccgcacgcacacttcttgttgatcatgagtggtagatacaagctaacatctgcggaccaatatgactgcatcgtctcggctgagcttcccgacaagaagaagtatagagagctctatgatatggttgttaagcatatgatgcatggcccttgcggtccactcaacggtaaatgccaatgcatgcgagatggaaagtgtaggaacaactacccacgacagttcaaccctacaacctcacaaggcaaggattcatacccattgtataggagacgtaatgacggtaagagtagagtggttagaggccatcctctcgataataggtgggttgtctcgtacaatccatatcttctacggatgtacaactgtcacatgaatgtcgaggtctgttcgagtatcaaggcagtgaagtacctatttaaatacctatacaagggacacgacagggcctcgatatcaataaacgaggcagatagcaacggcgaaatcgatgagattcagcgctacagggatgcgaggtgggtgacccctccagaagccttgtggcgtatatatgggtttgacatatgccacatctcgccgtctgtgaggcaattgcaactgcatctgccaaacatgcacatgttggctttcgatgcagacaaggatcttcgtgatgttcttgataaggaagacgcaggcaggtcgatgcttacagcgtatttcgaggctaaccggcagcatgtctgggctcgagatatcctttatagggatttcccaatgtggtttacttggcagacagcaggtaagtactggaaaaaaaagagagagaggtgtataggtcgggaggattgtgtgtgcccacctggcagagggggagcgttactatcttcgggtgctgctaaaccatgtggcgggctccacctcattcgaagacctacgcactgttgatggcgtggtcatgccttcgttccgtgctgcagctgaaagaaggggtcttatagaggcagacaacaccctcgacgagtgccttatggaggctgcggtcttccagatgccagcgtcgctatgcaggttattcgctaccatattggtgtattgcgaacctagcgatgtccgtggtctttgggacaaacatctagatgccatgtctgatgactacaggcgtaacaacacatgccctcatgttgtccaacagatggtgctgatagatatctgaggcatgctacaatcaatgggaaaggaaatcacatcgtttccgctccctgaaattgacgaatcacatgatagtaccagaggagatcccagagagattattgaggagtcatccattggtgtggagacggacgatatgaacctctcagaccagctgaatgatgagcaaaggtccgcattcaacaaaatcatgaatgcagttggcagtgctcaggggggtgttttcttcgtagatggcccaggaggcacgggaaagactttcctgtatagggcgctgctagctacggttcgcggcaaaggagatatagcggtggcaaccgcgacgtcgggtgttgcagcttctataatgcctggaggccggaccgcacattcgcggttcaagatccccctcaacattgacgaagggtcttattgcagcttcaccaaacaaagtgggacggcgaagcttctccagatggcgtcacttataatatgggatgaggcctccatgacaaagaggcaggcggttgaggccctcgatatgagcatgagagatataatgggttgtccgcgttctccgtttggagggaagacgattgtgtttggaggggattttaggcaggtgctcccagtcatcaggaagggcactaggtctcagataacagatgccactctacgcaggtcctatctttgggattgtatggttcaattaaagcttgttcgcaatatgagggcgcagagcgacacgtggtttgcggactacctccttcgagttgggaatggaaccgaggaggtgaacaaggaaggactcataggccttccttcggatatttgcgtgtcgtgcaaagggaatgaaacggacctcgaaaggctcatcgataccgtgttccccaacctaaacgataacctgacggacccaaactacatcacatgtagggccatattgtccactcggaatgagttcgtcgatcgaataaacatgaagatgattgagcggtttagaggggatgtgatgacatatcatagttttgaccgagcagatgatgaccctcataactattacccgccggaattcttgaactctctaactccaaatggcctacctccgcatgtgcttaagctgaagataaactgccccatcatgcttttgaggaacattgacccagccaacgggctttgcaatgggacaaggctggtggttcgtcagtttggaaaaaatgctattgacgcggagattgttgtagggcagcatgctggaaagagagttttccttcctcggatacctctatgtccttctgatgatgagatgttcccgtttcgcttcaagaggaagcaatttccggttagattgagctttgcattgaccatcaataaggcacagggtcaaaccattccaaatgcaggcatctacttaccagagcctgtcttctctcatggtcaactatacgtcgcgctgtctagagcaacctctagaacaaacataaaaatactatcgatgccggtagaagacaagaaacaaaataaaaagtctaagcgtactggcgtgaaggacaatgagaagaaaggaaaggatttgtctaaacagtctgcaacatacacaaaaaatattgtgtttagagaggtcctcacagattagaagaggtatattatgtgactaattaaccgtccacaatatgcttgcttaaattccattcttactgctgagtgcttcttcatatagtttagttcacgtatggctttgtatgcattaggtgttttctgaagacggtgaaataaatcacctataagatctgatctttggatgataatatcttatgttgagtattattaaactgaaattctgcgattgctttgcacctttgttccctacaatatgtgattcacttgaatgccattgattcctagcagtatttgtgcaactggctacatcgaaaattatattttgtaagatgtttacatctgaaacccctgtacataaaacttgctattggaatcactgttgcaaatatattgtgtcactagcccgattaggataggataattgcacaaatgttttatttttccaagttataactgaagtatattaggttaatttgaaacaacagtgactaaatgaggtccacatttaataatagtggatcatgcaatttacttgaaatttatctgaagcattccatggcttgcttaaatatgcttgcttaaatatgtatgtactttcttagatagctgtacagataacggattgcatctttggcaatggggtgctgtgcctggattagcagcaaaacattattatgctcttgatctattattgtcaggttgacaaagcaatatggactatagacgcagtggaagcattgtaggcgtgtgcaagaaatggtgaagggatgcatctagcacaaatttccttcctgatgcacattcattgttaacagtaggtaat

SEQ ID NO: 46794 - DNA, 17408 bp, Oryza sativa
caaatttttgtaaagtcttatgttccaaacaagccctgaagctaacagatggcaagtatgtgatgtgaactttgtgcggtgaaagcaacctggagcctttcatctgcatatgtagctgttgattttatagatcgaacccatttatgccttttgaatgcatgatcaattttttggtcaaataagggcatctatatagttaatgtggactgatggcatatattatatattaataatatttatttagtcagtgtttgacttgacatacactctgaaactgcatgtataatagaacctgtagctgcttccgtgatcacgtcaccgctgcccacatcgccgatctactccgcggatgccgtttcatctatacgaaatttgacttatgaagcatagcatactgtggtattgcctatgattttacttgtaaggaataaaatatgcaccgacaatagtgtatttaggcgccattgttttgcagttgctgctgctttccagcagaactagcctgatgcttataagcatcagcaattccattgttttgcttatggctgattactggatcttctattaactgatgcattgcctctgcttgcctacctctgtgtgtgttgtgtgcttgtcagcactgactccagatgcgtgcagtcagcatgaagctattgtgtacatactagatactggtgttggattgagagggttgcattttgaagttaatttggttggcatgaatctattgtgcagatactgtatactgttttttttttataaaaaaaaagttggatactggagttccagtgactaattgaaaatcatagctctcttggattgagccttccaagctttgacaagttagatttgagcgtgtttgcatatttcgtacgagtacaggaaactatgcattacatttccatgatactataatatggagtaatctggaattagatggttcacgaagaatgtggtgatattttatattaatctttaatctttctcgtggattagcaactgaaaaaaaaactttttatatgcgtgtctttaccgattaaaaagggcatactgtaaaatgaactacgacaaaatacaacaaattcaactccaatgccacaaccagccaacagccagcgattgtgactcaatgttgaattaattgataaaggaaacaaactatgggccttatgggcctaatcgacccatatgacctgactgttagagtccaatgccactgccacaaccaaccaacagccaacgatttgtttgggtgtttgtgggtattttgacgtgccagaaccagccaacagccagccggcgatttttttggtatttgattcgattttgacgccacggcaagataacgctaatcgtgattagttaacaatcatcacataaatggcgccagcagctcttgttgccagccgccaccatttccagcagctctggttgccagccgccaccatttccacccattcttccggacgtctcttccgaacggctaattaccacgcaatatggagaatgccgtagtcgtgcaaccatggaggtcactctttcttcattctattatttcttctgttgatggattgtgcaatgctatcatatcgtgtatattatcttccccatgcagaattgttcggttccacgatatacaaatggatcacatacactggaaatggtggattgtccgtgcgagggtcatcaagaaaggacatctgcaagagaattattacggcgatctacaaattcgactaatactaattgatgaattggtaagtcaaaatgatttttcaatcttctttttcagaattttagatctaatatgtagtttatttccactgtgactcactgtatgtagcaagcctctcagtgcacctcagccaatcaaatcacgccgaagctaaaatctttatatttattgattgattgattttaacgacaataatttttttagtgtcttatagtcttacatctcataacatgtgtagggcactaagatggaggcaattgtttaccgtcgtcaagctgagcatttcaaccagcttttaagatgtggatctgtttatgatttctataacgtcgggtttgatccgacagaaatgatcgtgcatctaagatttaagataagatctcagttctgcatgattctcaataatgtaacaactacccgcacgcctcatggtcctgtccacatgctacgttgtccatggcgttttccagaatatgatgatattttttggcaaggcacaattctttagtagatatattgtttgattcggtactgacaaaaataccaatctttgtttagttgctagcaaatgaaaaactaatgtgtctatgagttgtgcagatgtcattggattagttgtgcatgtcggggacattgagttcaggagtttgtatttgcgtcagacgccgacaaggataatcgcgctggttaatcctaggtacgacatgctccatttttttacatgtattaattaattgagatcacacaacactcatgttgcatataatttttgtaaatcaggttgcagataattttcgttcgtgtatgggaccaacaacttacccgcaacttgactaggtggcgctcagcacggacacatttcgattgttttgtggctacgctgacgagggtggacagaagagcaggtaaggaagcccccctctatttctctaacatatttgccaccgtgataaatcacatattttaaactaactgacattttccttttgtagatgaactatcaactacttatgagtctgacataatttttaatcctgattcagcatcagcaaatgaattcaatgttttgcgccaggcattagcagtatcaccttctaatgttcaagagcaggttgaagagtctatcggtagaagaaaccttcataattatcaacgccaaaactagaagatttaaatgaaggcaactatagttgcatttatttcgcatacatataatgatttttcgcttccaagtttttatagtgtcatcagctttgttgcttactcagaataagcatcacaattttataatctcaatatgatacaaaagttgtatgccactcatataaaatgatgtccatgaatctctatgaaaagcattttttacgtgcgatcaagatgatttttccgagcggaggatttgaccgtatgtacctgagtgtctggaaaactatatattttcacgtgcgggcggcccaaccacattgtataatcgattaacccgtgcggccaaatcataccgtccgcatggaaacaaattaaaacgcaaaaatcactgcctgcccgccggccagcacgcatccggccaccgcaactcgtcgtcgccgtcgtcgcaccgcatcacgcatccggccgacgccgccatgaccagccgcggccgccgcacacacccgaccgccgccacactgcataatcgattaccccgtgcggccaaatcatacagcacgctcagaaaaaaaaattaaaacacgaaaatcgctgcccgccttccgccccgtacgcaaccggcgaccgcaactcgtcgtcgtcgtcgtcgcacagcagcacgcctccggccgccgccgccgtgaccagccgcggcagccacacgcacccggccgccgccacaactcgtcgccgtcgtcgcgccgccgcacgcactcggccgtcgtcacgtcatccgaaaaattgttttatatctaaatcgttcgctcgttgcttgcttctggtacttcaaaagctaagtgctttgatttttttgcatgctactatgcactcgtcctattaataactgagaaaggatgtatacaagctatgggcctgatcggcccatatcacggtgcaatgaaacatgacgagctgcttccgttttgtcgccgcgagattgccgccgcgcgtgtagcaccgaccttccgtttatcccgtcggttcccacccaggcatcccatccactgcattccaatcgccgccgcatccaagcgcctttcatcggcggtcggctgccgcgaccgcgacgacgctgccgccgcaagtgcaacacttcaaatcgatcttcaactgcaactgaattttgaagaggtgcctttctactgcactatatgtgaaataagaggtgagagcaacaccaccacgttcttgtggtatactctcgtttgttgcaaattgaatttccatgttatctgtttgtctaatattacaattttttttggcaacttcaatgattcacttccaatagagtgtcaattacaacaacatgatgtcggcaaattatcgcacacacatctccaaccgggttcatgcccccgcgtcagaacagtcgcctgatgcatctcaacctgtaacaatcaaaaaaccatttaacaggaaaggatatttcacatgtttgttattcttcttttatttgtcattttgtgcaaaaatttttatatcaaattttcgtaagttgagggtacgtacctccttttgtatgtttaccgttactttatgcatggctgcaggtcagtagagttcgatgagattaagatggaacacgtcttccgaacatgctggaaggtgagtgcgaaggtggtgttcaaatctcccatgcagcaaaacaaatttggtgctcaatatattcggtttatcctaaaggacacaacggtatgtcacaccaatcacctctctcctcctaattgctagatataatggagcgttgtgcacaaaagttatggaaattatgcctttattctatatgtacaatttaaacgtaggatacaaggatggaagcactagcgtatgaccagcaagcagatcgttttaatggaaccatacagagtggcttagtctataattttactaatgtggggttccaaccgaccgatgtgcctacctatgccaacctaaccatgcaagctaagttttgtatgattctgacaccaaagacagccctacgcaagcctcgttttgtagacttcagtgctatttttaccgacgcgataagtgatgatatgttcataggtaaagcaacaaccttcaataactattttcatccctttttttgaactctatagttatgttcattacataaatattcgttcagatgttgttggtgtgcttatatacgtgggagaaatacatcatcaccaactttatggacaaagcttacctactagggatattgccttggttaatcgtcggtgagttcattttcagtttttcctttacataacatgttctcatattgtgagtggtccctaatccacttttagtactacagatataaggtaatctttcttcgaatttggggtgaatatgcatctcgacatacagtgtggtggcaagcacttgcatcatagtattactgcatgtctgctacatgtctcaagaaattagatattctaaccggtaagtaacaaatcatcctaataggaattactatttgaccattttgtttgcgaggtaatagaactgaacactgtcagactgacttgcttatcgtgcagagacattaactactacggtggactccgaattgaccaactctacagattcactcagtgcacctgagttgggcgtgattcgtcgtttattcgttagttctcgtgaggatgctcaacggttcactcaagcagtcgtttccttgagagcgaaatttattactattgcttcccttttagaccgattggatcctcaaggaatcatcagacgagatgtgcctttgatacaacaagaggatactatcgcccgttttaaaaaagcttaagagattgcttttagattcatgattttcgttatatgtttaacatttgtagggatgctctggtctattaacgttgttttttgggtcgtagaaacataaattaaaatgtcctattatttcgattatgatgatttgttatgtccggatttggtccggtatgttcgaaccagataaaaaaacacatggttttccgatgatgcatatgttcccccttgcaatgcacgtgttattttcatacacaaattaaaccagaactataatattatgaaaaaatattttacgtcctaattaattgcatccggtttgttcagaccgtttcgaccaaaaaatttaatcgtgatacattccctttattttttttaacgagatatacttacgtgcacggtccaacaattttgttctctcaatttttttccttctaattttaatcgtacccatgatatcggatttattcagtttcccgaagattgatggacaaaataatcgaaggaaggaagaagcgtgaaactgcctcgactcctgcgtacccaggacacgtgataaggcccatcaactcatccagattaaggcctatataatattagtcagtcaagaatcactttcgacttgattaggcccatcaactcataaagattaagccctatataagataagctggtgccctgtttccttgctaagtgttgccgtgatattcagtttgatctgctcgtcgtatcgccgccgcacaactcgccgaataccaaggctggtaaacaagcgccgccgccgtcgcaaaatccaccgaaaccagactacgcgaccaccacacgatggatgcatcgccgtcaaatccgccctcgtcgactccgccacatccgcagactcctccgccactactgttgttgacgacgccgccgccgccgccagtcccgtcgtcgccggctccgccgccgtcgccgccgctgccgccgtcgccgccgccgccattgccgtcgccggctcctcctccgccgcccttgccgtcatcttcggcgccaagcaatgtcagcacagatattgatcctgtaagttaagcacccagcttaattagtccatgaagactatcgatacatatatatatatatatatatatatatatatatatatatatatatatatatatatatatatatatatatatatatgtgtgtgtgtgtgttctattgcgatttgggttacttatagcaggcagtacattagctagctaatgttaatgcatggtactgtagattaatgctatacactgtacgttacttgattattaattaaagcacctagctcgccatccactattatattaaaaaattattacttacaaatatgtcaattgcattaatatatactcctacactagcttgtgcgtagtgctcagggttgcttctttacttatatgaggaactcatctctcgcactcgcaaaaccgagggactcattaacgtatgattaattaaatagttttcaattagaacaaatagatttttatggttttataaaataactctaacaacataactcaacataaaatcaacctggccctcagcttattttacaaataatatataatactctgagtggtatggttcaccaagaaaaaaagattaatagctatgatcgagcaaaataaagcattgcaccaacttatgcaacaataatattgacatccctgccgacgtgttttttgtttagtgttatatataatttccatatgcaatatagatatccttgcttaatctcatgtggtactcaggtcaatcaagacgccattcatgctgatatgattacaaccccaccctcgaagaaagcaaaaaattcggaatccgaggagcatggagtatccaaagtcagcatgccaaatattgatgtaccatcaaatttgatacgatctatgtttggccagacctacaagtatctccctcaaggtacattattgttttcacatactcccttcattccacaatgtacggcaaaattactttttcaagttgtttcataatataaggcatatatgcatgcatgtcattaactaacacctcttctccactaaaatattattattttaactctccactaagacctctaattttattgggtgcatgcataattatctcttggtctttggtttaagagtggttgtgctttatatataaaactttgtgatatcagaattcatttttttttgttttacagattatgaattaacaaatgaggatgtaatggccatatttttaattgaagattcggctgaaaattgtacactggtggacatgggtcatttttataacaagaaacgtcacttaacgtgccttctctctggagataaatttttgaacgatgatgtaagtaaaactgcctatgatgaagcaacgttacaatttaattgccaacatattctttagtaattgcagatttttaattgaatcaacaggtcatcagtgcgtacatacactgtttgagtgagcaagcaaataacgataagaaagtgaaatatgaaaacccgtttctttctgacatgctgaaagcggctggggtcaatggagtaaatgaagatgaagataactttattacaaagatagtgaagaattacctacaccatgaactggtattgtttggctctctatatttgatagtatttaagtttattatttatttatatatatagatataatataatataatatatgtcctaactccatatgtcttgtttagatttttattccaataaatatgaaagataatcattggtatttagcggttgtcaacatagaaaaaaaacagatacaagtacttgattccatgtgtatgacattcaatcgtgctgacctcgcaaatacggttagtgtatatgacatgtgaactctcttttttttttaagattgtaattcatttatgtatattgctgactgtaaatatgataattgagcagctacaaagactacaatatcatcttaatattattggacggcaacaggacttgcctagccacaaatggggtgacctcaatgttatcaagtggccaataatagaacaactaaaagaaagaattcaggaagacaggtatactacaaataaatttttcatgtaatataatattaatataagatgaatgatatatttcaaatggtgtacggttgtttagtttttaatagttgtacttatactttaaaacaatgcagttcttcatgtggactattcatgctcaaacttatggagaattggacaggagaatcactttctcgttctattacacaggtgtgtttcttaataaaaaaatagttgatcaaatatcttatctatttaaaattaaataaatttactttttaatgcgcaggaggatattacactttttaggtccaaactagccagtgtattattacgttggaaaacaaataaggcggtcatgacgaccggggaacaaatcgaagataccaaagatagtgatgacgatgttgttatattaggtagtcatcaacggaaattcggctctacaagggacatcaataaaactaaagaagtaaacaaaaaatatagttcactactctctgtagtatctaagatgagtaaacaagagttgataagcggccttctgcactacatccaacagattaattgtgctgaagccatggagtaagccactgcaatgcattgtatacacaatcgtaattcatatatgcattaacttattttctttgattgacaggaaaatatgggtacaaagttcaaggccgcactatattagcttgagtctcaaacagcttcaaacaatactaaagaaggatgagccattggaaagtgattgcttcaacatggctattcgtaagttcatgtatgaaaaaatcgagatgattcataaaactaaacaagcaatatcgaatcattgcttggacttgcaattttgggtaagtttttaaattctaatgctcatgtcattctctattgctcatgttattacctataatcgcaatatcgaatatattgatttatctattgcttatgtaattgaaccattttttaaatcatgtagagtgctactggctttggtaaagtcccggtccaccatgacaacataaatcttgcagagaccgtcggtagttggtcggaaattcattacaaactttcacagtgcaaagcggtaagatcgctaagataccatcctatatggccgtgttttatatattatcttgacggatgatcttttgtagattcttataccagtacgccatgctcgaagttttatcgtgcttgtagtggaccaagaaagtcaaacgctctatgtgttagacccaaatccacttatgccagaatataaaaataacccaaatatgagatacaccagaaaactgataactatttgtgatcacttcaacaaagctatgagaaaggcatgccctggctctaggtggaatgaagacatcaacttgtggaggcaagtaattgtcaataatccggtttacagcaggtaagttatcttcttaaaaactcgttcaaaccaacaaatttaactgtgtagagaaagggaagctaactcttcaatttccttaggagtttatcgggttttcttgttcatctcttcatgtgtacatggaataataaagaaccacatttgccggcaattaatgtaagtcttgacaggcattaattattcatatattacattattatatatttaccaaaatttaacttattaaatacatgtgcaggatggtgacgagctaaggaaactttttttgctaaatctactgatgtaccaacaaaatgagtgtgaaagcaacatccctaacggcgtacaagattttctaaagtgtataaagaattcacaacactagggtagttatttaactatatggaacaacattagggtttaactataatatggagtgatttaatttgaggtaatcatccattagaaatgccgtatctacaaatgctggatgttctatattttttgtttgtgctttatttgtatgatatcatcaaattttcatagatgtcttctatctatgttactttttataatttatgtagtaaacgccatgagattgtttcattacgatgccatatttgtcttttcaatgccagatcttatccccgtgatcaacaaaattccccgtagcaacgcacgggcaccctactagtatgaaaaaaaggaaaaaaggcctacctattcaaaaggagcccaactaaaaacgatttctatccctcccaccatctatctccccactatttcaggcccattggccaataaaaaaaagcccaaacatctaaccctatctctccacctcaccaccatccaactgcccggaggacatgacgcgccggcgcgccgccactcgctagtctgcgctccgctgccggcccgcccgaggagacgacgcgccggctgcctccgccctccagcctccagcagtctacccttcggccgcggcgcaggcgcgcacggcgccgtcggcgccttggcggctcgggcgctcggcgcatccggcatccccccgcggcgcccgcctccatgctccagccgccgccgcccgccggtgcggcgccgcggtgacgagttgccgcctggcgcctgcctgcctgcctacgctccaccgaggcaccgaccacggcagcctgctagcccgcagtcgcaggggcgcagggccccgcgccgcgtcgccgccaccggccaccgacctgccgctgccgtcgacgacgaggtgacgaagtcgatacctcactgagacaatgactcactaactcttccctagttggctagttcccttcatcacttcatggctaattggtacgaagtaggaactttggattaggaatttatgatttaattcatacttgaatgactgaatgtctgaatctagcatggattgttcatggttgaacattttttatttaaaatttgaatataggaatgatttatggttaatatagtatatagtatcaactactatattagtgatgtaaggatgagaatttcacaaatttgatatgttttgtctattaatagtttagtattatactctaatatgcttaacacattcaatttatgatcaattctatccctgcatctatgactttatgaaatcatgttcataccgttatatattatacaaactttgggttgaaaatttttttcttcctcttctaatttcgaatacccaagttgaaaatcctgggcccgccccttctgccgatgacgaacaccccgccgtgcagcggcgagcgcaggatggagaggcacacggcgccatcgctcctcttgtacgagtagtgctccggcgccagcttcatggcggcgtccttgccggcgaacaccagcgtgatcgccgggagctcggtgtccttcgtgtagcacagtacggatgagcccttgtctgctagcggcggcagctgcttcttgaggtggtcgaagagcaccgggttgaggaacgtgtaaagggtggaaacggtggtcatgatcgcggcggccttgtcgctgacgatctcgccgctggcgaccttgatgccggtgatggcgacgaagtagaggttggggtcaatgttcggcgccttgtcgacgccgacggggatgagcggggtgctggtgctcgcgctggcgccgcaaccgcgtcgtcgtcgccgagccatgcgaagctcctgagatcgccgtcgatgaagtaggcgaacctccggaacgacgcggcgaggacgctgcgcctgccgaggccgacaacggcggcgtccttgcgggaggaggaggcggaggcagaggagcacatgtacaccacagtgtctattcccctgcttgatcagtctctcttctcaccgacactcgaagactattgacgattgagttttaagactttgatcaccatgcttaggcagcttagcttaaaacattaattgaatatatatatattggtcagggttttcttcgacatggttttaaagatggactagtgggtcacttaatatacgtggaaaattgatgaggacccaactagttcggatataaccatgactaccttatgtattgatcaaccaaagatgcatatgttctatattagatttacttgttatatatttgaactaacgttgttacacaatgagtttgacgtgttttcgtttgtagacgtactttgattgtgcgaaagaaaagagaagcgtaaagaatgcatggatgattaaagaagttgattggggaccaaaccaagaccttctccaagtccacttccatttcaccacgtcacttttgatccatagaagataagagatcaagttttacacattttggattcggattcgggcctctagacagcatcaacttcaaacggaccgagctgctaatctagaaggaatttcggggcctatgagtacttgttggaaagcttatggagtctactttcaaatggttttggacccacgtcaaaatttttatcgagctgtcgggaatctgcaaaataagtcacgtatctcatccagtccgaatttgatttgagttttgggtcttgtaattgtgtcgcggggttagcccaagagggtatgcaccctagggcaaccctagaacgtccctaatcatatttattcagtagccgtcatcgttgagagtcgggttttgcttagattaatctgtcaagaaccgtttcaccgccagatcggtttgtggaacaccaaatttgagtgcttaatcattcatatgcaatttggttgcaatctatcttgttcttgcttgtgttcttcgattcgcatgcagggattagccttctcggcgagggcaaccaggtttcggcactgttgataaccagaggagacgtggtgctgcgattgcggggttcagtagcgtgttcgttcagaagccggatcgaattgtgtcgcgactccgcccaaatcgactgtttatcaatacatatcggaagatcgggacctaacatccctcatcagttagtatcatagcgcggttgcccgttaggtaatttatctacccataacaagaaaattgccacacaaaaatattgcatccattacctagccaatttgagccgttgcattgttctattaatttttgcgtcgttgaattttagattgcatcgtcgtgtcgagtgctggtttagtttcagatttaatttttagttgtgagtattgcatttgttcatcactttgggttagtcatgtccgtcaatttgggtccagttttgcatctcatcggttgttgctgggaccttgaaaaatcgaatctactaatcatcaggtttccgtttttgtggtttggaggagttttctttgagcggtttctgtgttgccatgtcggttctgtgttcgtgctttttgtgcacacgttgaggagagaaacagattggcatatcggtttgttttctatagggggtttatctgatctgtgtcgtcaaacggaagaaaatctccacatattttccaatcttccacagtagtctgaatccaactcgtccttgtcacggccgacccccacctccacctcacgggtttcttccatgcctcctcctcgatcaccacattgttaggtattttggtggttgtagatttgagtttttttttaaaaaaaaaggaacctacatgcatgatgtgagcattccatttttgagctggtccaattttagttttgcactttgcatttgagtccctacaatatttatatttacatttgagtccctggttgaggtcattgattggttcctgctgaaaaaagtaaaaagaaaaaagaaaaggttgaaaggtgcaaagaaaaaaaaaagccgcacctaaaaaaattaaaaaaatgcagaaaggtgcttaaaaaaagccgcaccagaaagaaaaaaaatcaatcatcttttgagtatggtttgagagtgcagagttgtgcattgattcatatatagtccttaatgttgtcgggtgcttgcttgagctagagttgagtctaggttaggccagcacattgactagtactttgaactattattcaactttgaattttctgattaacacaattgcgttcttttgctactatatattgtgcctcccaagctccacatatatacttctggtcagcaccactttgatccttgcaatcgctacatcaagttcttcaaggtgtcacgaaccagccaccagttgtaccgtccttagcattgctggtaagacacttattcttagtaagctgctccatttggctgagttgttgagaggcaccgctacactgtgtagcagattattagggataaccttcactgtttgttgttgtttttgtgtttgcaatgacaggtatgagtggcactcaaaatcagcaacaccaacaaggtaacaataatcgtgtgcccgatgattcttattctaaggttaagtttaaaataccatcatttttggattattatgatgctgagaaatactttgattgggagatgacagtagagcaaaagtttagtgtctaccttgtgcctgagcaacatagaattcgacaaactactagtgagtttaaagattttgcttttatttggtggactgggttagctgtagggagagctttacctactaattgggaagaacttaagttagctatgcgcgatagattggtctcaccatcttatcatagagaattaagcaagaaactgatgtgtttagaacaaagggataaatctgtataggattactatggtcagctacaaaagggattgatgcgatgtagcatagtggagggaactgaggattttatttgtcgtttttacttgggattgaggcgcaaaattcaggacatagttgagtataaggattttaacattgtcaactagttgtttcaatttgctatgcttgtagagaagaaattgctagggcgtgatcaacaaagtcaagaacaaggcgagcacgtacatgccgcgggcgaagccatctttggggctgcccaagcccatctctttccggacacccccaccagcaagcaagcgaccagttgcgtccggagtttctgcagcgccaaaaccacctccccccacgacttttagattcaggtaaaggttcttcgcaagtacccaccaagagtgcctcgtccgtcgctttgacgggatgcacgcccagcattcagtgccaccgctgccatggatttggccatgtgcagaaggattgccctagtcaacgggcatacattgctatggaagatggctacatcagcatcttcgacgttgaagatgatgaggaggaagagaggaaaaatggagagaaagacctatccatagctatatgcatgcttgaggaatgtttaattgaccaagcgcctataatttctgaagatgagaaagaaggtaatgataatggtgctacaactactcaaggtatgcatagttatgatgtgccaactatatccactacttatgctacgttagagaaacccatggtggaaacaattgttgaaatacctttgtcacaaaacaatttgcttgatttttttgataaagaatagttatgcgatgcttcacttatatctatgccataactagtgaatgagcatgttagttctatagtagagccaccatgtgttgaatttaaacatgttattcatattctagcgagaatgaagagcttaaattgctatcttctttaaatacttggggatatattcaatttaatgatctttgtccactcaattgtttagagaagaaattatttgctagatttgaattgccatgtccttctgatgtgattttttatgttattggcaattatgatagtaaaggagaatataatatgtatcgagtatatatttgtttgaatttgactatacctcattttcatgatgaaatgtattgtctagaggaccgcatgcatataagtaattctttatctatttcctctagttgtttaaatgagttacatgttggtttgcaagaatgtgagagttgcggtttttttactacaaagattttaggatccaaccatatggacatcaagaaatgttctttaccggatgttgtgatagataaagataagttcaatacgctccatgacaaggtgaaaccgaggacagtttccaatcaagaaggggaggatgatgaggacacaactagctcggatataaccatgactaccttatgtattgatcaaccaaaggtgcatatgttctatattagatttacttgttatatatttgaacaaatgttgctacacaatgagtttggtgtgtttttgtttgtagaggtacttgcttgggcgaaagaaaagagaccgagcgtaaggaatgcatggatgattaaataagttgattggggactaaaccaagaccttctccaaatcctcttccatctcaccacgcggaaaggctaatgagcgatcgatcgctggcagcgatcgttttttttcttttttttcttttcctcttttagtaagtttatacatctaaagtttacacatctaaagttaatccacctaaactttgtaaagagaatgtttataagtcaaaagtttatatacccgattcaaatattttatattttcctcttttagtaagtttatacacctaaagtttacacatctaaagtttatctacctaaagtttgtagagcgaatgtttataagtcaaaagtttatatacccgattcaaattcgaattcggattcaaatattttatatataaaatatttctatacacaaagtttatgcgtgcaaagtttacggtacaaagtctatgcacatgaatgagag

SEQ ID NO: 46795 - DNA, 4448 bp, Oryza sativa
tcacccgcccactagcaacccccctcaccacgtcacttttgttccatagaagacaagagatcaagttttacacgttttggattcggattcgggcctcctgacagcatcaaatttaaatggacctagccgctgatcttgaaggaatttgggggcctatgagtacttgttggaaagcttatggagtctactttcagatggttttgttcccacttcagaagtcctaccgagctgccgggaatctgcaaaacaagccacgtatctcatccagtccgaatctgatttgggttttggaccttataattgtgtcgtgggcttagcccaaaggggtgtgcgccctagggcaaccctagggcgtccctaatcatatttactagataataccccgcacgttgctgcgggactcaatgattattgtaagtgcaatgcggaaaatacaaaaggtattttgcccacatataatgcaagtgcaattatctaatgtgttcacataatattgtagcattgctaaaaaaatatgattgaatatgcattgtttttggttgaaattgcttgttgtccaaatttcaaatgaaagaaaggaaaggctacataatgaaaaggtttattattgttattgccagtcagcaatattgtccaaattacatgcttcgctttaaataaacagatgctgaaataaaattaacaaattattctcgaaagtaacaaactcatcacatctcgtgccttgattacttatcgttgcagtggaacaacttaaagaattacagttcaatctagtttctgttagtgttaagaatgtgatagtgaagtaactctcttgcattagttgagtagaaaatcatgttcccagagtgaacctttcaaatgcaaaactttatgatcataccaaattttaaatcagtgatcttgcacaccaatatgtagttagcactttttcaggctgaatgaagttactatgttaacaaacaaccttacctgaatgtcttgatgcagaccaaatgaccaataggctgaaactcatcgaatagtttcactgcgcagcagaaattgtgtgatttcgtaggaacataataaatactccacgaactacgaaccaaagtgaacttacacgttgaactcctgtaattgcttaacccaaatacctgcaagtgaaacaaaaaaaaaaattcagacctatactgttgtttccaaataggtgatgtgtatggaagatgaatgattaaaactccatacaatgtgcactacctttgccgttacatcctgcttaagttccttggcgattaatacaccagctgttacaggatagcaggagcctattggaccatactggagaaaggaagccaatgtggctgttgagctcggtaattatgggctggttgaatagttgatcgatcatgagtgtatgagatcagtgtctaagatcgatgtgtggctgaatcgaacggctgaaactgatagatgtgacgtggctcactgagaagcaaggaaaatagttttaattgcagttagtggggatgaattgtataggtatataggattcagtagccgtcatcgtttagagtcgggttttgcttagattaatttgtcaagaacagtttcgccgctagatcggtttgtggaaccctaaattcgagtgcttaatcattcatatgcaatttggttacaatctatcttgttcttgcttatgttcttcaattcgcatgcaaagattagccttctcggcgaggtcaactaggtttcggcacggttgataactagaggagacgtggtgctgcgattgcggggctcagtagcgtgttcgttcagaagccggatcgagttgtgtcgtgactccacccaaatcgactgtttattaatacctatcggaagatcaggacctagcatcctcattagttggtactatagttttgaatctgaaccgttgatcagaaatatggatcatcagttggtactgtagctttgaatctgaactcttgatcagaaatacggatggctagagtagtgtgcagttattaacttgcagatacaagtgtaactgtaccggatccgaattcctccgtttggatttgcttcattgcgaccttctacaacttcttgtggtgtttgaatcaccgtcaccgtcaccgtcagcatcaaaatacccgaatgccttttctatttctttttcatatccttctttgcatatttcaggagactatggttaatttggttatccatcaagggcctctctgtaaaactgtttgtacttgcagttgtaaaattgcattagcctcggtgtttggtcttcaaaatttttgtaaaaagaaaaaaaaatgagtcccggggcccgtatgtaaatcgtacacgtctccacctctcgccgcaacgtgacgatgtcatcgttcgatcggagccgtccgtccgatagtctgctcccaaaggaggtaggacccggatcgatctgagccgtccatgccgctatttatacacaccctctcctcctcgtcgtcactgctctgcatttctttcttcttcctcccaccccacgactgcactactaccagtttaattagcactttagcgagctgcgatgatcgattagtatagcctctctctctgagtttttaattaatttgttctttcttctctcgttgggaatcgaactgcggtttctttctttgcttttctttttgttttggtgttggttttggtgcttgcttgctgggttaatttgctcctctgctcgatcaatcgatcgatctgttcttggcgtggcgatgagaccagtagagatcaattgccatggcgtatatcgatttgtgctggccggatctgttcgaggcaggcaccatatatattttcgttcttgtgtgtgttcttcgtggaaacacacaacgactctttggatctaaactttgctgttcttttttaatttttgtttgggtttgtttgtttttgctgcttcaattcgtcgtttggttatcgttcatgcgagagagtcttggcgtgcagatgagatgcaacaaccataacctcacacgcatatatgcatgcattatctgagggcaagatcatctgcctttggtccatctcgatcgatcgcttcgtcttgggtcgtcgtttcctctttcttctgcttgaattgcttgcacagatcgtttaattttcgcgtccttttcgttctttttttcattttctttctcctcgttccattggtttttctcgatttttcacccgggccgagatcgatgctgccggccgacgacgtcgatctctctgtcgttcttcttttccttcttgccgtacgcggctcgccggagttttggttctttctccgccgctcgccggagttgcgccggccggtcatgtgccgcgcggctggtgagtttccttcctcttttttcacccggcagcaactgcaacgctcccctgcagcagcagaggtggtcggtcggtcccttcaaccgccgcgccttgcgcgcgacgaaaccatcgagaccgttgggttttctgacgggaacaatccaccccgtccacgtgtcagattctctttttcgtctcgttgatcaagtcgtgactcgtcgtctcttttctgccgtgcccgacgaccttagttactcatttattactgttactgctactttactttcttcagcttaatctgttgcttcgttctttttctttttggatggcgcacctgctagctatctggatctcttgcttcttgaagcagccgtatcttggcctgcttctgcttctgctgtgtgctcaactgctcatgtgcttgtgccgatgataataaatttttgtcacttctgagcgatgcaatgcatctatgatcgttactacattggagctgaaagttgaggcacataatgatttgatttctctattgcccaatggcattcttttttccctttctttctttcaagaaaagctttgctctgttttcaggacagtgtttctttgggtacacagaggcacttgtatgaattgaattgtgtatgcatataggatgttatgtgcgtgttctgaggcccttgaattgcaatggtgatacgaatcgaatcgacgcaaggctgaaacattcgtgttttgtttctttgatctgccgctttggttacaactcagtaggacaattgttagctctctgtttctggtaattattgatcttcagtttggacacgaacgattctgcttttgtattttgccttctgttcccttttgttatggctgcagaaaagtttgtgatgttagtgtactgtgcctatgatgaatgttgaacctgtgtcaggatttgaaccactgggcatgtaaatctcactaggttttttctgaggcatgttttgctatgatgaactgtaaatctcacgggtttaccttgtctcatcgattggccagtgatgatgagctttacatcttactgacactgatctgtatgaagttgcaatacaacagtgcgagcggct

SEQ ID NO: 46796 - DNA, 11084 bp, Oryza sativa
tatataaaactaacagacttaatttgttgatttttcaggattctgtttatttccagcaagtatgtgatgtgtcgataagaactccaggctctagtattaacacatttgaaggtcacctcatttacctacttctcgttttcctacaaactcactgcattctcctggattttatcaagtaaaggttttgcgttctggatcttgtggatcgaccagtgatgacaagctatacatcacactgattatatgaaggatatatagcataacagtgtgctgtgcggtctgaggctttgaaatagtcatttctttgtattccacgttcttttttttttttggttcagttcaatgtgatcaccagtttgaatcatttagcatctgaccttctgcttaactgcagtattcttgatcttgtcgattggccggtgatgacaagaccattgtcatactagatattgatcatatgaagtatgtaatgtaacattctgcttctctgaggccttgaattgttcattgccttattctgcatcatttagtatttggctttctatttgcattgtttcaaaaaatgtctaaggtcaaatgtttctcctctttaggtcatattcatgagatatgcagaagctatgaatgcatctttgtacatggccacatgatcataaactctctctgatctgccacttgattacaactcgcaataactgtttgctctttgattctggcgagtaattaatttgcagtttggacacacataattctgcttccgtatctcgccttctattattccctttgtttatagctcaagaaaaggttgtgatgttaatgtagtgtgcctatgatgaaatgtttcgacctgtgtcaggatttgaacaactgggcatgtaaatctcagtaggtttttttttgctgaggcatattttgttagctgtttgaagggaacacaaattagtctatgatgaaatgtaccaaactagtggaacttgattaataaaatgccttttaattaactgtgttctcccgtgttatgtcaagtacaggttttgaccttctcgatcttggtggatcagccgctgatgtcaagtacattctgtttgatcttattaacctctattatctgttatgttgcagtgtgtgtttttctaccttatttgacttaaataaaaatgaggactcgttgacttttccagattcaacctatttccagcaagtatgtcaatcctttctttgttttctacaaaattcagtttactcttctgcgttatatcaagtgcaacattttagggatgagaagttttaccttctctcatggattggccagtgatgatgagctttacatcttacagacactgatctatgtgaagtatacagtagaacagcgcgtgcggctctgaggcattgaattagttagtgtcattgtggtctacaagattcttttatcccagttcaatgtcatatgattatcgctctgcatcattagtatttgtccttctatttgaactgcttcaaaaaaaaaatgtctaaggtcaaatctttttcctctttaggacacaattttagtctgtgtattcaaatgtatgcagaaactattgaatgtatctttgtacatggtcacatgatgtttgtatcaccacccatctaaagcaggcttaatgtcagtctgctttgtacatggtcacatgatgtttgtatcaccacccatctgaagcaggctgaatgtcagtctgcatgtgcagaaatgtgattctgatggctaacatgatagcatcttttcaacattctgcttcagtcttattaccaacccacaactagcatttggcttcagatatgttgcagagctttgtttattttcacttgatatctaacttgtataaacctgacagacttaatttgttgatcttcaggattatgtttatttccagcaagtatgtgatgggtgtagataagaactccagactttagtgacaactgagttgaaggttatccgatttacctactactctactaatagaccaaataggcatagtaacactatattctttcacttgataccaagagatgtgatgtacaaaaaggaaaatgtatctgtcattttgattttttttttttgcacaagatgttgcagatattatctagagtttaaacataaatttcgtgttagatacagtaaatggtgtatcatgtactttgattttctgtgagagaggccagtggaagttttcaaaaatcatttgtacgtcatattaccaaataacctgctgtagtgtttgaaagcatttggtagaggactccatggtattacaaatcaggctacaataggaaaattatagtaaactgctatggtccagtattgaaagtatcaaggcattgagaaaccataggagtcccctctttattttcactgagtcctgttttctactgtgttctaagcaattcacaaatagaagtcacaaagtataacctttgatcacttgagtagttagttcctaaggaaataactactgaatgccattcaattgagacagtcataatatctccgaaacctgccatagcaaatgttttcggtttaggccacaagagcatgtcatataacaagtaaaatgatgatactcttgcatgtatcttacatgtattggcatctccgcaataagcagaccactggtttcttctagagccttgagagtggctacctcgccaccaacaaccatgttaatcacgattccatctgcaccaacatagatcatcagcaacagtaacactcaacaatatgacaaatgatgataaaatgatattttcttgacgtgcctgctgccaagcatgtagacatacgtctgaagtaagcttcctgaaaaatctcaattgaaacttctagtgagcctagaattaaaaaaatcaaaccagaggagttcaaagaaactgcatagcgcgtactcaacagacatcctgaaaaacaagagagtggctcaccttcttcgtgggaagctcatagtttattagcacgcgagccataaggggagcctctcctagtgttgcctggggcaagcaggcatctgttgctactacgatggttagttttgaatctgcactttcagtcttgggactatccgcaatatcagcagcagcagcttttgtatgattccattggattgttgcttgccggaacttgtcaagaacagatgctcgctctgattcagcctgatcgctgtactgtattgacaaaaaccattaggaatgaagttggcaacaaaatccaacacaggaagtaggtagcaaaatccatgaacacaataaagagaatttagctatatcaggggtacataaattcagtttgtctaattgcacaggcatatctgtaattcgtttgggtacataaattcagtttgtctaattgctcaggcatctctgtagttcgtagatgcagctacattattccatatccacagtttttttgatgaattgaacagctacctaccaacacaagcgattaacgtaaaatcacagaaaagtgtacatcaatttgcagcacaaaacgagcataccatatacagctacattgtgccatatcacagtttttttttctgaattgaacagctaccaaaataatcaattaacactaaacggcttcgtaaaatcacaggatcaatctgcagcacataccagcggcgacaatgacacgaaggggaggctggcgacgtcggcgcagacgagatcgagctcgtcgcgggaggagacgccgacggcgatcggcagcgcgccgcggcggtcggcgacgacgccgaggagctccaagagcgtcctctgcaacacaggcacggccacagatttaaaattttcaattcacgcggcgtgtgccctccattagtcggagctgggcatggcatggtcaccatcggagagagagagacgaggggcggtgaggcctcgtaccatcttgaactggaggcggtcgacggcgaggtagaagtggcggccggagctggggaagaagaagagggggaggaggaggtggattactgattagccaacacgagacgagacgagacgagacgcgagggtgggcgacgggggagattgggggggcgctcacctggggtgggatggcgtcgcggcgggagaggtcggagatggcagcgcgtcggagaactccgcggcggccggagatctcatggcggccggtggtgagaaggcggcgctcgccggagagaggagggaaaaccgaagcgggcggagagggagagggtgggggaatattcctttcctccatggtggaatattccaccaccgtggaaagcccaatgggccatatgggtctctcagcccaaatgaacatcggaaattctgaattaaggcccccatttagttcccaaacagaaactttttaccctgttatatcgaatgtttaggcatatatatagagtattaaatatagaaaaaattaattacacaggttgcgtgtaaattgcgagacgaattttttaagcctaattgctccatgatttgacaatgttgtgctacagtaaacatttgctaatgacggattaattaagcttaataaattcatctcgcatattacaggcgaaatctgtaatttgttttgttattagtctacttttaatattttaaatgtatgtccatatatccgatgtgacatgtcagctcaaaattttttgccaactaaacaaggcctaaattcatcttgtgcccatgatcttcttcttttttttcaaaaaaaaaagggttaaactttaattccagttttgaagtttgtctcccttttaagtccaacgggtggaaaactgaagttgtcgttcttaagaaggaggaaatattttttaggggaaaaaaggacatatatttgacacatagaagataaacttgtttggtttgatccctacaaattttcggtaatgtaatatgagtgtgacaggttgtgtgtgtatatatgtttacagaagcaattgcctcgtacatatgaatgtttatttacatttacatttttttataggcattcataccaccggatgaaattgaagccataatcaagtggcgcactcgagcgcctaagaaaagagagccatgaaaagcatcggtcctggaggaaagggaaatggtgttccttgaaaaaaaaaaaagcttactatcaaattgtagtaggatatagcagatcaaaccaatgttttcttcgagtaataacaatctcgtgtttatttgatctaccttggtatctgtactgctgtacaattatgtacatcgtctcagtcaccaaaacaccagttgcaaaacataaggcggtatggtaccaacttaacctacatatgtacatagtgatagtatgccatccagtcggtacatcatgcctaaacctccccaaacattattttgtgtttactgaagcactagtgattaattagctgcttgctgagctaaaaaaacccggccccaaatcctatcctcttcatcatcttgagaaactcctcgtggtcgacctcgccatcacctgcaaaaccaaaaattcggattattatccatccgtcctcattcgatcaagtttcgtgcaccaactagtccatcaattatggcagcatatcacatgcacataagtttcaatttagctgtttaggacgtattgagcgtattaggtgcacataagtttgggacgtattggtggtatgcaccggctaacaaatgctacagaaaaaactataaaaataatgtttatacatctccatctacatgcaaattttcacatttaaatttattatctttcagtgataaaaaaatagaaaagaaatgcgacagttttaagggtataaatttattaaaatatctcttaataatactctatatatttgaaatcaaaactttatatacacatgtcgaaaattaaggaaagtattttaaactcttgaggggtattgaggaaatgtcttctcatttgttcaaatgctatccaaatagtcataagaaaattatgaaaaagaaaattgacaccattcataccatatacatataaactacttaaagaattaaaaaaaatcaaggtaagactcaactcacacattaagaaatagacaaattcacctttggatttgtcttatttatttctccacgggtagattgaatttgaatataatttttggtgtagtgaaagatgttagtatactctaatttgcaaaaaagaaaaaagaaattttcacaaccatttacattaaatttgagaggaaaaattacactaggggacgttcccttgagggaatagaatcctatcctgtaaaattagatgcacatgtaatttgtgagtgtggcgaaagcacctgaatcttatgtgcacagaatatgtcccagttaatcgcttggtaaaatccaagccaattacagaaaagaaaatgctgggggtgtgggagaaacaacaaatcagaccgttctcgtcggcggcttcgatcatctccctgacctcgtccagcgtgaagggctcgccggtctcgatggccagccgctggatgtccacgtccgagatcttcccctgttcatcatattcagattcagattcagattcaaattacgcacaacaacgaccacaataacaagaacaagaacaagaacaataagaagaagaagaagaaggaaaggacactgacgttgttgtccttgtcgatgatcttgaaggccttgttgagctcctccctggcgtcgcgctcgcccatcttgtcggtcatcatgtgcacgaactcgtcgaagtcgatcgtcccgctcccgtccttgtccacctccgcgatcatctggtgtatttgctgcatttgcacacgaaaacgattctcatttgcaatcgtcgtcatcctctgctttttttttactgtcagcttagcttccagcaactgatgaacatatcggttcgttgcttccctcgtcggagaaatggattcagaaaaggaagagatatatgctcaggcaggttttggtacctctggtgtcatctcaaaccccagtgctctggaaacacacagaaaaatgaacaaaatctcagcttgtagccacagcttataattagtactaggatttaggactgtttcggcagttgctttggacagttcccatgttatccgttatcacgtttcatgaattgctatagagcgagttttgtaaaaaaacaaaaaatcaaaacaaaaaaaatatacatatatcatataaatatagcttttaaaattttaatatttaattaatcatgcgttaacaattcaatcttagccacaatagtattgaaacatatgtacctcatggcgacgttgagctcctttggatcaatggtacctacaaggatgcagcaaagcaagcaagcaagaacaagtgagcaattaccgagtttcagttcatcgatcagtgcaaagaggagaagaggcatgaggaaaaaaaaattcagaacctgatccatcggtgtcgaagaggtcgaacgcctccttgatctccttcctcttctgcgccgtcagccgcttcttcctcacctgcttctccctcctgtacccgtcgccgccgccgccgccgccgccgccgccggcggccgacgatgcctcgtcgtggtagtagcctctgtatttgctcgcctgcatgcgtctcgtggttatttcagttcagagtttttcagcgaaattttttggttatttctgctggttcagactcttgctctgattctctccacagtaactgctgcttctgtttatccttatcctaattgacttcagagaagcaaccactgggagcaaactgaaaatgaactctaatttttttttcaacctgaagtatgtacatgtttaggatcacggttacgttgttctaataagcaattcttgaacttatttaaaatattcagataacaaggtttcatgcgcaaagcttacaaaacgatatgttgctaacgaaattcagctacttggtcagaaactaatctcatcaagaaaccggatgaaaaccagacaccaaaccaacaaagtaaaattaatctgaagaagtcgacatagccataggagaatcagcatctcaatcagcatatctgcagagggcaagcttgcataccatggtcaagtggtaatcggagctgaaactctctcaggcttcagagagatgatgatcgagaccaaactcctccagagcacctctgaagtctgaaacctcacttgcttttcctctcctctcctctttcttgatgcttcgtttcttgaaggaaccaaagtgagatggactgatggaggaagaaagggcgagtgattaagaatggtttcttgtgccgtgacgaatgaatcgaacagtgcaaagtaaagcgagaggaattgaagaaaaaaggaggagaagaaagcgatggggatttggaaagaacagcacagcacgtcagttgagtcttatcactcatcaggtagtcgtcagggattattcctgctccttccgggtccaaatcactttgccctgggtcctgggtcgcagccagttctcggcattatttgcacccaaaaaaaaagggttttggtttcttttgttggctgaattctggtgtttgtaccgaccgaagctaattttggattttatgactcgtttggatgggaagaaatttgtaggaaaaatataggaaaatatttacaatgagagcctttgaatgatggaaattgggttaaaatgaattttaaaggataggcagattttctccatattttggtacctcatgtttacaaatgctatgagaattccaatgcaccttctttctttctcgctctgataaatcaatatgtaaatatttaaaaaagaattgtttttttctgtgagacatccaaacaaacaattcatgcggtttatttcatgtagtatttaaccaggcatgatatttcaatcatgtttttttttccattctttgtttcaaaggaccccttaaattttaaaaatacttttaattaaatcatttgtttgccttcttagctattattagaaaaaagaaactgacaacgaaagtgacaaaaaaaaccctctagtactaaatccaagctcagccaatcacacatactgaatgtaacgggctcctttgaaatgtacgaattgaaaatttcatagcaattagtttaactcattcgaaaatcctttataatatttttttcaggaaattagttaaaatatctttgttctaaaggaggcctactactgaaagtaactttattgacatacatccttttgatttcaggagccttcatgggttgctgttttatctggcaaatacagaagtgagcaccatcgttggacagcgtagtctctctcttttggttgaattgctgattgaaagcaatgttatgtagtggaagcatacatctcaccagcacgaaagcacacaggctgtgttctttcgaagaggttaaaaacccctcccctccacacgtaaaacggagcaatggattaacgtataattaatcaagtgataacatttttttaaaaaaaaggttaatatgattttttaaaacaacttttctaaagaattttttttgcaaaaaaacacaccgtttaacagtttggaaagcatgcacatgtaaaatgagagaggtgaggttgagaacctttactaaaagacagttgaaagtgacgtgtataacttcatacagaatggttcaattatgatgacggtacaactacagatagaagatacatcctctaaagtgtatactgtaacctaaaacggaggtagtagatgctggtaaggtgtataccgtgttgtgcatgtgtgtgatggtgtacgcatgtgtatatgttgtatgagcgaaaaaaaaaagtttacccatcgccaacttatccaaaggagcttctataaaatagcatcagctctaactccatctttcgtagagctgtaggccagtcaaacaatttctttcgtagagctgtaggccagccaaacaatttcaactctacttaaaaggcaatagagcatgctaaagttctttcccaaaataaactagagacttggagttgtgttttggctggttcacaaccctacttcaaatccaactattttaagttaaatttagaagttgaagaccaagatttgatcaaactttttagtttggaagaaaatctgcctcaaaaggtaatattagaatatcaaaattttattagatgtgatttttaattataaacttgttgttggtcataatattagtttggtcaatttttgctcctatgtttgttaaatatttgcgattaaagtggatattactttggtaataatcaaaccttacgtaccgttaatgaccaatactttgcacggatttatctcaccaataaccagtcaaaccccttatctcgtgcgtaaccaacggcgtcacgatagctctagggttcgttaatgaattgcgtccctctatatattcagctcgatctcttcctctcttccacgccggccgtccatcgaatgcatcgattcaagtggcgaatttgcaaaggtttgatctccgttggaatcagattcgtgtggaatagcttcttcacaaatataatatcttcttcagatttgaatttgatttttaattccccatcttataatttgcttttcgatcggtttcgggccatcgatcgatctctccctctctaatttttttcctactactagtcttgttcgtttgactgttttttcaagattcatggatatggatttttgcacctattttggcgtgtgccagtacgagacgaatcccggatgaaacttttggtgaattttggctggatttgctgtcacacattcacgtgacggttcatgtcaagaacaaattaatctctcggtaattttatttttgtttttactcaaagttaaaaaccaccgttttaaacgtcagtttaaccccagcgctccgtgtactactaccaccagacaacaaaaagcaatctgaggataggatgatgcgataggcgatcgtgagcagatccagaccgtacgttacgcggctcaccgtatcctagccgtccacgtgtttagctggctggtgctggtccatgtgtgggccccacctaactcgtgacacgcgcgcgtcctttctcatcttctttttccaggtaaacttcctcatctccttcat

SEQ ID NO: 46797 - DNA, 7003 bp, Oryza sativa
cggtgctcgcgtgtcgctgcgtgcgcgcgcgctcggccgtggtgatatcccttgctcagttcatctgaggcacgcacgaatcgaatcaatcgaaacccattttatttccccttaagagttctttctcgcgaaatcgaattcccccacctaatatatagttagaatttcagccttacgggtggcgaatcctgaattttgtctctggattttgctggaaccatggacagtttctcacttttttcttggtttgttaatcgatctgtctgccagatctactacggtcggattgcttctttagtttgaatctgtgaaaccttttgttttcgatttttcacgtcggctgcttctttaatcttgattgatttctgatgacttccgtttcgattgtagcgtgccgatgatgattaaaagagctaacaatggtgaattcgatgaatgtgcttgcgtgccgctgggtgcgcagctatggtcagggtttcacttatcgcacgataatcgcgtgattatcgcggttatcgcgcttatcgcgggggtacggtaggggaaactggcgatatggtttggatgaattttgaccaaattcaaaattctggaaaaaaatcgaaaaaaactgaaaaaattcatggatatagttcttgatttgtaattgccaatggtgaagaatttttttgaaatagagtaagctaaattcaaatttgagggcaaaaccaaaaatggtttacaaattgaaaaaggaagaggataatgagccttaagtatcctacatattcttccaattattctcaatttctagttttctacacatattcaaccatatttttgatttttttaccctatttattttacatttacatgatttcagctacacagcccgcgataaccgtgcgaatatcgcggttatcgtggcaaaccgtgcgattatcgcggtgaaaccgcgaaaccgtcgagttttgaattcaaatttttagatgtgatttttgtgcgattttagacgattatcacgcgattatcgcggttatcgcgctaccgtggggtggcgataaccccggcccaaacgataaggtaaaccctgatggtgatatgcattcttacgcagaggcacacataaatcgaaatcgattgttttttttcctcctctcatgtgtttgttcccctattatgtgtttcttctcttctgttactttcgatgcaaccctcaaaatctgatgttttatgttttcctttttggcaaattcttgatggaatgagaatatgtaaacacggatgtaaatttatgtaaacacggatgtaaatttatccattaaccagtaatacgtactacgtaaattgaaacaaatatcacatcaaggtcgttgctctctaagaaattgaggaaaacacctgtgaattaatacggacgcatttgtacaggagacccatgatttgggtgaataactggagagctcttcgttttgaaaataaaatcggcacgaacaccaacggtggtttctggtttgtattgaatggtctaacaaacctagaaaaagtagaccatatgggatcattgtactaaactccatctaattaactactactccctccggtttaattttaattgacgttttggacaatgacacggtctacaagatatatctttaactttatttttctattataatatatataataaataaatgtatgtttacttttattatagtgctttaaaagacaaatttatatatgttgttctagtttctttaaactaaatatttttaaagttgttgatggtcaaagttataaaagtttaaccttaaccttatccaaaatgtcaattaatatggaaccgaagggagtatgtgggaagagaaagtttgaaaggaaatcacaaactggaagagagttttaaaggaaatcgcaaacaagaaaaactgatactctagtttggaaggaaattctgtttgcctcatcagttgcaaaccacacatcaagattacaggttgaagagttgcatcttctgttcagcttcagtacttccaagcaactgcgacagtgagccaaatgcacaaagcgtaacatgacgaaaaagagattctacataattgaataaacaccttgatctgatggaaaagacaccagattctatttgctattatcatcacacagtacatctgattgtgcacattacttttgaatgatgtacagaagcatcctaatgcatccttggacacagttctaatgctaggcctattgtaccccaaaggccttctggatttcagctatgactcggtctgcgacatcgggaccaaacatcctcggcaaatttgaagtcaggtcaacctcgattgacttggaccttacaatttggtccctctttatcatgttttctctctcgccttcttccatctctgaagtatgatcagcacaactatcaagccaaatttgaagaagtgccctagcagctgttgctagttgaccacgcactatctcttccaaggtaccctctcctccttgcccacagtcgatgctcatcagtattgctgtcagtgagaaggcgctgcgcacgaagagggatcgcgatcagtatggacgggcctgcggcaattcttcgaccttctcacgctgtttgtccacctgagtattttcatagtatctctctatgtattcgggatggagcgcaaggtctttccgtgggagaaggtccagaagcaccacgatcgaagttgggctaccttgtataaattccatgaggaaatgtggagcatctgtcgaggcgttcagaaagatgagaagagatgtaatgtcgattgcgccatttgggactttgcagtgtagtgaggactggagcatgaaatcaatctgtagacaagaaaaataataattcaaccccacttgtcattccttgcagaactcaagaaattattatactgtgctaagcattaggcagcttgattcaggtgttcaagtggtgagattaataacattgtttgaatgccattgatcattttggccactccaattgtatctgttcaattggtgagataccttttctttggagagtaaaaagaaatctttgagtggtaggaaaagatcacgaatgaggcacaaacgcttgagcagaccaattgttgccatttcaatcttggatgtttcgcagcactaataaatcaactaatttgagcattactaatctaacaaacaatcataatttgctccaaagagttggattgtggatcttggcttctcaaagcttgcaagttcaccttgatagggcaatcacgaatagttcggcagcaaattttcagtgtaaaacagtttcagtaaactgtactgaaacagtttcagtgtaatttactgcatttcgtcataggattgctctactctacctgcctgtcactacaatttcactatttcatatgactaattgtgctctagaaattactgcagtagaaataatctccaattaacagaacagtaaattttaattagcagcttatacttcgtggggagagaagctaagccaatcgcgcaggcacaagctaaaatctgtatgatctgacgaacaaatgtgagagaggaagggggtgccattaccgtcgatcccggcgcgccgcggcgcacgtcgagcgagcccacggcgttcccggcgccgccgccgccgctgcggaacttggcgacgtcgggcggcacggcggaggggagcagccgcgcgcccagccgcgcctccgcccgggacgcgagctcccgagccacctcccggtgcgccaccgccacctccacctccaatggcgccgtcgcgcccggcaccgacgacgcggacgcgggcgcgcacgcgcgcacggcgcccctgagctggggaggcgccgcgcgggggagccggaacgcgccgcggtggcggaggggcgggtaggagatggtggagtgggccggggaggtcgccggcggcgagcggaggtggtgctctgggcggagcatgaacgacgcgaggtgagaggggagtgagattttcctctttttttttcttatagaaaaatgactctgtgttacaaaatccatcgaaaggacatttctactgcaaaaagaaatctcgagacggtgaaaatatgagataattggcctgtttcggcttctttttgctgcggcatgcagccacagcaacgccaacaactgaacattcataattgaacttttacgagcagttcaaattaaggcactctgtgattaggtttatatgctagtttttgaaaaaaaattaagcctaaaagacaacattttttatttggttttctttaaagctataagcatttttacattgctatatatgactccaaaattaccgtttataaaacaactaagctgaaaaattaaattaaaactataagcttttaaactatctgagtgagtgtagctcaactagtttgtattttttttaaccaactcacctaaaatcaaaatctagatttgacaccgttacggctaattgatcttccaatgagatatgttgacacagtttttcaaaggtgttcataggggtagggtatgtgtgtatgggttcatagtactacctctgtcccattataagtgcagtcgtgattttccgtgatcgtccatcttatttaaattttttaaaaaagtttaaaaacataagtcacgcataaagtactattcatgttttatcatctaataacgataaaaatactaatcgtaaaaaattttcaaataagataaatgattaaagttgggtacaaaactcatgactggtgactgcacttataataggacagagggagcatgtgttatgagcatatatgtttatacttttttttgaaaagcatataaagagcacctaatcccagtgttaaattcacgtaccagggacaacaaaaagctgcctgaggatgagataggaggaaaacgatagctgatagggatcgtgtgatgggggcgtgagcagatctgtgccgtccgttccgccgcccggcgcatctcagccgtccacgtgctcgtctagctgccggtccatgtatggggcgtatggctttttcttcttcctcattctttttttgagctttgagtgtcctcatctcatctcatcacatcagctctcgccttcagttcctccccgccgcatctcccatctcgtatttcccatcctcccttcgcgcgtctgggtgaggattcgggcttgtacttcttgttaatccctagtccttcagtccttctcccatcaggtgtcgatttggtctattggtttttcttttttactttgcttaattctcgtttttttttttaaaaaaaagggttgttctgttggatctccagctggagccaaggatacatactagtagtaatttctgttggtttgttttagtgatttatcttggtttttttagatctggtatacatctcccgtggttcgattgggctgggtatttgttctttgaagattggtgttttcagtttttcttgcgtgctagtgatgattaaagaagttaaaaatggtgaatcctggattaatgtgctcgcgtgccgctgtgtgcgcgcgcggctggagattttttttttctctctgttcttctgtgagttcttctatggaaaatatattttttttcttctaacctctccttaatttgactcgtgtgcgtagttacttgcaggttgtcagaattactaggttttgaaattacgactggtactccaggctggtagagcggcaaggtatgaaaatgtataaattcatcattgctgggctgcggctctatattaaagagagatgggggattgcaggttttgcccctcccccccccaccccacccccccacaatagatggaattcagctctatgcctagttcgtttaatccctcccacaaggggattgagggagatttggaggggatttattccacacctattgttattgtggtgtggaattattccccctcaatcccctccattcattctctcttgggtttaaacgaacaaggctagcaaatccggatttttgtcagaattttgccttaaaggaatggtagatcctgattttttttccagaatcttgctggagcaatagacaattctgtttgtttgattgatctgtctaccacatctaccgtggtccaattgcttcttaatatgatttgtgaagactcgtgtttcaattttcaaggccgattgattcttttatttgatttctgaagacttccatttcgattctgtcgtgctggtgatgattaaagagctagcaatggtgaattcgatgaatttgttcgcgtgctgctgggtgcgcagcagtggtgatatgcatccttacgcagttcatatgaggcacgcataaatcgaaatcgattaaaaggccggaatgttattccattatctaaaaaaaaacaattgcttcttaatatgatttgtgaagacttgtgtttcaattttcaaggccgattgattctttaatttgatttctgaagacttccatttcgattctgtcgtgctggtgatgattaaagagctagcaatggtgaattcgatgaatttgttcgcgtgccgctgggtgcgcagcagtggtgatatgcattcttacgcagttcatctgaggcacgcataaatcgaaatcgattcaaaggctggaatgttattccattattaaaaaaaatcgaaatcgatttttttcctcatgtgcttgtgtttcttctttcctgctgccttcgatacaactccaaaattgctgttttattgattttgaaaaggcttatgatagagttcaatgggatttcctgtatgaggtgttgcagaagaaaaactttgaccagcgggttataagttggattaaaaagatcagtgaggggggtaagatgagcataaatataaatggggcagatgggcataaatataaatggggcagatgggccctttttttaaaactttcagggggttgagacagggtgaccctttgtcacctattttgtttaacctggtgggggatgctctgtcagctattttagaagaacctgccagaaatggggtcttaag

SEQ ID NO: 46798 - DNA, 31292 bp, Oryza sativa
tttctgggaggatgtgtggctgaacaaagtgtctttaaaaacctgcttggctgcttcccatctctgtattcagcaagttatcaacacaaggcactgtgaatgagttgtgggatgggggggattgggatttacatttcagaaggaacttgaacagtcaagatagactagagttggataaactgcagagggagctggagggggttactctaaatggagagagagacatggtgatttggcctcatgacaaaaagaaaattttctccacaagatctatgtatagggtgctaaaatttggaggggtggtagatcaagaaatccaaggggtgtggaggtgcaagatacctctaaaaatcatgcatttcctctatatgacagggagaaacaggattccatgtacagagcaagctttgtctaggggaagaaagcactacacatgttttatttacttgtcccattgctaaatttgcttggagtgtaattgctatagttctaatttgcataatgtacctatctctttctgggattgtatcaaggttgtaaccaagaaaatggggtttcaggggggaatggtggtttttgcaggaatgacctggggtttgtggattaccagaaataattgggtttttaacaataaactgatcaaatcacctttgcaggtcgtgtacaggtctttgtctttgatgcaaaggtggaaggtgctgctaaaagaaaaggagtgtactagcttggatgtctttcaagcaaagataatgctgacgttggaagtgctgaagccgactgataatcttcctgatgatataggatagttcatgggaatgggctctgaaaatatttggtcttttgttgtgggtgttaaaatgtctggaagggggctaggtttagtggatgtccaagcttttgttgagctggtttggaaaactggaatccccagttttttgtttccttttgtttcgtttttctgtaagaactctgtttcgtttgggctttttctaaagccgggtaatatatgcctgttgtcaaaaaaaagatgctgttttctgtttacattttttccttttggctttgccgttcgaactctccattcttgatacaataattgtgtatttcaaccgaaaagagaaggcaaaaacaactctccaaaaaacttggagtttatgttttgtgccatgtgtgcttctagagctgcgagtagctgtagggagccaggattagtatggctggtagttagtgaatttctgattgatagcatttcaattttgtcataaactggtgcgttgatctatgaaattaggcagttagattcatcgcaaatttttaatgggatgagaatatgtaaacacggtatgtaaagttatccattaactagtaatacatttgtaaaataaaataattgactgtcctttctctttaagaaattgaggaaaccacccgtgaaatcagtttactggtacttataaattatattatctttttgggcactttcttttaatgagggcatcgatgtatctctagaggaggccgagatttgggttgaaacggctagagtaaaaaatcggcatgaaaaccaacactacattggtttgtataattgtatagacaaaattatgacatctgatggtatttgcaattataaatttataatcacacaatatatctgattgttcaagcaaaagggacaaaagactactaacattactttcgaatgatgtacagatgaattcctggtcacagttctaaagctaggcctcttgtaccccaaaggccttctggatttcagctatgactcggtctgcgacatcgggaccaaacatcctcggcaaatttgaagtcaggtcgacctcgattgacttggaccttacaatttggtccctctttatcatgttttctctctcgccttcttccatctctgaagtatgatcagcacaactatcaagccaaatttgaagaagtgccctagcagctgttgctagttgaccacgcactatctcttccaaggtaccctctcctccttgcccacagtcgatgctcatcagtattgctgtcagtgagaaggtgctgcgcacgaagagggatcgcgatcggtatggacgggcctgcggcaattcttcgaccttctcacgctgtttgtccacctgagtattctcatagtatctctctatgtattcgggatggagcgcaaggtctttccgtgggagaaggtccagaagcaccacgatcgaagttgggctaccttgtataaattccatgaggaaatgcggagcatctgtcgaggcgttcagaaagatgagaagagatgtaatgtcgattgcgccatttgggactttgcagtgtagtgaggactggagcatgaaatcaatctgtagacaagaaaaattaataatttaactccatttgtcattccttgcagaactcaagaaattctaccacgctaagctactgagcactagggagcataattcaggtgttcaagtggtgagattagtttcataatttgaatgctgttgatcattttggccactccaattgtgtccgttcagttggagtgattttgtttttttgtttttggagaggaaacaaaatctgtgagtgataggaagaatcacgaatgaggtacaaactctagaacagaccaattgtttccatttcgatattggaagcaaatgaactaatttgagcattgccaatataatgaaaagtcataatttgctccgaagagttggattatggatcttggcttctaaaagtttgcaagttcaccttgatagggcaaatcacaaatagttcggcagcaatttttcagtgtaaaacagtttcagtaaattgtccaagtcttttgacatgccattgatctattctgctctgtttgtgccagcctgtttttaccagtttaccactaccatttcactacttaattagttaattcatatgattcactacttaattcatatgactgattctgatggtgctctagacattaccagtttaccactaccatttcactaattcatatgactgattctgatgttctccaatcgacagaacaggtaaatctgtacgatctgacgagcaaaagtgagaggaggggtgccattaccgtcgatcccggcgcgccgcggcgcacgtcgagcgagcccacggcgttcccggcgccgccgccgctgcggaactcggcgacgtcgggcggcacggcggaggggagcagccgcgcgcccagccgcgcctccgccagggacgcgagcgcccgcgccacctcccggtgcgccacctccaccatcacctccggctccgtcgcgcccggcgccgccgccgacgacgcgcgcacggcgctcgacgttttgcccccgagctgggaacccgcgccgcggcggcggcggcggagggggaggaggcgaggagcgagggtcgggaaggagacggcggaggacggcgagctggtcgccggcggcggcgagcggagttggagcattggatcacggcgaggtgttcgacgcgtggacgaacggagcgagagatgaatgtgagcgagagggagtgagaaggattccgtgaacgtgtagaactatccctcttttacttttgtaactagtgcagtatatacataggagatgattgaaagagagatctgaaagctgctgttacaaatccatcagattccaagacattatctattgcaatttgcaaatgccttgttttttttacggacactgcattactgaaatgtgagataatgccaattgaggtggtatttgggaatcacaaaaatgactagtttagtccctccttcgcaaacaccacatgagttggtttttttcttttatacttcctccgtttcaggttataagactttctagcattccctatattcatataaatgttaatgaatctagacacatatatatctagatttattaacatatatatgaatgtgggtaatgttagaaaatcttataatataaaacggaggaagtaccatgctaatgactgggcagctcaccatgtagcgcataagcttgggaaccgaggtgatacttatgccctattcttttctccaataaaagttggataaacttttggatactcgtgacacgtttttcaaactgctaaacgatacgtttcgtgggaaaactttttatatgaaagttgttctaaaatatcatattaatccatttttcaagtttgtaataattaaaacttaattaatcatatattattactacatcgttttgcgtgaaacacttaatcttcatctttatatttatcttcaggagattaaacacaccacctaaaccttaatacacttgaggccatctgctactgctgatcactcactgctgttgctgcttatcgctccatgggccaaggcccaaagctcacaaaaggccagatgctgcacactagctttcttcctcagtccactagctcttcattttcctttttcccccctctaattattgtgggggccatattactgaaggagaattcgaaacatcttgaatcttctcagagagcttgagagtgaaatgagtgggccggccaaagaagaccactatagaagtgaaaggggagggcaagagcggtttgaaggtcaatgaaatgggttcagttcccttgtcaaataggggccccgacccatgtttaatcactgaagtgtggttgagtgagatgatccgcaaccaacaaatgatttgtcattgtctctaaatcactgaatgaattcgttttttatttatatatgagaactagagagttcacaactcccttttcatttattttgatcactttttagtttctgcgaatacttatcactaaacgtttaaaaggttaataggatccacgccaactataaatatgccatttcggataaatgccactactattcatgatattggttacgtgccactgaaatttgaggagttagaactacactatcaccgttgcatttcccgtcagacccctaggcgttagacccacatatcagttccatctttctccatcctccctcttctttattccctatctcttcctccatcttctacgactgctacaagggacatcgacggcggcgaccgagccctcccactgcggatgggataaggtcgatgacgacagtggctcccaagccctcccaccgtggatggggttgaagacgacagcgttggcatctcctgagccctcccgccacggatgggagaagattgacaacggcggtggttcccaagctctcctgccgtggatggagtcaaagaagatggcggtggcagctcccgaactttcccgccgcggaggtggtcgacgacggtggcggtgacgatgagcgccggagagagagagagatagggggtaggggaaagagaggagagtgaagggaggagaaaaacctggaattgacagctaggtcccacgtgcaattgatgctaacgaaaagttttgatggatatagcgatagagtgacacggttccgatttccctaaatccgaatgacacgtcatagccgatattgtgaatagtactaatttttatctaaaattacatattcgtagtgatatggatccaagtaatcatttatcaaggtagcgttttgtctctagtggggcctaataataagaagatattagaacatgccaaacaattatctatactactcccaatcttaaatttcgggtgtttaggtaaaaaaaatcagcatccaacagtagcactatacaaacactcccgaaaaatccttatgcctatatgcagaaatctagctctccgcaagtttgaagagggtctagctcccaatcccatcaccgagcgagtttgcctgcaccgagaggatggctcgtcccatcagaatagaaaaaaggatgctgatttaattttgtttggaagttttgtagttgggccattgtttttgttgttttgagaagttaaaataggctatcttggaggagagcatattttttttcttaaatctgattagagattcccaaacaaaaggtttaggggattatattttgatactaagttggtgatgctcttatgtggcatatgtatttagaaacttataaattatgtataccacttaatttagggttattttggtcattttacctagaaaaaggtgattgtgttgttatgtgtgatggtcaaaagtgaaaggtagataaaaatggagggagtattttatttattactctatctcaatgttgcttaactataccacaatccagttaatcacaagtttttccataacccagttagtcacaaatgtggcaaagaaagtaatagtacagcacgtgccttcagtgtcaatgccagaactcacccacgaaataattagtacaaaagtaatttgaagtggaagcactactggagaaaccatctttactcggtcagctaaaaaccacaatagtttcggttccaataaaaaccaagactaaatatatcttttagtcccagtttataagcagaataagattgtgttttttagtcctggatatctatctttagttccggatttggactcccggttgtataaccgggaaacaggcaattacgaaccggagataaagatgacttgtgcagcatgaagtccatagaatgatttgaaagcatgcagttttaaataaataaaatgtactgtatactagctagtgtttgcactttgcagacatacactgtgattaacgttgattattattagctctatttcacaaagttattttcactttttgctaatcaagcttttttaagattaattaagtttacaaaaaatataacaatacttttaacacaaaaggaacatattattaaaatatattaaaatctaaagttgatgtcatagatgttgttaacttttctataaatttaattatactaataaaaaatttgactaggaatacgaaacgaatggagtagtaattagtactccctcccaaaatatttaacgccgttgacttttttttaagtaatgtttgaccgttcgtcttattaaaaaaattaagtaattattaattctttccttatcatttgattcaatgttaaatatacttttatgtatacatatagttttatatgtttcacaaaatttttttgaataagacaaacggtcaaatacgtttaaaaaagtcaacaacattaaatatttagggacggaggaagtatataattaaacttcctatcttcaaaacaaatctacaaagattagtttagctctagcttcttgaaagtaaataccgaaatgaactccttacgtaaaaaaaaaagaaatatatatacaaagataataagcggatggatgtggtggcgagagaaacctctagagccatgcaaaaaaaatgcttaattagcttcccatgaacgccttgcggatctcggcgacgactctgtcggcgacgccggcgtcgaacatcctcggcaggttcgccgccaggttgacctccagctccgccgccgccaccttcctgtccctcgccaccatccgctccctctccgccgcctccatctccccgccgccgccgccgccggcgcagtgctcgagccagacgccgagcacgtccatggccgtggcggcgagctcgccgcggacgatcccgtccagcgccgccgcccctccagggccctcgccgcactggacgtcggccacgacggccgccggcgaccacaggctgcggacgagcagcgacggcgagacgtaggggcgggactgcggcaccaggccggcgacccggcggcgggcgcgggcgtcgaggcccgtggcggcgtagtaccggtggatgtaggaggggtggagcgggaggtcgacgcgcgggaggaggtcgaggaggacgatgagggaggccggcccgccctggatgaactccatgacgaggtgcggcgcgtcggtggcgccgttgaggttgacgatgagggcggtgatgtcgatggcgcctccgccgccgccggggagctcgcggtggaaccacgcctccagcatgaaggcgatctgtgtgcaaaggacgaaataaataaattattactacaaatttacggttaaggagctgagagctggattataccgttctatctatgtcccataataattgtatttatgggatatgaatttgtcccaaaataattgtcataatagagtaccgatggtcctattaatcacttcttattaaatctctccctatttgatcctcaactacacttcgactcttaccaatacattatttaaataagatgtatcatagcctttcttctcaatccttaaggccttaagggtgtgtttggttgggtggatgagcctcgatgggagatgaccgcccgatttttcgaggtgtttggttgaagggcagggtggatggggcggcccgaaatagggaatattccctcaatatgcgatttggctggatgaagccatccagttttggtctagatgatgtgtcatattctgattggctgtggttggtttgattttctgttaagcaaggtctaaatgatttttttctcctaaaccgtttatctaatttatgatttgattacaccattatatatatatatatatatttgttacaattaaatctttaaaacaagatatcggatgattatattttgataaaaatatataatgacaaatgggcccccactaacttttgcatttttccattcatgggatatccctccaatcaaataagaaattggatcgctatatccatacaaaccaaacaaaaaattagatagccatatttaacaaaatatgatggacatatcccatccatatatgaccgtgaaccaaacacaccctaatatatgctacacaacctagacagtttatatgggaaaaatgtagtaaaagttttcaaactattaaacggtatattttatgcgaaagctttcaatatagaagttgctttaaaacgttagataaatttatttttcaagtttgtaataatttagatttaattaatcacgcgttaatgactttctcgttttatgtgcccgcttttaacctacatccttttaggagattcgaacggggccttagctttaaagatatttggaagtgatgagatttgtagatttccatgcattttaaaactttgtgcttccaaattttcaactcagttctaacaaccaaaatttgactatgaagccagcacacgtgcacgtactccctccgtaaagaaaaaaaatcagcttagaaagagatgtgaagtacatatttattatactagtaggtgttatattttcatttaggtgagtgcttttgtagacggagggagtacatttcaatgtaacccgaccaaaaactactatgttttttttcttcctcgaaaacccattcaaaacgtaaggaaaattcgccgctttgatctttcgttctcaacgatccatccatcgaacggaaaaaaagaacaaaaaaaactcgcaacgcgctgctgtgtgtgtacgtaccgaggatcccggcgcgccgcggcgcacgtcgacggagccgacggcgtccccggcggcgttgccgaaccacgcgacgtcggcgggcacctccgacggcagcagccgcgccccgagccgcgcctccgcctcgccggccaccgccagcatcacctcccggtgtgccagcggcggcatcctcgccaccgcctcttctctgctcacccgcgacgccgacgccgccgcgctcctcaccgccgccatcctcctcctcctcgccgccgccgccgcggccggcgacaggcaggaggggcgagacggcggcggggcggcgcggcagcagctggtcggagcaggaagcattggtcggtcgcgcggacgatcgagctcgatctacgtactccgagattcagcatctcgcgccgccgcggtctcgtcaccctagctactctcgtgtcacactgtgtgtacgtgctcgtcgagttgggctatataggcagcttgggttaggcttggtttgggtacagttgcttccaaatttggttttactgtttctgtccaatcagccagctataacctcaaccagtcaatcatagcgaaatttcttgaaaatcccatcaatatatttcatttgacagaatagctcattaatttgtttgctagtatgcattgaataaaacaaagtcaaagtaagcaacacgaacaaaattgtctaaattacatatagtggagacgttttaaatatttagtgagagtataagaataataatactcctaggcttctagctagttaagtagtgagacctttgtttttaaatatatttactataattttttgaacgaccatttaccttaagtactaagcactacctctatcatacaaatactttatattttttatagttctagacttcaaaggccctcttttctatttttttcctaaatacatatactttatacatattttttttaataaaagtcttgggtattattttgaatacccatgaatcatggtgggtccgtcttaggcataaatgatgctttctgggaattgagatatatatatatatatatatatatatatatatatatatatatatatatatatatatatatatatatatatatatatagtaccatttattttgttttggcttgtttacttgaagtataacttatattttcttatatttacactcagttttcaataagagaaatgataaatattactagtagttaatagcatcatatattttaaaataaaggaagtatgttcgaaaatatcccacacaacaaacgttacccattttttcttggaatctgtcaaaaagtcttgtttcacctatactgttcacacaccatatttttttaaaaaaaatacaagaaattggaaaaaggtaagtcaacgatataaggttttgtgattttcccatgtcaaatattatttggaggatatatatatatatatagaacatagtttgatccagatctgaatgtgtaagtttaacaaacattcacttcatcaacatacagcccatgaaccatgaggaacttccaaactatttgaaaattgttcacgaccaccttttatttagataaacgaaaagcgttacattttcaaaagttcccgtccatccgtagcatatacacgtgacacaacaaagaacacaagacaaggcacaagcactataaaccgtgggatccgagtttcgctcacttattaactgcatgggtaactgtgttattggaatgcgggccataacaaagtaccagaacctactctctccataaaaaaatctctccatccaaaaaaaccaaatctacttagagataaaacacaagatagtaaggcagaataattgagatggaatgttatgtcctacatttaaataggttaggttttattggacggaagaagtatcataagatttgcttccatagactaatattatatatgctagtttaagataaaaaccggcacctatagtatttgtactttctttttttcaaaaaaaaaaagtagcagctatgctaaactatagatgccgatttttcttaaaaaaactgatgctcgagccgagctgagccaacaccccaccacgataaaaatcgtgccccgccccatgtctcctaaccttatccactcccatcgccctatctcactctcgcactctcctcctcctcctcctcctcctcctcttcttcttcttcttcttcttcttcttcttcttcttcttcttcttcttcttcttcttcttcttcctctccaccctcctcggcatctcccctcctctgcatccacctcccccacttctcctcctctagatcaagcgacaacgaccggatggtggagaaggaggctcggccctcctctccgtccgatgatggcagtggtggggtagaagtcagcgcgaagggcgaggtggcatccgatgtatgggaaggaggtggaggccatcacaatccttccctcgtcaagctcctccccgacctcgccgagcgcctcaccaacagcccactggatccaacagcgtggaccgtggcgtttgcctagattcggcgatggtagtggtggtggagaaggctagcgcggaggcgcgaggtggcggccgatggcctcgaaggagatggaggtagaggccgtcacactcctccccgacctcgccgagcgcctcgccgcgaacatccggatccagcagcgtggaccagctactccgttgggccttttcttttcttgattaattgaatactttaggtgtcggttgtgtggtaagaaccaacacctatgcccaaaagtaaaggtgttgataaattggtgccggctggaaaaccgacacctatgggatatacggatgaggtagtagttacaccaggaactgcatagctaccgcatccgtcggtggatatgtaggggttgttcagattgatgtcatttcaaaccataccaatttttagtaaagttgtcaaatatgtgcatctatttttttttaccatactctagtaaatacataagaaattctgtcaaaacttagcaatattaccaaattaccaaaatatggtaaggtttaatctctctaagcgtggcactaccatttgtaagatccgacggctacgagtgatcgaagtagcaacatccacatgcatgaattgtacttccttccagtagtcaccactcatcatcagcacgagccagtcactctcagttagccttagcttacccgttgcgtcttcctgttggtgcttacaactgtacgatcggtacgtgaccagtaatagttgcagtatcgccccaaaagcggccaaacagtccacaccaacacaagaaagtttgcctcctacttctctttctttctttattcttaaaaaaaagagagaaagagcatcgaatggattatataaacactggtggagaaacgctttgttgtcccggttggtaacccctttgtagtcccggtttttcaaccgggactacgaatccgggactaaagatcgcaatctttagcgccggttcaaataaccgggagtaaagatcgatttttagtcccggttggtaacaccaaccgggactaaaaatatggtcccggttgttgttactaaccggaactaaaaagttttggtttttttttcttttccttttatctggttggcatttttccttttttattgttatttagcttaagctagtggatcgaataaataaaatcaacaacaaagcctaaaccatagatcgaatgaataaaatcaaacaacaaagcatccatattgtttacacttgttcagaactacaacatctcatcacagagggcattcatcacagagaacaaagaaaggaaaaagaaagttcacatctacgacatcattcatcagatagcaaagagaagagaaaaaaaaaagttctcctgccgctgcctcccgaccggcgccggccgccgccatcccgaccggcgccggccgccgcctcccgaccggcgcagctggccgccgccgcccccgacgcagcccgccgccagcccgccgccgcctccatctcgccgccccgcgtcgggccgccggcggcggcctccatcctgccgccccgccggaggggaagggaggggaggagggggaggagaggggaggaggagatggggtgagagaagaaggaagagaaggatgggaggagaggaggagagaagaagataagatggagatggctggatgggagaggaggagattaggatgaaattaataggagactttgcatgcgcgtgtactggatagaggttttgttttaccggttgtttaacaaccgggactaaaaatcctaactttaccaaccgggagtaaagatcacggtctttactcccggttggtaacaccaaccgggactaaagttagaatttttagtcccggttggtgttaacaaccgggactaaagatcacgggagggcctgacagcccctgacaacatacgaaccgggactaaagatcccggttggtattaccaaccggaactaaagatcaaatatgcctactgtagctaccaaccgggactaaagatcatctttagtggaaccgggactattgtggattttggttgactgaccaaagatggtttctccaccagtgaaataataagaaaattgcaaaaagaaaaagtaattaaaaagatttgatgtgtctgcatcctggtcacttccaaaagtgtgacaagtttcatgaccaaattaagtaggcgttctggtggaaaaatgttaatctgggtttgtctgttagataactagatactatatactccctccgtttcgaaatgtttgacgctgttgactttttagcacatgtttgaccgttcgtcttattccgcagatttaagtaattattaattcttttcttacatttgattcattgttaaatatatttttatgtaggtatataattttacatatttcacaaaagtttttgaataagacgaacggtcaaacatgtgctaaaaagttaacggtgtcaaacatttcgaaacggagggagtatgtcccaagagggctaaacaccccaatccatgtcaccagaatcagaagatggtagcctggtatctatctaggcattggttaaagctgaaagcctgaaactaatgctttgcttcaggttacagagcttgaaaagttatctgaagaacaaaccaggcccccagaccccaagcctggtatgacgcaacagcttctgcacgcaatttttaattgagtccatttccatccaaacatcatgaaaaatattaacgagaattcacaaaacagtaagctcttattacttctgttgtgtaatgacaaagcatggatactactgaatccacttgcagatcacaacagccgctgaaatacaacacaaggcatcacagttcaattcaattcaatcgtggacagtctttgagcctgatgttctaccagagaatcgatttaaatatgaactaggaaacaaatgcagccctctcatacacaccacaagaacgaacgatacatttcagttagtcaactgaggactagcagcagcacaagtgcccatcaccacaacaagttgagcaagattccaacccaacccatgttctccaatcttcctttcagtctcgacgaaactcctggtcttcgctggctttttgtcgctgcgggtgattttccggatggaacaacctgttaggtaaatacatagatatcatgaaactgtgcagcaaaagtaacagttttcactagccacttatttcagtgcttacaacaaatgaaggtgattgatcctgttatgttgtctggtcatgaggtgtagcagtggaatttgtaggccgcctcctcctcttgcatggctctgaatcgacttcgacatcttcgtcaggaaaattctgatcagatacttctggacaagcaaaaaggaacacgaaacatgtgttaattccaggtttcatggctatgagaacttgagaaggatgacaattgatagtattaatcaatgaagtttgctgacacaagcaagaaacagtgcaacaccatacgcaattgcagtttactgatctgtttctgctgttccattatttgtaaagatccaaacacttgcttgtttgttagctagttttaggaaaataagtgttgaaaaaatctttttacaagttagatgtgattacacataaggtaataaatacgatgaatctatgaacaaagttgttctcgaaacagttaaaagtcaaaggcaaaagggaaaatttgtttggtgaaccatgatgcaacttgttgagtatatgcagaaaaaaacatggttacaaaatttgtgcattgatcaaacatgaattgaacacaatagctacttcaactcattaattttttttacatttgcagcaggggcaaataagatccatattatgtataacttttcatttaaaactgcaccatttcgagcatacttatttaccaactaaagagtctaactgcacagtcaagactgaataataaacatatcctaaactcgtatcaaaacagaagcaagacttgcactgaagaaagcgatttgcaaataagatgaccaaagtagtaacctgtgcttttatcagcaagaattcctccagcacaactcttcgcttctcttccatgcacccgaaccctctgtcggaccatgtcagtacccgactcatcgtcatccacagaaaaccccaccgcatcattcttgcggttcacaccggcatcgcgtggtctgaaacgccttatccatggattctcagggaagcagctcatgcctccatcatgagcgtgagcatcattcctctcagaccttaggttgtcgcacacaccctcccggtgcaccctgaacccaattgcgccacccgcatgactcctattcctgtcaagcccatggtggtcatgcctatagagttgttccatgaaggatgcctccatggagcttatgtacaagctgtgcctctcatttgtccatccatctgacatcaagtccaggaattgatctccctgccaagaagaatcacagcataaagttttttttaaaaaattcagggtctgcaaattgcttagctcatacaaaaaaattgactgaatactgctgttacatagtaggaaaggaagtcctgaaagcaaatgtccaagatcatatatgtattactatgttcttaatcagaagatctgatcatagacacaggggtggtaaatgatcaagtgccaatcttaaggagtggaaaaggataaattattcaattttagtcagttttttttaaaactgaaaatgtatatcttccttcagttttactatgacatcatcagttgccagttggttgcagtgacagaggatgccctgaaggaaatgttcaagatgttcattctccagtttcttaggcccaaatatgtgcatacagaaacgagaaatgtgtccgtacatcaatttgcaagatgtgatcaaaacgagaattttaaatttgtatggacaaatggaaatcaggtgcgcagaacgcatggttattgcagcctgcatgagactacacaaacagaaagtatggacactcccaaccaataaatttgatacaaataaattcgatcgtttaccttggtcagcggctcggcgttgatcggcgggttcaacgacacatcccccatgacaaaatctcccaagaagcaggacaaaaccaaacaaaaattgaaaaaaacaattaaccctggaatccaaatctctccaaattggacacccccccgaacgaagaaatcacaaggccctggattactacacaagcaaatcagaggggaacaagtgaacaacccacaaacaaatcaagaaaccagcaaatactttcttcttttctttttcaaaaaataaataaataaccgcgattcagagcaagaaaccgtaagcagagaaaacccagaagaacagaacgaacccgcgacgatctcgccttgcctccccggtggagggagagatcagagacgacggcgagatatatagtctagcgcgacgacggatcggagaggaggaggcggaggcggttcatccgggcggcggagaggggaggggggagaagtgtccaggtgggggaggtggggcccaccgcacgggcttttacgccgacgtggtggtacttttccacgtggcagccgcggggctttgtcggggggagaaatatctcggcgcggcgccccgatattttttttcgcgggggtgtgtggcaggtggggcccaccgggggtgggggtgggggtgcggaaaagatcagtgggcgggtgacgtcactagggaggggatggggtttgacaggtaagacacgctggccgagaatgggaggttgatggggggtttgccgatttggggattgaaagggtgatccgggtgggaatcttttcggggatattattgttttgatgcgcggatacatggaatggtatgcattatcgtatatatatacttccttcgtccttaaatataatagattttaaaaggacgtgacacatcttacatcctagcacaatgaatctagatagaatgtcggttcaaattcattatactagaatgtgtcacatccataaaaaaaatccctgtcgacgggggatacccgtagaccggatatagagggtattggggtacgctggtataaggatctacgtaatacgacatcgagtaatcaaaagacgagaattatactggttcaggccccttgacaggtaatagccctaatccagttgatatgggattatatggtggaaaacacatattacaaaggaaaagacggaactcgggagattcgacaaggttgtagtcgagatgatccgactagctctcgtcaacttggctccttgtaggctctgacttcgtaggctgtgttggttgtcggggctctgagattcgatgccttgtggtctccccggggggtcccttttataccgcagattggatgttatctgagtaggactccgatataccagacctgacacgatacgtaggtaacccaattcttgtccgagaaggtctctccttatctgttgtctttacgaagagtttccttaaatgccaaaggatttatccgtgtacacgtggatataccttgtcggtatgtggcgtgtatcgtggggtaaagggtatgcctgacccgtaaccctgacagtagcccccgacttctgctcaaaaatgaattcgtgtgaccgtttgcaactccgggcgtcgagaacgtgtcattcctggtgcgagaaccaaagagatgatgtgtagtcgagcgcaccgtttgaagtccaacggtcacgaatgaattttgaacggaagtccaaaaaaccgccatgcacaacggacttaaaaatctccggcggggatttctcctgtttcttggaattcgcaccgtcgggagtgcgtctatttaaagggatttagggcgtgagctttgaggtccgcctacttcattaggcatacactgctcctttgcattcctcgccttactcgccaccgcaaaaagcccttgcctcaccgattcatcgtccgttcccggcgatcttccggcgatctcccaacggccatggatcttgggaaatcgacctccaccgctgcgaccctgaagaagcttcaggaggagggcggcctccctggccgcgacaaggcggagagggaagcaggaggtactactccccaacccgtcctaggtcgcatggttgcgattgaggattacattgtctgcgggtttcttcctcccccctctgaattccttttgctagttttaaacttctatgggctttcactttgcacttgaatcccaactccatcgcgttcctcagcgttttcgtgcatctttgtgaggcctacattggagtagagccttttctagatttgtttcgcttttattacgagttgcgttggatggaatccaacaaagtgtctggctgcgttgggttccgacttcgtgacggaatgaagtcgcgctacgtccccttccagtgcccctcttctcgcaacaaatggcggaacatgtggttttatctcgagatcaaggactcggatcctgccctaattgttcctgaggagcagccggacaaaattccggtttggaccgccaagccccctttgaccccatctctccaatcgtttatcgacatcatcgatgatctccgagaacggggcttatcggggtatgaagtcatcgcagacttcgttggtaggcggatccagccgcttcaggctcgggcccacccggcatataactattccgggccagatgacgcgacccgggtttctcctcggggtatctttcttgtattcattttgatatgactgtactcgcgttcgctttcgacttatcggaaattaattcttccttgacagctctgagcagcgacggcgtggagcggcgcgttggtcaagtgatgatcatcggcccgtcaaccgcgagcaacatccccgcgcccctttgtgacaagggagcggtggaacgcgacgaggcaatcaatgtaagtctattcaaatgtctttttcctccttcatttggaatcagcttgtgatcggacttagcgtaggcccttcccttgactgatgtcatcggaccgctcgcggatcaccaggtggcggcttctctgaaggagaaggtggtcgaggaggcgtccgacgccgctgctggtagtggcggcaaggctccgagtaagccgaggaagttctcgtccgtgctcggacaccgtcgcaaggcggagacttcgacggtaacattcgcctcgtcgttaagctgagcgactaggaaggttcttgttctcactggcgactttgcagatttccgatgcatctcctcctcttgcgcgtcgtcaacgccttgtgacgatcggcgagaagtaagtcgcgaaacttctcagattctcaagtcttcttttcgaaccgaactctgatccgtcggtgttgacagggaggcacgagcgaaagcggctcgggccaagtctggggggacttctagcgcgtcccctgtaacagcgtcgactgacgtcgttcccgtgatcgggagtcaggaggcgacgccaagcggcccaagcagcgaccccgtcggaaaccgtggcgcgccagagtccatcctcacctgggaggagctctaagtcgagatggggcgccttcttgaagccggcgctcgcggcattggtcgcgaggtctcggaggcgagggcggagacagcggcggctaacgcgcgcgcggagcggctggtgcgggagctggccgaagcccgcgaggacctcgtgaaaatgagggaactagtggctggcaacgagcgtcaacgcaagggactcgagaaccgcatggcggaactcggagataacctctccgagatccgtggttctctgagggtcacatacaccggcctccaccagcttgccgcggagtgtggggtcaagtcgacgatccccaagaaccccgacgagttctccctaacctcttctctggaggagctggcgacagcgatgggagagatccccgcgaagcaggcggcccgacttgcggaggagacgtccaacggcatttataccggggcgtgtcacgtcctcgcgtgcgtgcggttgtcgcgtcctgagctagatctccgcgagatcttggaccagggggcggcgagcgacgcacgtaagggggtgatggaggaagtcggtgacctgggggagtctgtcgtccccctcttcgaagagtaggagtacttgtatttttatttccttctcatgatttgtgaaccccaaactttggttgtctagctctgttcatctttgatctcgaaaattcatcttatcgattgtagagaggtcgatgatgaggatgtccagtagcgcgggcaacctgaatcgatggcgataaccccggtactcgagttagaaccgagcgcggcgcatatcgtcgatggccagattgctgatgccggagccgaaatgacggcaactgacccgagtgagtgatctcgtcagccttattgctttttggtggtttccgagttgtcttaataaccatcacgtttggcagatctcgaggatgcccttgcgactcaagatcatcgtatccaatactagaagacgaaatgtgaagtggcggaactcgagagggcgatgctagccgtgaaaaaagatcaagctgtggaaacactccgaggtcgagaggtgtggttctcatcttatctgaagaattgctgcgcctctatggcgagggtgtgccgggatcttcgggtagcccgcggtgatcctgaagaatcggcggccgggtacatctcgtggctcaacggggcctgtgctcaactcgacggcattggtcagcgtatcgacgaggccttgaagcaagagtgtcgtcgagcaagccgatatgccggggggcatgtgttggcctgtgtacgagatcaccgcccgcgcctggaactcgaatttctccgtgagggttttaaccgttctcggagaaatccggcagagattgaccatctcgcgagatcaatgtcgccgctagccgagaagattttccaatcaatggactggcgttggccttcttggtagaatttgtaccttgtaacaagatatcttgggaaaagacgtaatgtgacaaaatatttatgtgctaacagtaaggaatactttgtgaataaagaaatatatatttaacaaatgtttcttactctgggtgttgtttgtaagagcgtgttctcagttaacgaccttagttagccgtttgagttgtacactctccctagcccccagccttgtcgtcggagggatgtccttgggtgacaaggctcttggacccttggcctgtcttggttgaataagctctgatcctagcccccagccgtgaagttggaaaagtcaatttctgattacacggcttggttaatacgcacggcgagaactcttacacgaccagatcttacatggtctttcgtctctgaaggatctgacaaggccttatcggctctgagcgtccccagccgaagatcccttgggttcctcggaggccttgtcgagacggcgtaaagggacataaggacaggtttcaacgctaggcgttgtacagagtgaggggttgtcaggtgaagacactttggttgttatatgggaccaaaaagtagtctttattgatactgtaagggtgcttacaggtacaatggtattgactcatacatagaatttacgtagttggtcaatgttccatgaattcgctaattcgcgaccgtcgccgtctgcgattttgtatgcgcctggccgcaaggcttgtgtgatcgtgtagggtccttcccattttggtgagagtttgtttcgccctgcttgggtctgaactcgtcggaggacgtagtcgccgatcgaaagtatgcgtgctcggatgcgcttctcgtgataacggcggagggcctgttggtagcttgctgctcgaacggcaactcgctcatgatgctcctcgagaaggtttatatcgatgtctcgctgttcatcctggttctcgtcggaatgcttctgtactcgagtactctgatgtcgtagctcaccggggagcatggcttcagaaccgtacacggggaagaagggtgtttcctcattggacgttgtcggtgtggtgcgtatggcccatagtactgatgggagctcttcaactcattttttgtcatgtgacatgagtctgtcgtagacacgggtttttatcccttgtagtactatgccgtttgccctttcgacttgtccattgctttgagggtgagagaccgaggcgaagcatattttgactcccaagccgatgcagtaatcttggaaatcggcgctgatgaattgggagccgttgtcggttatgatgcggtgcggtagtccgtatctgcaaaatatccctctgatgaacttgatggcgttatctgccttgatttctccagtaggtgatgcttcgatccatttggtgaacttgtcgattgctacaataggaatttgtagccgctctgtcctcgtgggaatggcccaagtatatctagcccccagcacgagaacggccaagtcagagggattgtttgaagcgcttgtgcaggtagctttgtgtgtttgctgtgaaattgacaggcttcacatcgctggaccatgtcgcatgcatctttgagggctgttggccagaaaaatccttgtcgaaaggctttgccgaccaatgtccgtccgacggcgtgtgacccgcatatgccttcatgtatgtcgaggaggagttgtctgccgtcgtcgatagagacgcacttgagaagtatcccgtttggcacctttttgtataaatcgttgccgatcatacagtagatttttgctttacgggttattttctcggcctctgtgtcattttcgggtaactcctcgctgttgatgaatttgattagcggggtgcgccagtcatctgttgtttcaatgtcagccacggcgcgttctacctcgatgacatctgagctgatgtcgggggtgcttgggacgacttcgccgctgacttcttttacggagggtttcgtcaggacgtcgagaaaggtgtcgggctcgagcggttctcgtctggatgcgcgtcgggctaggtcgtctggctcgacgttatccttgcggtagacgtgtcggacctcgatcccgtcgaacctcttctcgagcttcctgacttctgcaaggtacttggataactcggggttagagcatttgtagtctttgtgcacctggttcgcgactagctcagagtcccctttgacgattagtcgcttgaccccaagtgcggctgcggctcgtatcccggcgagtagcccttcgtattctgcagtgttgttggttgccctgaagttgaggtggattgcgtgtttgaattgatctccggatggagatgttaagataagtccagcccctgctccttggctattgagtgcgccatcgaacgccattgtccatgtctcattgtcgccttggttatctgacttgttatctggcatggtccaatcggccacgaaatcggcgagtacctgagatttaatggctgtttgcggcatgaagtggacatcaaattggcttagctcgactacccatttcgcaatgcggccgacaacgtctttgtttctcacgacttcgccaagagggaaggaggaaacaattgtgactctgtgggcttgaaagtagtggcgtagcttccttgatgtcatgatgattgcgtagagcagtttttgaatctgtggatatcttgtctttgcgtcatggagagcttcgctgacgtaatagactggtcgctgtactttctctcgctcaacgacaataacaatgctaacggagtgtggcgtagcggcaatataaagaaataattcttcattaggttggggagcaacgagtacaggtgggtttgataggtagcgcttgagtgtaataaatgcctctttggtttcctgcgtccatacaaatttgtcttgtttcttcaacaaggcgaagaaaggttgtccttgttctcctatcctggcaacgaatctgcttaacgctgccatgtatccggttagcttctgtacttccttgagtctcgtgggcgacttcatgttctcgattgctttgatcttctcaggatttgcctctattcctctgccagaaacgaggaatccgagtagcttgcccgacggtactccgaacgtacacttctctggattgagcatgagacgatatcgtcggaggttgtcgaacgtttcccggaggtcatcaatcaatgagtcgcttgtcttggttttgacaacgatgccgtcgacgtaggcctcgacattgttgccaagctaattgctaagtgcgccctggaccgtgcgttggaaagtgttgccagctgttatcaatccgaagggcattttgacgtggcaaaatactccgaacggagtgatgaacgctgttttctcctcgtcctccttcaccatgctgatttggtggtagccagagtaagcgtcgaggaagcttaatagttcgcatccggctgttgaatacaccagttggtctattcgagggagagggaagtgatccttggggcacgccttgttgaggtctgtgaagtcgacgcacattctccatttaccattggctttccgcactataactggattggcaagccactctggatggagtacttccctgatgaagccagctttgagaagtttgtcgagctcttctcgtatggcttgttttcgatctggtgcaaatctccgcagtctttgtttgactggcttggcatcgggtcgcaccattagtttgtgctcaatcacctccctggggacccccggcatgtcggacggttgccaagcgaacacgtcggcattgtcgcggaggaaggcgatgagcgcgagttcctatttctcatctagtgtagccccgattttgacattcttgtcggggttagcactagagagcggaacgatcttgacggcgccgttcggcttcggcgtcttgtttggctttctcactttcttgggtggctcagacgtggcgggtggagtgggcgtttgctcgaccatgtcgaggcttcgcttgtcgcactgcaccgccagttttgcgttcccttgaatagtgattgtccccttcggccccggcatcttgagtacttgatatgcgtagtgggatgcggccacgaacttcgcaagtgcagtcctcccgatgatggcgttgtaagctgtatcgaattcagcgacatcaaaggtgatttgctctgttcggaagttgttggcttggccaaaggttacaggcaacgtaatcttgcccaaaggtctggatgatgattggggagtaatcccatggaaaggttgatcagttggcgtcaactcactttgtggaattcccattgcctccagagtgctggcaaaaagaaggttgatcgagctgcccccgtcaatgaggacccgtgctaccttgatgttccgaatagtaggttcgaccacaatcggataccgtcctgggataaccgcggtcttgggatggtctgcttccgagaactccatcttctgctcggaccacttcatcttgggtgcagccccctgccatgtcgagcaaacttcgcgttccactttcttgtattctcgcttggaggagtacgtcgtggaaccgccaagatgtgcgaaacatggaggtcggagtctgggtacgcagagtccgattcgtgaggaggcgactcctcgttcttctcgacaacgcgtactcgcttgcctttctcaaacgccatgtgcttctcgagcgactttttgaaaacaaggcaatcctccagagaatgtctgtctgttttgtgtatggggcaccatgatttctttgtgtcgctgccttgtgggtccgggcgcctgggagggttcgcgtactctgctgcgagaacttccgcttgagctttccttttcccgtttttgcgatttttcttcttgctcgactcagatgtgtctgcggctgactttttctctcccccagtcttcggcttgtcgttcttgcgtcttagtgcgtcgtcgacgtgggcgcatctttcaacgatctggaataaccttcgagtagttgtgatatgccttgttgccaactcctgggtagtgtagcgatctctgacgccagacttgaaggcgcgaattacagaagcgtcggtgatttcggggatggtattcctgcattcgttaaagcgccgaacgtattccctcaaagattcacctgagttctgtgttaacgcgtgaagatcgtcctcgatcgcgtggcgcttgtatgttccttggaagttggcgacaaactgctgccacaggtctgcccacgaagaaattgagtagggggggagatgcatcagccacgaacgtgcagatcccttcaacgcggttggtaaatagtttgccaccgcgttgtcatctgctccagcggcataaagcactgtcgagtagacttgaaggaattcttctgggtcgatgctcccatcatacttttcaatagctccgggtcgaaatctctcaggccatcggacatcacgtagggaacgaccgaaagccctgcacccagcgctcggagcggtgggttgtcggtggtcgcgtgaccttcgtggatgtcggtctgacaatgaagaggacgcagaggatgatgatgatgacgatgggtcacttggttccggcgtgcgattacgagggtgacgacctggatctcgggaatcttgtcttcgtctctcgttgttgtctcgacgccgatctcctccatcttcgtcgttacggcgacggccgtgactagtgttgtctggccctcgccgatcatgatcatcgtggtctcggttatcgtgtgggcgacttcctcgatcatggcgtcgtgaggagacatggtgccgagagcgatttgcttcatcccgtgtgcgtcgtgcttctcggcgcccgttgatttgatctcgaaggtcacccgtgccacgaggtgggggggtagctcgttgaggtgattctctatgttctggaatttcgccgttagcatcgctgatgggtaatcggttttgttgcgccgcggtggcggcttcttcgaacgcgttgctgaggttagccaccgatgcccgtagtcgttccgtccaacgctcgaggtcgttgttcaggacaggatcgtaaggtgtttccctcaatatggcttgaacagccctgatatgttgggctggggtggtcgattgatccgccgtctccgcgtttgcttgtgctaacgtgccaacgtcatcgatagccaacacctcccgcgccgcgtctgatgtcgatgacccataatcttcgaggagatgtaaaacagatggttcgtggggattaagatcgattaccccaatgaaccgatctggggccaaagtcgctccttgttccttgccgttatcccggactgggacgtatgacttaggagacggagtttttatggcgccaagtagaactttgcaactcgagaggtcgtgattctttgtcttatggatgggacaatagacgttccgagttggggaagtacgctggattccacgttctttgcaggcgcggatctcagcacgagcgttgacgaatacccagcaatcttgaagagtatgtttcttggttttatgaataggacaccaagacctgatagtttcggaagtcatctttgctggcctgcggtttgtgtcggagggacaaggcctggtcgcatcagaatccttcacgaacttagatgtagtcagcaatccgttctccgtttcaacgggtggatctttcgacgtagaggcgtcttggtttgtaaccaccgcgttctcgtacccagtcattggaggactggttgagatcggcattgtggtgtaaaccggacagacgatttcgccgacttgagtccataccagcattgtcgaggtgggaagaacttgaccggaactggtgttgacgttgttgtcgacgaagcttgatggcataatagtagaaccttgaataccaaggccccctaactggcgcgccactgtcgacgggggatacccgtagaccggatatagagggtattggggtacgctggtataaggatctacgtaatacgacatcgagcaatcaaaagacgagaattatactggttcaggccccttgacaggtaatagccctaatccagttgatatgggattatatggtagaaaacacagattacaaaggaaaagacggaactcgggagattcgacaaggttgtagtcgagatgatccgactagctctcgtcaacttggctccttgtaggctctgactttgtaggctgtgttggttgtcggggctctgagattcgatgccttgtggtctccccagggggtcccttttataccgcagattggatgttatctgagtaggactccgatataccagacctgacacgatacgtaggtaactcaattcttgtccgagaaggtctctccttatctgttgtctttacgaagagtttccttaaatgccaaaggatttatccgtgtacacgtggatataccttatcggtatgtggcgtgtatcgtggggtaaagggtatgcctgacccgttaccccgacaatcccctatattatagaacggaggagtaatactttctccatcccaaaatagagtataagggattttgaaggatgtatcttctagtactgtctagattcgtaataataggagtacattctctaaaatctcttatatttttagacgtatggagtattatataagagcaagtataataaagcttatattcagcgggtgatatgaaatccaaatcatactaagtgataatctggatgagaaaggagaaaagatggtgcaagcggcgcacttgctccaaggcatcacaatactttgtcactgttgcaagagaaaagagagaaaatagcaccaaagagaaaatagcaccaaagcaccgcagagaaagtgattgatgtggttcaaaaataataaagcttttacttgtttaccgtgcttattatactctccaactattatgtttggaggtgggtgttgggaacccatctctcatacacggaaaacggagcggtccattaacacgtgattaattaagtattagctaatttttttcaaaaatagatcaatatgaatttttttaacaacttttgtatagaaaatttttgcaaaaaaacgcaccatttagcagtttaaaaagcgtgcacgtggaaaatgaggggggagtgttggaaacttgctcttgcaaacacaccctaagttgcttttagatgacgtggcacacaattatagctagcaatcgacgatactattaaacccgctctaagcatgaaataaatcggtgatatcttttttctttttaaggaccgagcaagcacatcctcggttagaaagtttaatggtatagtttactgtagtctatcttaaaatcaacatagtatattccccgaaaaaaaaaatcaacatagtatataatatatttgctataagttttgccttcatttttttcctattcctctctctttctcttactaatgcattcaatgtatttatcttgaagcacgtgtagaactagctctagtatgagagccaaaaccttcattttctattatctctctcctcaacataagcttatagctaacttataaggagttgtttggttcaatgccacactttgctatgccaaacgttagacgcaccacagttttttttggtaggtgttttgtttatgccataattgtggcttgctacactgttatcccacatgttatgggaccaaaattcctttgccaaatctggcaaagtgtgatggcatctaaacaagcctaaaattttcatatttcccatacataccatactagactaaaaagatcagaatacccacacttctcaaataccatgcaattattactctttatatattgtcaatgcatttattttctacttttaccaactctgatgcaatgactaattaaagattaacttattttggaacaaacaggagaaacaaagtaaatttattttaggatggagaaagtaggtagtagtaggagtgcaatttagatgtctttcttactccctccatctcattttaagtgtagttgtggatttccgtatccaacgtttgtccgtccgttttatttgaaaattttttatgattattgtttttattgttattagatgataaaacatgaatattattttatatatgcgtgagcgtgacttattttttatttatttttaaataagatgaatggttaaatgttggatacatgaacctacaactgcacttaaaatgggacggagggagtaatgcgtaatgtcatgttggccctagaatgataaataggcaacatatgtagccattgcctcacatatttacactaatttttttatggccaaattcgtacatgcaaaattatctagagaattggtgtatgaaatatgcaaaaccttctgcacttccattatttgtaaaaaaatatttgagggaaaagtataatcttttagagaggctggcggatataagtgac

SEQ ID NO: 46799 - DNA, 6689 bp, Oryza sativa
cgactacagggcagatatttcagaggagataaaagtgctcttactaagaaggcaggctcaaatgatctcacgcaaatacgaggcaggctcgaatagggctgtaagtgggtcagccgcgaacccacttatagatcaaaataaacgggttcgcggcttattttagcctataagtgggtttcgcgggttagccacttacacccatgggctcaaatgatctcacgcaaatacgagggccacaccaagtagggctcgataagaagccatgctcattttgcattggctaattagttatcttagcaagttaggtcggtttggctcgctgtgctataaaagttattcgattttgcggaatgatgacaaattttctcgatcgcttgaatcattaatcattcaagatatgtcagatgacgatagagtaacacacgatatttgttaacaaggttcagtcgaagtctacatcccagagatctgattatgggtgttcctccccaatcaacatagcacctagccattacgagtccatggcctcgctgccatcatctccctgcgcatgtctacactacattatagtagccatgattacattgtggtgtcccctcctctctatttaagagagagcatatgatagagtccgactctaactctatcctacacctgttccaactcctagtaggactagtatattcgacaaagattctaacacgttagctaaatgtacgagtcggctgacgagctggcttgttaaactcgttaacaaattttatcttatttctatcacctttataatttaccaatttatcctatgtgcaataaactccccctataaatacggatagtttagaagtaactaaggagtactagttaagaagcacatgtatgaaaaaagtgatgacctctcatactagcaagctaaacatagctagcgagctaaaagctcagctcagatcactataactacgagttcgagtggatcagaacatatctccaaacaagccaatccaagctacaagcttcatttttttttctacccctaacaccaaccttcgtacttccgataaaaaagtagaggacactccccctcgtatatcccttcatcccttgcctaaagtatatggtgtacatatcgaaggaaaccctaaatcctttggtctgtctgcctctattaaaactgtcaacaaaagcaaaattaacccagagagcaaagaaaagcaagcaggacacaatataatatgaaagcattcaggagcaataagagtatgcccacatcaggggagaggaaaagacgtaaacgatatcacgagttggatttgtagaatcattagatgattaatcttgatgatgaacgattatcaaaaggtgagtgtttgttgaaaatatggtgaagagtgttttctatcggtgaacagtgcgtcgacattatgttgccggtcaaactgggtagtgggcgccggttaaatcgaaggtgtccgggcgatctgaccagttagcttgacggttagaccgacagactctgagagggagtcggtttatcgtggtaagattaataagtggtaagattaatcagttgaaggtaaagatcttccaatgtagtacagactaaagaccttaaggcgtactatcgaccaaacaccgagcatcaggcaaacacgtatcaacaaaacatttaaaagtagatcaactttatttcatcaatatgtgtttacaaagtgcatctaaagcactcctctctcaactcttgaaccagaatcgaagctaaaaaaaaccctaacttttctctctaaaaaagtcaatgtcttctagtctcaatccctcatctatttatacccatgacatggttgccccaaaccatgaatccaactagaactagaactcttaatcacatagtaaacctaccaaaccagagaaacaacatccccatataactccacacttcaatcttttcaaacttggacttcaatccaaatttaacccatctttccgtgcgcacacatcaccacatatatgccatatgaaaaccttcacctctacatgcattgctatagttgtctagcttgagtatcccgcatgatatccttgatcatctagacctcatttctcccaagcatagtcccgatccatcactggctatactcccatagccacaagcaacacctgcaaacaaatctatcatccactcatttctcatcaaaattttggtttgctccaacacctcgtaacaaaatatggatagtttttgtctatatttccatttggttaacttggtggtcattaatcacaccagctacaactagcaagcacagtactatgccaatttatggcacactaacaatctaacattcatatatgtataaaacaatgaaagataaaagataatgcatgaaggactcatgcatttcttcaaactgcatttgtttgtgtttttctatagataacaagggcgtgaatagcttgctagatgttaatgtgtggacacggcatctgctccaattgtcttgtgtttgacaagatatggttgtagaatatcatgcattcaatacttatcaggatcagtactccaggcatgaaggttggcaatggacaggagtcgagttgtcgatgacatcaaaatttatgcctgcaaaatcatatagagaagaattggcatatgacaatatgaaaaaataatgtactcttcagttatttgcaaagtttggtttttaggggcaaaattatcattcaaaggggctgacggatgtgagtgacaaaaacttgacatcggtagaaaaataggacaaaagtactagtacaacactatactgtagaactcgacgaagtcaatggcaatttgtagaactaagcagggatgggaaaaaaaacaaaggatttctcattataaaaacattatgcatcaacggaactggaagagtcttccaaataagataaatgtactcttactaagaactgtacctattctaaagaagatcactgaaccaaacaatctaacataaccacaccaaccttcatatttattactataggaaactagagcgcatcaatcctctcccctcatattacacatgcaattctgcaaacatataagagggaaagaatcatttgatctgtccggctctaggaaaagcaagatagacaatctaattagtcagcaaaactgaacgacgctggggagcaagacaaaaagatgaaaacgatatcacacatctatactttctatatagttggtaccacctaacaattacttcctccgtttcacaatataaatcattctagcatttcccgcattcatattgttgttaataaatctagacacatatatatatatatatatatatttatttatttatttatttatttatttagattcattaacatcaatatgaatgtggaaaatactagaatgacttacattgtgaaacgaaggaagtattagaaactaaagctcaacatgcaagcatgccacatcatcacccactagcaattactattctagcccatttaaattccatgcaagcatgccacatattcactcactagaaattactattctagcctatttaaaatctatgcaagcatgacacatcatctacaatattatattatagagatcaacaagtgtatgtcaaattatcttcctcacattattttctcaacatttcaacttttatcatttcaacaatatttaacattaatcatccatgaataccgcagcaaagcgcggggtatcacctagttatattagatttggatacttggtgaacaatacgaacaaccaagaatttgattgcagtggtaaaacttttactcaatgatatttaccgattccacaattaaaactaaacctaattcctcttaggttgattccattttttaatagaaatatgcatattatcccatgttatcttttttttatatacaaatatgtatgttatcccattttttttatagaatcatgtttttttattttcaaagtgtccaactctccgctctcattttatccctatattttgatctcattttttataaaaatctacaactcttcctactcatattatccctatattttgatctcatttttttcttacaatttgtaactctccacgctcatattatccctatattttgtggatcatactttttttttcaaaatgtcttcttagtagcttaatcctatatttgttcgttttaaaatgtcttcgtagaaatctgcaactctccatgctcatgttatccccatattttgtggatcgtgttatgtagagatcgtttgcattaaaatgtcttcatagaaatcaacaactctccacaatcatgttattcgtatagctctatagatggtgttccttaaaatatcttcgtagaaatcaacaactctccacgatcatcttattattcttcgtatagttatatggatggtgttccttaatatctctagtttgtcccaatatgtaaagatcttttacttcaacatattaatcctaatacaatatcaatggattatggtaagaaatgtacaataaatttatctttcatttattcatcatcaaaatattggtttgctccaaaacctcataacgaaagttagtagggcatagggatgaaaacagagcggataatgctcataccatagttgttttcatatcttttgccggatacggaaacaaatacagatagcttgaatatggaaacaaatatggattatctcaaataggaataagaatcgaatatgatcggacacaaatacggaaacaatttttttctcagaacatgaaaaccaagtcaacttctaatagaaacaaatatcaacatatataattagctcattttatataaaatgtagtataatttataaatattttaaaattttaaataatattaatagtgtgaactagtgttaaaagatgaactactattaaaacctaaaaaggtatattgaaggtcatagagttataaagaaatggggtgtgtctcatggtttctgcggatatccgaatagcactgttcactagatatccaaattattatccgtattcgacgtaaaccccgataccatattcgtattcgtatccgtgaggaaatatccgtattcatatccgaactatctgagaattatccaatccgagaggtatccgtattcgatttttctccggagcggacggaaactatctgcttcgttttcatccctagtagagtaggcttcgattcttatattattattctctccatgataggcaacgttaatcacgatcagtataaccaggaaacagtgtaatgtgcctatttatatagacacaacaaaattcaaaattatgcatgaaggactcacacaatttttcatttttcatactgcatactttgtgtgtttatatgcatcacaagggtgtgaatagtttgctatatgctaacatgtgagcatgccatctcctccaaattgtcttgtgtttaaccagctttggttagtactccctccgtttcacaatgtaagactttctagcattgcccacatacatatagatgttaattaatctaatacatatgtctatattcattaacatctaaatgaatatgggcaatactagaaagtcttacattatgaaacggaggaagtatcatccatgcaggaattatcaggttcagattaggaatgaaagttagacctgtcctgttcatttcgactacaaggagtggataaagtttcggattttcgtggcacgctttgcaaactgctaaacagtacgtttcgtgcgaaaactttctatatgaaagttgttctaaaatatcagattaatccatttttcaagtttgtaataattaaaactcaattaatcacacgttattaccacctcattttgctgaaatacttaatcttaatcttaatcttcatctttaggagattcaaacacctaacaattacccattgcctcacctttttttaccggacttaaaagttggcaaagactattttttttcgtgaacgcgcaaaaggattgcacgtcaatattagaagttggcaaagaccttcagtaaagacgaaaaagaactagtaaaaaagatagtgtagttctagttgaagtgatgggcaatgggtacccattcctgttcctagctcagatgtttagctaaattgacgataggttttcatcaattacattgttagacaatcaaactgtaaacaaacaagcaaaatgagaggaaaaaactagcgaaatcaaaagatgaaagtccacagcctcggggaaacttcgtagtggtttcttgaaacttatttctttccatagaattcctatgttccaaagattttggatgtgtttcttggtatggattgggaacccatctcctagcacggaaaacggagtggtctattagcgcgtgattgatgaagtattaactgtttttttttaaaaaggatcaatatgattttttaagtaactttcgtatagaaacttttttttacagaaaatacaccatttatcagtttaaaaaacgtgcgtgcaaaacacgagagaagtgagttgggaaaagaactcagccgtagtggtttctcgacacttatttcgtttccatagaattcctatgttccaaagaggccttatttgatgcataccttttgccaattggcgttatctagcccgaatgcttctcaatcaattatagtagtatagcatatggaaaactctgtaaagagggctgcagga

SEQ ID NO: 46800 - DNA, 3231 bp, Oryza sativa
  unsure (1)..(3231): unsure at all n locations
gatttggcagggtacaggcccttgagcgctgggtcgaccatccggtccaacgcatcgatgtcatgcagctggggcgttgcccaccggacaagtgactgctctgtccggagtctagcgctgagacgatagtttgacacaacagtcaggggtcaggactaagaaattaggaatcatcaaatgtaggcataaacaattcagggatgcagaatcagagaaaaataggaatacctgtcaaatggtttgcggcctgtcaagagctccagcatgacaactccaaagctataaacatcactcttgagggtatactgcccagtcatgtcaacttcaggggcactatatccagaaccctgatctgaagcctattgagatttatttggaaacatgaaaaatatggtaagccatatgttgtgtaacatcttggatactcaagaaaagaaccaatccattcagaacttaagtttccttttttaagtaagaccataaatttctttacaattgaaaatatatatgtttgttggagcaaaatgatttgagttttacctggaattcagaatcaggaacactgctggcaagtccagcatcagaaacatgaggattgaactcggtgtccagcaagatattagatgacttgaagttcttgtggataatagaaggagaacaaatttcatgaagatacctacagaaagttaacaggaaaggtgattaggtgttgacagaattccatgcaattaagagaatttacaagtgatttgtgcatatactcgttatttacctatcacattccattctattataatggcaagtcagatcaattttcacaagtcattaagttggaaaaaagacaataatttatttgaaaagtatccaacagatagggagagagatcttagttttcacttactctagtgcccgtgcagaacctaacgcaatcttaacacgagaattccagctgagtggtttgctatattcatctgggaggtgaagcatatcatgcagcgaaccatttctgtggaaatcataaactagcaagtgctgtccatgctccatgcaatagcccacaagctcattgagattgggatggtgcaactttgaaatgtttgacaccaagtcaaagaaatcgtctgaagattggcttggcaacacagtactgtttagtttcttgacagctagtacctgattcatataaggagaaatgtaagccacattgatcatgtgaagaaatgaactgtctttgtatatccaagtgtgaaacacttggtaacttccaaggcagaacaaatatatgatggtggaaatctgaattggtaagaaagcaatcaactcaatattttcatttacatattgtactataaatgaatgaagttttgtcactattgctaggaagaaatggaaaccatgtatgaatgtattgcttctgcctctaagattgcttaggtgcatttatgtaggaaaagttactctaaaatcaaatttacagcacagttttaaaaactgcacagtaagatatcttttgctattctctcaagcaaatggcaagtgcaatcatgcgtacctttccatcactgaattgtgccctgtaaacacgtccaaaagtaccctctccaacaagattgtccatgttgaaactatctgttgccatctgtaggtctgcaactgaataaactgttgcttttactgatgctgaattacttttctttgcaacaggcttgtttgaaaagtcatcatcatcgtcatcaaatgactggttgcgctcaatcttaggaggtggttttagactaacggccacaggggaaggcaaaggctccacctctatcttggtggattctggtataggcttcacatctgcatttgtagaaccatgcatacattataacttacaaaactaaagtgtcgatcatggtatatcaaacactgcaacactcaaacactgacctttaacttcattggaagggtatgaactgaaaggctgtcgctgttcaacatgttcttgccttgtacctttgcgttttctctttatcaagaagaatgctacaactgctccaatgaccagtagagctacgataattcctgctatagctccagcacgtaaccctgaatttccaccagaacttgatgagctaccactgccattggagtgtctgcctgggctttttttacggttgcgtgatggtggaggtgctgtgaatggtggtggtggtggtgccggacctgtgctccaagaattgccatcggttctgttgaacataacattagttcaagatgcagccatccaaaacattagggaactaagacataagcaatacttactgaagactatttattttctttagctcattaggaatccaaccagtaaaacggttgtttcccacatttctgcaataaaggaggaaaaactggacttagtacaatattgtgtgatataaccgatttataccttcaaaatgatttgcttacaaattatccaggggaagattagcaaggacattgattgatccagtaaattggttgttctgcagatacctggtaagatagaacataggttataggtataagagaacttataaatttattatattattcaaagttccttcttacaaagttttcaggcttgacagagaagtgaaactttgtgggagatcaccagtaagagaatttaaggagagatcactgtagcaatgtacagaaatatagtaagagcaaagatacatcgtgacttgtaagaaatgcaaacagagaagttagaagaattttgtgtgcacattgagatcaacctagaatacttgttttaagtaagagtactcacagtgttgataaacttggaaggttggaaaagacatctgtcatatttccttgtaattggttatgattaaggtttctgtattcacaaagaaaatccaattaacccatagagtacaatatgaatttcaaggcaaatttgtatttgggtcaaaaggtactcacagatacttaagtttaggcattgtggaaattgagtatggcacatttccagcaaactggttcccagcaagattgctgcaaataaaaaattcacttaaattatcgccataaataacaaagaacaattagatagtatgtgtcagtacaatttttttccctaaaatagattataaaatggcaacatctgaggaacttacagcctnnnnnnnnnnnnnnnnnnnnnnnnnnnnnnnnnnnnnnnnnnnnnnnnnnnnnnnnnnnnnnnnnnnnnnn

SEQ ID NO: 46801 - DNA, 26814 bp, Oryza sativa
ccacgccaaaataaacatgcagtatagcacagcgacccacacaaattaacctcagaaaaaaaaagttacatgacatgcttaacacatgagtttaactagctataccgctattagaataaaatgtttcaaaatatacatcacctaaacttttaatatagcatattgttatatcgctgttttagtccaatatatgtactgttaaaagctttctctaacaaatattgagcaacatgtaatggtatattaattaataactagcactaaggatctccttttacataggcaagactagtcaagtaaccaatgtgacgactatactaggcagatcagatcaatcggttgggccatttaaaatatgagtattcatccaacattgtttaggagaactggtaccgtcactttttgacaactggcataatgcaagaaccttcattgccacaattctttaacccctcttctagaacttctctaaacttaacatgtagtagctagacactgccagttgcatcacatgaagatgtgcatatacacatgtctaaagagctccaaagtcgaacggcgttggagctgagactgttgggtggacctcagaagacaaggattggacgactttgtgtctatttcagttagatgtataatttcatacccgcggcactaaactgccccggccaaatattattttgcaagtaatatgactccattggtgtgtagtactagctttaggtgatcaaattgcaatattcattttacgctctagctatgacgcatgaattccgtgttcaaccaagggaaagaaagctccttgttgacgcaacctcctctatatgccatatcaccaccggagatccatcacccatcaataaatagaccatgaaccctagctacgatagtgaaatcgctgaaatctaagttggcatcttcgttaccacggccaattgatgcttgaatcattcaacccaccaatctagcaaccgattgaaatctctcctatgattttgagttgaaattgaggtttttgtgtatgaacgcaaggtgcctgagtggaaagatgggatgatcaaaatatggcaagatgtagaaaaaaggtaggacgaaagaatgacatattagtgtacaaccattatgtggtatagtgatatatataaataaactccatgaatatgatatgaaaatatgtttacaaccacctcaaaacaatatattccgtcatcatattgtatagttcatgtaaaaagctggaagatcctcgctaaagattgtatttataaaagttagatccatagtgaaaatcaaccaatcaatattttattgtgttgtgattcgaagaaattatacatgtcacaaagatcaacaaatcaaccaaaattaccaaaaaaaattacatgccatatctcttaatatcatgtagaatgtttttggtttacaattagttaatcgttcataaataggaaaagttagggcccatttggtagggctccaatttctaaatttaactccagcatttaggtatggagtggagttgtaaagttgtttaagcccagcttctttcagttcattttgtgggagcacttcaactagctctacttttttttaggtggagatgaaaccgtttggttagatttcagttttaggagagatggagctgaactgaagcggtgtcaaacgcacttaattagatcatataataacagctggtgcaggcccatcaaacacgtcactgtgctatatagaaagtttattgaaccattcccctgcataaaataagcaattggcgcgtggtgaccacggtgtgggaatcgtttggtccatgtggtcagagaggactctgcattgcttgcataacaaagaaagcaaatattaaaagtatagatctaattggaggcagttttggctttcttgggtgtgggaaggtttgccttcatcctcctctcctcgagacctcccaacacacactggatagatacgccaaagccagcctcctctttggccgatgcagctgtagttagtaataattaaagaactaatatatgtttaaacaaatctctggacctaattggtgcggtgatcagctggtcgcttgttccttcatttagtcatgcttgaatttgttttctcggatggcatggcatatgttttgactttatatgtcaatggtttaatggctcacggtttctgtggcatgcatgtcacaaaactttggctgaactttgactcagctgaaacgatgaccaattaatttgagaacctgaaaagatatatatatatatatatatatatgggcaattgcttatttgaccccgttttaaaccctaactaccaatttgaccctactttttgaagtttgcttgtttgaccctccttttctaaaacgaagctcccgtctaaccctgtttccactagtccgttaagttttgatttaaaataaaaaagaaatgcaactaatattcataatatccagaatacccttaggaaaccctatccatccacccaaccttatccacatttctctctctttctccttcctccttcctgctcgctcgacttgtggcggcggtgctagggggcggcggcggcgactgagggggcggagggagggagcagcggcggcgacggctgaggggcgtggagggagggagcggcggcggttgaggtggcgccggtgcggcagctgaggggcgcggagggagagagggagggagggagcggcggcggctgaggcggcgccggcatgggatgagggaggcggcggctgcggcgctgagggggcggagggagggagcggcggtggcggctgaggggcgtggagggagaagatccatgccggctgaggggcggcggcggctgaggcggcaccggcgcgggatgagggaggcggtggtggaacctccggcgcaggcgcgcggaaggagggaggaggcggcggtggcggcgccagatccgctgaccgcagctcgagctccaccgcccggactcaccgccgccactcctcgtcatcgtcgtcaccagggccggcgccgtctcgccttttgtcgcctctccctgtggtggatacgtggaggagaggacaagaacacgctgtcgccactcgtcgtcgtcgacgtcatcaccaaggccggcgtcggctcgccgtctcgcctttggccacctctccctgtggtcaatccgtagagaagagagaagagaggagaggagaagagaactgacgggtgggttccacatgtaatacggtcaaatgagtaagggcagaagagacattttgtgcttcagtcaacaccgttagatgcccttaacagaatagggtcataccgtagcttcgtttttgaaaaggagggtcaaataagcaaacttcaaaaagtagggtcaaattggtagttagagttcaaaacggggtcaaataagcatattatacacaagcacattttactttagtttagaaagaaaaaaattgcaacatatacatatctacacgcatattttttttagtttactagaaaaaatgcccgtgcgttgcaacgggtaaatgtgattttaattttattattgttatacggattagccagggtaaaatttactgtgggaattcgcttgtatatttttttcagaaaatcatgagctgcaattaagagcctgtatttcatctcaagttagcatgcgagtattttcaaaagatttcttatatgactcttttatacttcgaaaagaaaacaagcttaaaatccaactcaaacacggatatatatttccaaaaacgaacgaacttaaaaaccgactcaaatacggatgacgtaccaaaatatcggtaaaaacatgttcaatttttataatagtagagatacatgatattgttttaaaatgatcggaacgttattgacattttatataataaagaagtgtctcgttttaaaaagaaaatgggaccaaacaatatacagttaattagagaaaattgtgcaagtatgtaaatgatgtaaacttgcttatattatttactagctagcattaactgtagttttagctttgagacgatatgttaatgttgcagtgcatttctcccattaagagcaggcaatacgtacggacgatgtcgtagcccgtgagtgaataatctacaagagaggcggtgttaattacgtgcaacttgaacaagtgactcgataataaaatccttccacaataatttgtacacatatcagatcccacaggaaaatggggaggactctgcccgagacgcgtcaaaacattttaaattaataatgcttttaacgaaacggccggagccccggaacgtaggttgcgattatagctttgttcagagtattcttgtataagaattaatccaaatcagcgaattagtactaattgacttcatcattggttcttatccctgattatatgttctgtacatatcttatgctagctatatgtggtgatgcacatttatttgcatgcatgcatgcatggccggtatgaaacggctagggttgaaaaggttattatatatatatgtacatttagattaatttaatttcgtccaaatcagtggatcaaaggggttaatttggaattatactcctagctatagctagctaatagtataatctaccgataaagtaactgcctgtacaaaccttttttcctgcgtactgttagctagctgctcgatcggacaaattaatattttgacccataatgaagtgcgtacttacgtatgaattactatatcccccattaattaattcgctaatgtgaggaaccatttttatgtgaaagcgaagtagtatgagctttatccatacatacacacggggctttcgcagcgaacaattgaacaagttggagaaagcgacggtggggtggcccatagattttgacaagcttagcccaacttggcaacccacttgaattttgtgcatccacgggccacggcccacggcccacggagcaacaacgcgagcatacgggccatcccactgtctagttgggctcgattcacccagaagcggcccactaagcgcgaggggtagcctggcccagtccgagaccaagaaagaagggatttttcatcaggtactatactctctctccatcaaaactagctagttaggtggcccgtataattgcatgactagcacctatataaaattatttaagttgttttatacatgattttctcaaattttgttaaatagtcgtctcgttgtattaccatattaaaaaaaaatcaaatatcgggtttccagttttatagtaagtcataccagtcatcacccccttactttttttttgctaccccttaatttacttgtccaatatgtcacggtttctatttattatttcattttcattgagacctttaaaattataccatatagtttttagaatttattgcctcgtcaggttctcgttttattgtttttagaagtaccatcaaacgctactactgtacccatttattgtttttattattgagttctggatgatgtctccttttagtattttgtttatttttaaattgtattcctacttaaatttttttctgatctggaacttaattttatttttcttctaaattttaattaatctcgtgttatgttctagatggaatatttttgcaatatttctttttatattccgaatttcagttttttaaattttattcctacttaaaccctattttccttttggttaatcttagaatttacttcatttgaattttaattaatcttgtattaggttttatatgattgttattcgatatattcgttacttttaattctgaatttcagttatttataaattttattcatacttaaactctctttttctaatttcagaatttattttatttttattttgaatttagttaaactcgtgttgtgttctaatggatggtcatttcaatattccttattatttaatttcaaaattatattactactcgaagtcttgaactctctatttccttttctaatttagaatttatttatttttgtattctcaattttatttaatcttgtattgtgttctatctgggctcttcttcaaatattattgcttattttcaattctgaatttcagttatttttaaattatatttctacctggactctttttttaatgattaatgtggaaatttttaggctctatagcgaatgtggtgcataattttaaggttatcctaataatatagtagatgataagagtaataacttatggctatgaatttgcatatagccataataagttaattcttgttagaacgaagaaagtatttttcaaatatttttcagggttaagttgccacaagcgttattcacattttgaccatgaaaacttctaaatatttgatgtggaactaatatactttgttaatatgctatactaacttcaagtatttaaactgctaaaagttcaaaaataaataggattccatgacaatgtttggatctccattgttgatccttgtcaattattttaccttattaagatatgtggaagttgctttaaaatatcaaatatatttatttgtcaagtttgtaataattaaaacttaattagtcacgtgctaatatcttttcttgttgtacgtacattaacttaatctttattttttatcagtgaagaaatggtacaccaatatatacgtgtaggcagcactagtgtagtgtgtgtacacatacatacatacatacatacatacatacatacatatatatataggacctgtttagatgccctagcaagttttttaatccagttaaatcgaatgtttagacacatgcatggagtattaaatatagaaaaaactaattacacagattacgtataaattgcgaaacgaatcttttaagcctaattgctcaatgaattgacaatgtagtactacaataaacattaggcttaataaattcgtctcgtaatttatcggcggaatctgtaatttattttgttattagactatatttaatacttaaaatgtgtgtctgtatatccgacgtgacatggcaaaaattttcaacctaaatctaaacgcatccataaaccaaaattagtcgaggacgacatggtggcctagtgatctgatcgtgctgtctaccgcatgctggagaggcacgcgtcacgccctgatgaagatcacgtatggggattggcaacgcaattaatataagcttgacccattggtgtctgaaattgcagactctgtcgatgattgctccaattaataatgcactcgctcagctgattaacgctcaatttaatgtacaaattcattaagaaattaaatagtcatcctacatgttcctctacatgtgagcttagcgtagtgggagagcgggacaaaagatgctcgatctggaaattaaccatcgcatcgatggagagctagcttgatgaggcatcgatcctgacattgtactacccctatggaggaaggctgatttcattttgtgcatacaccgtgcagattgctttccaaaatcattgatcataaaatctttttaagtaaatttcatcaaatacaaatgattcgcaaaattatcgcaaaaccgtatctttcgaatgcgttgtgaagtatatgaaactgtagatagaagtagaacatgtaaaaaaatagttttataataaatttgacgatttgactacaagccaataatatatattgtggtaaacttgagaataacattacagcattgttgcagtttttatgaagttcatgcagtttttttccctatggtattggatcattatctattttcagaagctttgccaatacctacggggtgagaataaccatcccctaaattcggctctgattgtggttgagttagggctaatgagatataaaaaaataaatgaattaactaaaattaatttatagctaaatattttatatgttatttgcttgcagtttataaaccaaggctaaagaataggctatgaaaaaaaccttcatcgatatagttatactgtcacaactttaattggctcatttctttagaaaattaatgggatgtgtgaattgaaacgagggtaactatgtaatctgccatatctcttaggtttgtgtgaaatttgttagaacgataactaatttcaaacggagtgagtacattagcactcaactgatgcagtgagcaatttgaagtagagaattactctctctctctctctctctctctctctctctctctctctgaaataaccatggcaaattataagtttctgatctccgccgcatgcatgaagctggtgtgaacaggagcaacgacaatatgcaatgacgaattcttgtatatatgagtatatgactgaaagtaagaacacacttccctgcaggaacctgtacagaacacatcaaaggcacccaattcgatggccgccgtgcttgcagtaatcactgatccgtgcaacacaccatagccggcaatttagatcgagttggctttggaagaacagccaagcagtatgacacacacacattctctgctcgtacaagctactacaaattgctagctacgatcgatctgatcgagcgtactcatgtctagctagctgaatcgatcgatgcatgtatgtatcttatattctacctgttgtggagggcatcggggcagcttggaatccgccgcttgtcgtcggcgaaccgggcggcagcttcagaagccgacgacgagctccacctcggcgccgccgcggggaccggccgcgagccgacggcgtacgacgaccccgacgagagtctcgccggcgtcggcgcctggaacgcgtctgccaggctgatgcctccgccgccgccgtggagccagagcgcccacgccaggcacaggatgagcgcgaggcgacggcgaggcagcggcgtcgtcgccggcggtggcggcatcgagctagcttagagagtgaagaaatggtcggtgtttgtgcttggaaagctaggcttttggtttaactagttaggttagcgttggctgtttccgctctgaaacaaataatgcgtgtgagaagcgggaatcaaggagagttgccccaagtatataagtttggagtagtataatacacttcgttttctactggaagaagaagattttacaggtgcaacacattaacaatttacttggttgaccacctgaaaatcctaggtaaattacattagttaagagcatatgggtgcagatgtgatattaattaagttactgtgttactcctagctactcctccgtcccataatataaaaagttttacagtttgacatggttattaaaaaagtatgtaggagtaaatggtggaggattgtgattggttggaaaaagaatgttggtgaagaagttgttatgttttaggataaatcttgagagctaaaagttattatattttgggacggaaagagtaattacatctagagactgaatgcctcattgcctggtaaaaaaaatactaatacaagtaagtacagtagtcctactcctgagcagtatagaagaacagtagtagcagtcctgaaactgagaatcacgggcaagtagggaactgtttaatctctggcagtacgacgtaggaccttcatcagagtagaataatagtaattataataatgagttactgatcgagaggaggagaggtagtactactagtgtagtacaacagcaagtgcaagagatgctgcagggtgacgacgactgtgccgcggcgcgttacaccgtgccgcgattggggctgacgctggtgtacggctccccgcctcgcccggggtccatttgcccggacccagcgacgacgacgacgacgacgacgacggatagctcacatgcgccacggccggcctccatctcaatccatccatcgtataggttgccttgttgctacctttctcctttgcacgtgatgaacttgcctggacgaacaccaattgctgtactttcttctcaaaaatggagctagcttttttttcattgccttttactgttccacttcatccgtttcacaatgtaaattattctaacatttctcatattcatagtgatgttaatgaatttagatagatatatatgtctaaattcattaacattagtatgaatatagaaaatgctagaatgacttacattgcgaaactgaggaagtacaaaacaaggcaggggtatgcagtttggatctaatgttcggtgttcagttctctttggttgttcagcattttgttttccaaaccggtgttaattgtaaaatgtcatgaacaatgtttggcatttgttctagcatttaggtgagtcgtttatagccgtattattcgctcaaacgtcccctgttttgctgctgctgctgctgctgctatttttctgcactagaaattagaaaacgtccaaaaggatatcaaacaaaacaaccgccaaacattaggcgtggactgtctagtatagccgtaaagagaacaaattaatagcatatggcaattcaatcatggggtgccattgttaccaataatgctgtcagatgaatgcttcccaccacaagtccatgctactgctgatgcacaagggtgtgcatccatctcacccagcaatttaattttattttgttacaattaccggattctttcgggctggccgtcctcgttcctcctcatggctgctcgctttctacttgcttgagcatcttcgagtgggcttcgactatctagtcctcatcttttggcagcattgaaaggagcgaaattctagaattcttgatttttctctctcctaggtctctgtggtttgaaagtccatccttcaggaaggctgtttgtggtcttgtactaataccgttgtctttagaggcttattggaagagtagtatggctccgcctccaccttctgagttgtgaacacgccgttgtctttagaggcttgttggaagagcagtatggctccgcctccaccttctgagttgtgaacagccttccagtagtagttttttcctttactttggtggttcttttttttttctttgtttcttgtccccaggcaatgaccgtatgaccaattgcattgtttaaaaatatattatgtcttcttgtaatatattgacatgcaatcattttgcgcattcgtgaaaaaaaaattactggattctttccaatcccagctgatcgatgagaagcaacaacacaaggtgtggggctgtttggatcctagtgatgatcacagctacaatggccatgtcctttcttttccttccagctgaagaagctattgataatttgtcctgtcacttagggctcccacatagtaacacccagctgcaactcgcccaataaaacgaaccagcaagaacaacaagtcacaggcactgtcctcatgcatggtttgccctttgtatttttgtgagtttttctgccctagttggatagggcccaagctaacttgaatggacatgcctggggctaatgacaaactagtccggttcatcactactgccccagtgacatgaccaccggaaatggaaatatatatatagtagtacttctgatcacagatatgacaattcagatgggtacaacatgtacacatgcccagccattttggccattttccagcaaaagacagcgtatataatccactagaagaattcgatcagttttctcttctcaataaaacaagaacaacaagaattcagtttcacccacagctacttaaagactacagagacagtggtagtaaaactgacatccttgtgggtttcacagggaaacgatgacttgtacaagccaaacagaaacagaagtgaagtgaagtgaagagaaaatttgcataaatgagaattcagacctcggccttgtgctcggggcgatgggtgaactcgaagtcgacgtgcacaaaggcgcgctcgacttcggggagttgctccagcttctcctggagcgactccccgatgtcgtgcgcgtggctgagcggcatgtcgccggggaggacgatgtccacctccacgaagtagtgagtcccgaaggtgtaggccctcaccgtgtcgatgtgccggatctcctcgtggtggttccatatcaggtacgtcagcttcgtcaggtactccgccggcgccgacctgccgatcagcgtccccacgttctccaccaccgtccgagcccacgtcgtgatcgtgtacaccgcgatctgcatatccaccattaattctcacatggagtagctagcagagtggcaggcaggcagcaatgggggcactcaccagtatggctccgaccggatccatccaccatttgtaccggacggcgaggagcgcgctgacgaggccgaccgagttggtgatcacgtcgaagaaatggtcctgcgcgtaggctctcacgatctcgttcttgaacgaccggcagtagagcatcaggaagaacttcaccactgcgactgaggacatgctgccgatcatccacagctccttcctgtggtcgaacacttggtgctcctgtaaggccattgcatataatagattaagctagtgtcagctgataaatcacataaataatggattatgaatttgacgaagagtgttcgtgggtacatttgtgataagctgacgcccggattcaattagcacttggaagccaagtgtacccattacagatgcaaatactattatgccctgaaaataacaggttattcagttagctccaatagttgtcatgaagcaataagaagcaggtaatctgaaatctgaaaactctggaattttgtctagatcattttagtatctctagcataaaagcacagcttaagttcggagtaatgcaaaactgataaaagagaacagattttaattaaccgagtcattaccactggctgcattcgtctcttcccaattggatagctatacttgttgggctttttcatagcatgtgcagtaaaccagagtatgaaacctgacaaaagatccagtagggagtccagtgtcgatgctattactgccatcgataaactttcaactgatgcaagaactttcccaatgaaaagaatcagattgatgatattcgacaggttgatggccaatcgttcgccctttgccatttgcctcaactcttcctaacaaaacaacatgaagatatacttcatatcactatgtgtatagaagacaaaaaaaaaaagaaatatacagcatccaatttatagttacaaatctggcaattgcatattgcattgaggaaatgtgttctcttaacaagattttacctcagtaggagcattctgatctaaggaaccaatctcattcatggtttccatctcgctgaaatccttcaggagattttcctgcttcttgtagtattttgcaattttccgatgctttcctgttatggggcaccgactttttcagtactcagaagtactaataaacgaaataatcaaagaaagaagagagtgttaaaccaaatagttaattaagcttaatggaacttatcatttttcagtccatagcatgttccacatgcatttaacagcttgatcaatcaagttaaagtactgttcgattgaaacatggtattccactaggataaatgcatatgctaattcacagtttcacacaaggaaaaatatatatagtccagattggaaagagtcctagcagcatgggaagtgtcttccttcagttccttgctactaatggacctaatgcagtggacgtaattagcaaacatagttgagtaagaacattattcataggtgaagataaaagactgaacaagactgtatgagccttccttccttttttgggctggtcctcaaataaaaatctgtctggcccattatattttcgggctgggcctcaaaatctatcactcttttggaccccccattgggccatctctaatgctatgtgccaatataaggttgataagtatgtctatatgtaattgcaatacagtaaattgcagtctgtgccatcttttaatcgatctattttagatcaccctttaatcaatcttttttactttggactagataattttagcgttgttttacgttggaccactcctagtttaataaaagatgtcctaaaacacaatttactgaaatttccttcaggtgtctaaatcgtcagcaccttgattcttcatatgagcatcgatgcttgagaattagcagcacctcacgtattagttgccaagactcaagagacaaaatggttattcttcgttgatattcttaatatgcagaagtatggacagtactgaaatgacggccccttcgcatcaaaataatgcttgtgctgttaacgtcagtctacaaccaaagactagacactagtggaacgacagaattgagtccagctgagtctaccgagcaactagtatactgcaatactatgagtaaagacaatcgtgttgtttagtgcgggtcaagccatcacaagacaccgagattctaatataatcgatcacgaattgaacaaaaaagggaagaggtaaaaaagctgcacgagtaaagtaaagctggaaaagaagaagcatgatcagagcagtagctgctttttccatcttttgtttcctttctccctgaagattactaaactggtagtattactgtagtacgagtgagtatatatgcagaaaatctaagagaattgatctcaaagggaaatcaatcaagagaaaaaaaaccatctagtattaaacaggaaaggggagagaggattgaggatgggaggcgtgagtaggtgaccatgggagccggcggggaagatcctggagaagaaggggggcttgcggtggaagcgctccgggacggtgaagtcgtcgcccacccgcagcttccacgtctcatcctcctccgtctccgtctctctctccccgccgccgcgtcgtcctcggctccccatggcctgcttgctgctggtggctaggccggtgcagaggcagcgatatgatcaggagcacgcaactcgatcgtactcatccgatcgaaatgtccaactgggccgagctggagagaatatatccatggcgcgcgcgggcgtgaggccgactgatacgtctgggggcacgcgtggtagcgatcgccaaggatcgatctctccacatctatctactgatcaccgaaagttgatcggtttcaatagtcgcgacgcgagcagaatccaaaggctataggctgcacgggtttcgctccgcccccgcacgcgatcacgtcgccgtccgttgtcgtgacgtgcgcgcgccggtgcatgtatgtgccgtcacggaaccttggggtaattgtgccggattaggcgtcatttaggcgggttaggcgactaggcaacatgagattctccggggtttccaggaaatcggccacgcgtacatccacgctgccacttctttggataaagcatacaaaggctttgggaacagagacgacacttgggactcccagatcatcatcacaagtcacacacgatttctccgatatctgcaggatgatgatgatgccaccaaactccgaaacatcacccctagcgatcacccctcttctccacgtgtttttcttttttttttacaccgcattacttttattttagtaaatttatgcaactaaagtttgtacacctcaaatttatacatctaaaatttagagacacgaagtttataagtcaaaagtttatatatccaattcaaatttgaatttaaattcaaatatttatatatatatatatagtatttctatatatctaaagtttatacgcctaaagtttataggcccaaagtttataaagagatttattaactcgatagtgtgggcgcaaggacgggacaagaattttctctagtaccaagttgagctaatgtactttacataattttgcgtttgttctctactaccgttgactttttattacatgtttgaccgttcgtcttattcaaaaaatttaagtaattattaattattttcctatcatttgattcattgttaaatatatttttatgtatgcatataattttacatatcttataaaagttttaataagacgaacggtcaaacatatgctaaaaagtcaacggtgtcaaaatttcaaaacggagggagtattttttaaagatcttttgaagagtaattgggatgattattcgagcttaggagtaggccagataatcatcggacaaggcccatcagaaaagacacatatcctataactaggccagataaagcgggcccatttaggcccattatgttagaaaataagaattgatgtacatgccctgatgtaccaactcctgaaaatggctagaaatgtaaaatcaccacctaagccaaatggggacggtgttatggagagatccataacaaattactccgtagaagaaaaggcttagctgtctaataattaaacttggaccgaacattcgatccctagtttttcttattaaccaagtggtttttacgtttttttccgaaagagacaccaaaagataccacaattttgaatattatcttatactgtatcttttagtagttaggccatgtctagatttcaacttttttctttaaacttagaactttttcatcacatcgaactttcctatacataaacttccaacttttccgtcttcaaactttcaattttaacgtggaactaaacacaccccattgaaattgaaacgaagtgacggaaatgttagaagtttatatgtatagaaaagtttgatgtgacatttttgggttcaaagtttgaatctagacgggccatatcaactgttagagacaaaaaaattgcattacttcagctgtgtttagttcctgaatttgaggagaagtttaggaaaagttggtagtttgaaaaaaaaagttagaattttatgtgagtatgaaagttttaaatgtaatatgatacaatagaaagtttgaaatttaagaaaagtttagtatgaactgaacagggccttctttataacttgtgcgcagacaaaccagccgctacctacttgctagctactccaatgctagaaaatataacaattgcttttgtcataccaaacggggagatcaggaccaagctagcagtccaccaatgctgcctagtttgtgaggagcatgcatgaatgcaagtttatgcaactctgcatgcttcacacgtgtaaggggcttcgtcagcttcttatatcgatttagccgccgtgcattgtgtgtgttcttttgtgtgcgcaatgtgacacatctcgtccttgagatcatcgcgaagatatatcgatttccgcaagacatggcagattagcggcatcgttgatcagctagatcatgattaagtgtcaagtactagttcagactattgtgtgggttttcttaataaaaaggccagatcattatttcaatataatggtctttccctctaaaaaaagtactacagtagtagttcagatgttctctgacaaaacaagaaaggaacgcatagtgctactcctaataagtttaagttagttagggcacgttaaaattggaagtttggttgaaattggaatgatgtgatggaaaagttgaaagtttatgtgtgtagaaaagttttaatgtgatggaaaagttaaaagtttgaagaaaaagtttgaaactaaactaggccttagatcacttgggaagcagtgagtgcacagcctttgggtctaacgagcggcaatatatacgaataatggcaactcttctccatgcttaagattggtgaacagctattatttgtaatgacacgaatctactgaagtgtttattaccattaattgtcctgaacaactacttcagaagggccattcttgatgctagattggtgaagtgatgactcggtcagagcaagagtactgtacacgtacgtatgattccactaacagtagcgcaatttgatgaagctacctaatcgatctttagttgtttaccctcacggcactttatcttggagttaaatataacacgcatgcatgcgtcaaactactgggcagttttgattggtgacatcactgtaaacaaacaggacaccccccaaatttgatttcattgtaaggaacccaggatcgagttcgatcgaaacagagtcccaggccggacttggattaatccatggatgttgatcgagttccaaccaatggttggtaaccgatcgatccatgtatagatcaaacgtcgcaaaatgagaaattgaggaggcagattaagctattagcgatcgaggaattgaagaagagatcgatcggtggcatgaacagcaacgtaccgtggcatcgcttgatgaccctcttgacgaagtgcgggtccttgggccgctccggcaactggaagtcgttgacgctcagccgccacccctccgccgccgccgcctgcttctccccgccgtcgcccatgccgatgccggccggcaactactacgatcgagcgaagacgacgacgaactgctcgcgcgcgcggcgtctgtttgatatacaagttaaccgcctaactggttcacgagacatgcaaggaggagtaactgatttggctgacttgcggcccgtaattattggctttcttcttatcagaaaactacgaaattaatgaaccggatggaggcagcaagaagtggcacggttaagagtgacgcgatgggttttttttgttgccgacctcgcgtcaccgatcgatcgagcgtcttatttatcaatgcgtttcttctcatcagcgtcacgcttcgctccttttcagctgctccctattgcaaacatacacacaccagccattcatagacaaatacttatagtttgttaatcaaattaagtgggacatgacgatgcagatgagacacggcgcgcactcctgtgcagcggcgcgcggtacggtttcgaggcggtttttacgccttggatttctctcgctcgctatcgctttacacacgtcttataggtgccgtcactcactgcgcattgataggtacaggaatagtggaatactctacaacatgtgctcatctcttgtattagctgccaattaaggtgcgacgacgaccttaattgggtgatccaactcttgtgaccaccgcacctcgttgtagcctttcaacaagagatgtatataaaacaactacccccagatatttgaaacaagggatattgacgaaatttgcaaagatcaactggtcctgatggcgatctcgcctcaacaaatcaggtattctatcttagctaggatgtgacaggtagctcaaatcttgtaggctttgccggtgcgattgcgaaccacgatcgaattctgacccaactaagtagatgcaagaaagactctctctctctggcccaatagtttgttgtgtcgccaaggatgggttcatctgaagtcccttcgcgtgatagcaagttcgattttcatcccccaaccgcaataccagatacaacgggtccctaaattgtcaaaaccggtgcagacgaagtccctcggtgatttggatgacggttttggctgacatgacgcctactttgttgctttgacttagtcttcgtcctacgtgacagtaatgtggcactggaagcaaaatataaaaatttaaaatttaaaaaatgtgggacctacatgtcaatcagataaaacataacaaacagtgggacccacatgtcaatcaaataaaacataacaaatagtgggacccacatgtcagtgggtcccacccccactcaatctccatggcgcgtcggcacctccttctcctctctccctcctggctatccttctttcctcctggagctcccttgtcagccacccagcgagcgcggagagggagaagggtggggaggggcggccagcccttctcgtcattgcttgtgacgtccacaatgggacctgcaatcgctgggaggggcgtctcgaggacccaaagccggccaagctgttagtcaatcgatgactggagcgaggatatgtaggagttgaggtcgccccaggtgaagggcgagcaggcagcagtgaggacgtcgaaggcctcttgtagtgccttctttgtggcgagggcggcgatagagacctcaatctccccagtcgtcatctccactggccggccgtgcaacgcatgtgtggaaagggggctcaggttttggatcactgtcagcggcgacaacaactaccccgcatcgcgatgaggtacatcacgacaccctatggccaccgcccctcgaccttctccctctttgcgtgcgctcgtgcatggagacagagaggagggtgggacccactggcatgtggatgctactctttttttttatcttttgtcttactgacatgtgaaccccaccttttattttaatttttaatttttatattttgcttctagtgtcatatcaccgtcacttgaacgccacgtcagccaaaaacaccatctaaaccatcgagagaacttgtttgcactgattttgacagttaagggacccgttgtatcggtttagggaagacaatcgaactcgctgtcaagttaagggacttaaaatggacatattccttcatctgtcgcatcgcatggcccatctctgattgaatattgggcctaatttgcgcgatcacacgctgtaaagtattgggccaaaagggctagggcccataagatatcccattcccaatatgcttcacacacgacgtcaaatccctcgtaaactagtttctcacacgcaaatccgtgagcaagcatcagtttggttttggagtttggcagtgtgcatgtcggcagaagctttccgcagttccgctatccacaagaaaagattggtttagagtttgaaccgaacgaaccacgcaattttttttcacgtgtttggagtgcgtatatgtttctgttttcagaaacaataaagatagaatcagataactctcatcgtcaaatgcggcatgtgcatttgtgtcgcgccgtccgtcgacggcgaggggtttggtgtcgacgcctgctagctgcacgtacgtctgcaccgtccacaccgctctagtactcctatttcatttcggcgcaataacgccgagccatgtgcatatatcatcgcagtttgtgccacagagacttcttttgtctttaccgctctgcgtgcatagcaccaggatcctctgtcattgaccaccacccacggtcaagccaaaaaattaaaaaaactccatctattctttaaaaaaagatatatttttactagttgaaatacatgttaaataaagagattaaaagccaactaaaacaaggagagagagagagagggagtactatcggttccatagcttaaaaacacgaacaaagggattcttagtctattttaaacacctttaaactataattttttaaaaaacaaatgattagtctaaaactattttttttccagaaacaaagggagtagaagctcacgtaaattttgtttttattgtggcgagctatacctgttgtcatgttttctgaagtggaacttgcacttgtttttcgtccgagtggcgacggctcaaattctttttctgcaccagaataattatacaacttccgcccacttgcaccatggtaataaggatttgcatggctaattagttgacttgactggctacaatgagctaccgactgtggcacagtacaacctctttcgaattcataatatggtcatctagaagactagaacgatagtgatacgttatttagctgcatgtgatacactagcgctgctccctccgttttaaaataaaaatgtttttcgtatttaaaatttatatcaaaatataaacacctctaacactgctcacagtaatgtttgtctcatacacctctaacacaaacaaaattcacatcttaaagacagaaaatatcaatgcatcaagtgaaaaaaaaaataatagaggtagtatatgtagacaacaagaaaagaaaacgcttggttttacatgccaaagttaaacatgtcaccatatcagacatgaaacgtttatttatctttgagcttcttggaagaattggtcacattaattttgagcccttttctagctaccgcttgtaagccaacgaagagccgagctcatataaaggcgtcatgtcattttcttcgagtatgccaatgcctcaatcgaatttgttgtattcttatgcatgtcgattatcctttttctcccttgtgaatgttacacaatggaaatgatgtacatttttcacgagaacgatagcatcagcttgtaaagtcgtcataagagggaaggaggttggaaaagtagcttagtcatagcaagttagaaaggtaagatagttaagacaatttatttagaatttgaaaggagtccccttaatttcaaagaaaaaataaatggaaaggagtttttttaaagaaaggtcaaggggggaggagggagtttctccacctgaatttcatttcagaatatagaaaggaacacaagatattgtcaaatcacagaacgaagaatagacgaggaaagagtttccttccaagagaaaacaacgaaaaagtattcggcttaactatctcttctttttacaaaattgattcaaatttctaccttttgatctgtttggagtagtgctcccccaagctcgttgtcttcgtcgttgcaggtgatggttagggtctcccaaagccctaatggtagcttcaaaagctctcccattttttaaaattgaagaataatactacatctttgctgtaggcaaaaatatatagctaggtgctcctcgcggaaaatatatatataggcgtatagctagatgctggctgccgacggctgggaataaaagatggtgcacattcatatcactctttagtatgctttaatttctttgcctcttttcccctgctgaaaaaaggaatatattttctgaataaaaagaaaaaaaacagtgtgctcttgtattcactaaaacggagtgcttttctattcagagttcagacatactttacgaataccttacaaaattcttttttttttaccgttcaacagtaacagaatatattgatttaatcgacgcatgtacaagtaaacaaagaaatgttgtaactaagtttaaagctttaagacaagatcatgcccaagtgctcattccaaagaaaagggaagaaataacaatagaaaataaaacccagtcccgtcaaggataacaagtggacactagctaatgaacaatgacatatactgaattacagaacgaataatatagggggtaattaattaaacccgtcattttgtcttggtacatgatagtacatctccatgatgggaccaataatggattgtttcttcccagcaagagcgattgattaaccaggtctcacctgttcacacacaaggaggacaaggcagcgccatggatggatcaatccaacactgcagctagctgcttctagctagcaaagtagttgtaatcagtgagcacccgcatgcgcgacgcgccgcgtttcctcgtggcgcgcgcctatgccggggcgcgcgccgagcgcggcgtggccggcgcgtcggacggcggctcgacgttcaggtcgaggccgggcgccgggcgccggggcggggtggcgttctcggcgacgcgctcgtggtcggcgggctgctgcggcggcggcggcgcctgcttgggcggcgcgtcggcgaagtcctcccaggagaagctggggcgccacgccggcgcgcgcggcgggggagggcgggcgccgagccgtcgggtggcgtcgcgcatgcggcggaggatggcgtagaactcctcgacctcggcgtcggagacctcgtcgacggtggtgggggcgtcgtcggcgatgtcggaggcggctgggcgcttgcgcttggcggtggtggtggcgtccatggtggtggtgttcgtcacagcatagacgtttggtggggggtgggtgcgtgtggccgtgtttgtagtatagtagaatagaaatgaggagtgtttcctaagaaaaggagagaaaattttgtggtggtttactactccatatttttaataaacaatgttgtgactttttatcacacgtttgactattcatcttaattaagaaatttgcgtaattataatttatttttgttgtgagttgatttatcacttaaaatatattttaagcttgatttatatcttatatatttgcataaaatttttaaataaggcacaccattgactatttaccttattattattagggcatgttatttactacaccttacagtacattttgatatcggaacatatgctaaataaataaaacaagattatttgatacgccatattatacggctttctttttttattacactataaaagaattgtttatgttatgtgaaatgcgcaaccttctttgagaaaaaacagaaaacaaaaacccaagcggttggttaattaaaaaaacagttcgataaattgttttacgttgatccacatttccggtccatccataattatatgggccattgtaatacaccaactcatcactaaagtgtggttatcttcaaaaatatggtaaaaacgacatttatggataaacaccagaagtgaatttctcgtgtatattaatatttttcgaaagacaggccccttgcaaagtcaacaattcatacgagatggcaatttcctttcgttcatccaaaatctaataggaagattttgttgatgttccaaatccccactcaaaatgaatcaatgtgtaaaaaagtgaggtttaagaaaacttttattggtttatcgtcacaacaattattctgccgacctcttatacccaaaacaattggaatttcacgcctcagtttaccacaagtgttaaactttggagtatttttctaattataacatttactttctcgtgtgaaaatccaatcgacaccattttagcggggctaattaactctatagaaaacagatcaattaagttaggtctacaaacatgcggaggacaagtcgaataacacttctcttcaatcaagttaattagcaagcatgatatgcatggtgggtgtgatatctatgctcatatcctttgtcatgtggtatcttaagcacgagcaggaccatactcgatcgtatctgatactcctatgcgtagaacgtattactccgtataattggataaccggagtgaatgtcaatccgtactgtacgatgaactttgatactccctatgtcccactaccttcatatacatgtataaaaactacttcgtatgtttcatattataagtcgtttgaatttttttcttagtcaaatttttttatgtttaaccaaatttatagaaaaagttagcaatatatatctacggtatagaattagtgtcattatcatgtttgttttgtattgaaagtgttactttattttgctataaactttatcaaatttaaataaatttgacagataaaaatgttaaacaacttacaataagaaatgagggagtaacttattttagaaccgaaggagttatttgtgtttacctccatggctccatgtactgctagctagatgaacatatctcagcgttagggaccattctgcagatttgatcagaaattgatgagccccaatcgaatcgaattgaatagggtgcagtacccccaaaatattgatcgatcattagctacccttctactctggccatcactctggaatagtagtatgtgaatgtatgatctggagtgcaaccagcaggacattaacctcattgtgctagagttactattacaagttaaaaaatgtttatttttcatgagaatgatatagcaatatactacaagtgagaatgtactgagaagggtgtaacagtaaagaaaaataataaaagatagctggtgtcactgagtttgtttattactactagtataatctatagaaggacttaagagatttggactatgaggtctttttctttttttggagaaagaggggactttgaactttgaagtcttggtcagtactagtattaatatactgtcacgtaaagtcagtatgtgctcaatacgtataaattaaaaacgagtactccagcacctaaacagtttcgtgtcgtcacaaagctgacgtataacagttcagttgctaggcgtcatcaggggagagaaaagctagaagaagaggtttgaaaagtcttagctatgccctgtccacaagcacaaagaaattgacaaatcgcatagcgagtggttagtactattctacaagctggtttggaactgaacatctttagaaaacgagactccatgatagtcttcttagcttaatcaatatggttgttcccttcatatttcttcttcgaatccactgatacgattgtactcaagcgtgcagcttttgtggacaactcgtgagagagagaaaaaacagtaaagctggtggtgcacttgggcttgctaaagtgcgaatctatgagctttggaaatcatatcatcaactggataaaaggtaactagtagataattaaattctagtgatagattcgcaactactagtagtaacttgcaagcatgaaattgtctattggtaaagcaatgaatttctagcactgtttgttacagtatgagatgcagagacgatggagtcactgtatatgaatgatgcagcttaagcaaattgctttcataattactgtaagatgcttcaagactggggtcccaatcctttattcttaggtcacacataccctcaaaccaaccaatgctgaaccaattaatttgtcgaccaccagcccactacgaatttccttttcaccgcgacaaaacagcgcaactgtaccatccacgtcgatattatgtgcctagattccaagacaaagaggcggtgaaactgatcttcacggagcgttttcctaatgcgacccggttgtgtctgtaagcaacaacatgagtggcaaggagcaatcgtgaatggtga

SEQ ID NO: 46802 - DNA, 20471 bp, Oryza sativa
ttaacaacccgagcgtttatttcccagggcattggtggagcagaatggtttggctttgccttctctccggcaaagaaaatatccgcaatagcgacgacctttctctgaagaatcaggaatggaggccatacgtactgacctcacctgcttacattcagagatgtgacgtcaagccaattgctttggtatgacatcactgacatttccttgttcccaggtccactgggtcgcagcaaatgctggctcgtgagagcaggtataatagcaggctataagctagctgcaaacatattttaaagagataaatgaggagagagaagggcagcgggctacagatttatagccagctgtagcacagaatccaagacacaatgtatgcatgacagatgggaccagatattaatagtgtagtatataactattgtatgaatgagctattagattagctatagatgaattggagctagtagttggctcctattgaacttgctcgaggtgaccttgactagggatgagagccatggccggccaggtcaaggtctccttaaataaaactgtatatctacagacaccaagcaagcgaccggacggatcggtcaattcgttaatttcgctgtatgcttctgtaatggtatattttggggctaataatgctccagcttagccaaaagtgtactgttctgcaacccaacacgacgtgctgctgttgtgctaaagctaaccgctttctaattggctattcactcctttgtaaaataaaggtactacctctatcccaaaaataaaggcaactattaatatatctaacgtttgaccgtcaatcttatttgaaaaatttaaaaaaaagtcgcacataacctactatttatattttatatctaatgataataaaaatattaattataaaaaagttttaaataaaacaaacaatcaaacgttggagataaatagtgcaaagctgtacttagtttgggacggaggaagtatttattaacttacccacttatctcaacaaatcacaatcattacttatctaatttcttttcttatttacaatttttctacaattatttttacttcatttactttttaatacatgtgtttaactaaaataattatatttcggaatatagcagcagttacaaaatcagcatgtacgcatcaatggagaaaagtttgccggcgtcaaccgtcaaacatttttctaagagaaaaacaaagagggaggacaacgccggcgtggagctctatcgcagtggccttcgtcgagagttcgtgacatgatgatgactgatgaaccgatgaatggatctgctgcatctcatcgcacttcttcgacttttacgatgttttcagctgcagtgaggccttaagtttagaacccgagcgaaacaaaagttataggatgaaactgtataatctcatactagtatatagtaacaattttgtgacttaatttttttttctgctatcgatcaactttcccgttggctgaaatcgatggagtgaagctatcgtacgtgctagtagccatcacaacgagtttttcctcgtctgcccaccatgattgtatcaacacataattgcacggatattaatttgtttcgtcgctatcgtgcacaacgatgaacggcatttgcggtgcacaattgccggagcaccacgtccataaacggggaaatcaagcaaggaaatgattcttttctagacgtaagggcaagagatgtctcttatggtgagacctaatccgatgaaaacgatcatgatgtaatttatcatctaaaagttaacaaagagaccattcaacctctatctttaaacgtgactacacagtagtagtagctgttttgtctaaaccagctatcactccatctaagagaagatactatccacttatatactttaaatgcaattttctcttaaactactcatccgatctataatccgattgcaccgttgtgttcgtaacaattaaatctttataacaagatcttacatgattatattttgatgaaaaattataaattacttttagatttcactaaattacttcttagacatataaaagtaaattcaataaagtctaaaagtaatttacatatattatagaagtaacttataataaaaagatagtaactttaatgaatgcctctttttattggacgtgaagtcatatttttatccctacaacgaatttacttatagtgtcatgacaaacttacttccgttttgttttaagttacttttataatatatgtacattacttttagactttattgaatttacttttatactccctccgtttttaatagatgatgtcgttgactttttctcacatgtttgaccattcgtcttatttaaaaaatttacataattataatttattttgttatgagttgttttatcactcatagtactttaagtgtgatttatatcttatacatttgcataaaatttttgaataagatgaatggtcaaacatgtgagaaaaagttaacgacgtcatctattgaaaaacagaggtagtatgtctaagaagtaatttagttaaatctaaaagtaacttatatatatatgataaaagtaagttagatatataataaaagtaatttatgaatataaatattttttcatcataatataatcatgtaagatcttgttacgaagatttaattgtaacgaatacaatggtgtaatcggattgtagatcagataagtactttgagagaaaattttgtttgaagaggaaaaatacatgcatgtctattaagaaaatgcatgcatatagtacgagtactccacgttttctcaaaatttaggtgtcgctggttaagacaaaaacgagaggcctctctgaatagattttacttctatctttacgtggcaagttgctagttttttttccggtgaggtgttttctttgcttttaatattctccctctcgaaaatgctagaaataccaaaaaaaaaagtaattagatctaggactgcatagactgagaaaattgattttattgatacaaaactatctaacaccatacatattatgtttatgtttttagtttgctctaatattgctatacaatgctactacaatactacatggagagtactatacttaacatgggtgctcgtatttacgactaattaatttatttcattgatagacgatgtaaatatttgtggtgactttgttaatctcaaaatacggcactcaatttttccagaagtgttcataggggtaggatgcgtgtgctacatttataggagtgtgaacacgttatgagtgtccgcgtttgtactgtgcttctaaaaatatattgcatacaatattgttatgcctttgaaatcggttgcaaagggtcgcttacatttttggctattttaggctttcaggtgttttttatatataaagatagtcatggaaatatttaactaccctttgttttgtattacatattaaaaaaaatattggttctgtgtttgatggtggtgatgtaatttactaaatgcttcatctaaaaaatccaatcctaactatatatctggacaagtagaatgtccagatttatagttaagattatacctttttttacggatactcctttaaaaaatctcaatggtgctaacttatgcggatacatgttgtcagtgtaatcacggttgtgcttgaaattcaaataagtgaatccgtcatctaccactttatattaaacagtgagccatttggatcagcatcaacaattcacatagaattccaacgaaaatatgaatttttctattaacatttgaaaaggtaataatgtgatttattttttaattatgttgcaaagaatgagcatttagctagtcaaaagaaaatcatctaaaggctgaagtgaaaactaccgaaaagagggggaaaaccatggcttccattagttgtcatgtcctctttccaccttggcctcgagtgacattttgacttcagaaaaaataactcattcattttctgattaattggaccagcttcgtactagaaccgaatgagtgcgttttttagctttaaggtacaattatggagaataaagggtagattttgtaggtccacatggatgtagattattacttcctctaacaaaaaataattgacctattcgttttaaaaaataataaatgacctttgtacattatatcgtctctcaaatagtttccataactttaccactatggctctgtttagttccgaagtttttttccaaacttccaattttccatcacatcaaacattttatacacatacaacttttctataacatcgtaccaatttcaattaaattttcaaatttcagcgtgaactaaacacagcctaacttcgaatgcaaaatatttgacacctgatatagtctataagtttataaaggtagtattttcaagataaatcttataatatgatccctatgcatcaaatgtagatatttatatacatcgacgttaaaattaaaattctgatttgaaacatatcaaatttgatatgttatcttttggctagagggacacttgaatttggtaaagcaattccagaccattttcgtagaagtgtgactgtttccaactgtttgtaattcactatgtataattttttaaaaaagtctatatatgcatcgtatggaacaactagatatttaaattgataaatatgaaaaatcctcaaccatgccgagacagttttccatagaaatgatatcgtttttggaccgttttcatccatagtgggagaatccaaccgtctgggcctgcgaggcgccagcccagatttcgtcgtcgcggcccgctacagatgggctgccccctgctctccttttacatgttgctaggccgaattggctgggccaattgccggggtacacacacaggtggtcgcctctgaaatctcgcatatatgcccccatagatggcacagtgaggagagagcggtacagtgggcagcagcacggccacgtgcagcgtgcgtccaaccccaagccgtctcgtgagcggtggtctcgcacgccacatgtgagctttggcctttgggatttgggaggcagcagtgcgtcgtgtccggcccggtcgtggcaggcagacgccgcaatggacaaagagaaaaactgtactacaactagtagccagtaggggccatccgcctaattatctggtccatacccgcacaggcaagcgatcgctcttgccacgccaccacttgtcccacacatccttccgcgtgatcaccaacttacaaacgtaataagcgcctcttccggaacgggatcttttcaacgtattctcaacgctagatcgctaccgtagcagcaacctcttgcgtacgtgtgcttgttcaaaccttgcaacccctttataacttggaattttgtccatggttcatgtgaagattaaaggggtgatgtgtgtttggtgaagatgggggggtccaaattaacttggccgtgcgtgccgggtgatgtgggcgcatgcgacgagccagcggtggttccagctttgtcaccttgtaccgcgtttctcggacacgcagcgcgcttggaggatccttgtccatttttgatccgtcaaatttaacatctctctatagcttagctgaatgccattgccagcgagagcaagtcaatcgtcgatgagtgaagcatcattcacgcatgggctgtcagttgcccatgcgcgccgattgcttgcttcactgtgtgcgtcgttccgcttaatttgctcgatcgattcacgcgagcacaatcgcatgtgcgtgcatgcgtgcggcattcaatcaaaatactcctcctatcattcatgatcctctcgctacaccacttacaggatctgcagctgatgatgatggttgatgagctgatgttgagtgaacaaaagggatggaggacacggccgggcacgcggctggccgccgtggtccgccaatccggcaagatattatggcagagatgataaggtgcgtgcccatgtcgcgtgcagtccagtgctctcagcctctcgctatccgttccagtcgcgattctcgtctccaatgccggttactacgtgtcttgccgccattcatttattttcttattccggttttgcaattacgtgcttatgttttctgttaatcattcttgcaaatgttgtgcaagtacagtaccagtactagtagtagtgagttgtgaaagctgacgtgttgctgtgcccaaggttgtactagggttgtagcacctcgaggacgaacatgcccacatagacatttgttgcgatctggggcctattctgtttttcggtgattctccaatctatcgttgagtagcgtgcctgacaccattcttttttatctttacagctaaagaaacacagctttcgatccatttgtttaatcaatcttgtgcttggcttaacttgagccaggtggatgcatgcagatcagcagatgtactccaccgttgcaacattggcactgctaaaagcatgatcagtggttcacaagtatagtagggatgcaagtgggccgaccagcgaatctacttacttcatccgtttcacaatgtaagtcattctagtattttccatatttatattgatgttaatgaatctagatagatatatgtctagattcattaacatcaatatgatttggaaaatgttagaatgacttatattgtgaaacggagggagtgtatgctaaataattcgtgggttttcatatcatagctcgacttgccacgtcatagagatgcaaatgaattaacccataaacttatttataggtcaaaattagtaggtaaccctcaagtcaacccgcgggttactcactaattttacctataagcgggttcacgggttggcccgcttgcatgtctagtgtctacgtaatcatcatgcaaataactcatatatagtagtatgttaatagtagtataacatactactataattaatgatttagcattataactgatgttgattttttattcttacaatttttcactcctaacatatataaaagaatcttttccatttataattaagtatatgcatcaaccgttcaacatttaacgacattccagaggaccaattgccccatcagtaacctatttttaaaatttcttcacattctagtgcaatccatcctcccactcaatgatggcacaaggcatcggcagtttgagccctagacctgacttcataatccccttttgaatcatgtgagaataccatacaatttgtgaaaaaaaaatgacgaatgcgacgggaaaaggtgaggagctccagtttatatgagtagggtggagaaacatcaagccatgagctcttgccagcaatcccaatggtgatggcgactgtggtaaggtcctctcggtcatcctggtatgccttccaattgttacatactcctctcttcttcgaaactatagttagatccaatttgttcggtcgttggcgcaattgtggaacacgtggcaaagcgacgaagctacacaacaagatgctcaggccatgtctctactcactacgtgtatgtgtcgaggctatcatgccttctataagacacgagaaacctttgcaagccattcgcttttttccctctctcctccacgtcaactcttcgccaacgtggctgagcgaggtcacacgttagcaggaagagttgtttattcccttatgtcattaacaatgtggtgcaaaaatagtacataggtaatactccatccgccccaaaatgtaaggatttttttagggttggacaagagttataagaaagtacgtagaattaaatgagagaatattatgcttggtagagaaggggaggtaggtaagaagattgaacagtggagggttgtaattgattgagaaaataatgttggtgaataaattgttatattttgggataaaccgtaagggctaaaatttgttatattttgggaccgatagagcgagtaatattttattcagccatctaataatattatgtaagagaaataataaaagatacccatataaagtaaacaatattatctatatctacttttcttttcttttttgcctaatactactttgtatatatatatatatatatattgcgaggattgttataataaaagttgatttatttaaatctaataccccgattggtgatgcgctagtatcacagtatcactcagctggaccccctgtcagtcatagcgacagagcactccgattggatatggggcctataaaacagagaaaaaaagcgccccatccaatgaacatgcatgccactcaatgcatgcagtgcagtagaggaggagtactgacactgctcagcgtccctctccctgcacatttactcgtatgcacagcacaacacacactcctctcctctcctatctccaggctcacagatgagctgtgagctgtgtgtgtgacacagtctactgctctctctgtacaaagggagagggtgagaggaaattaacagaggaaggagggagaagaaatgcgagaaatgctggcgtctctctcttcttcgtcccgtgcggccatctcctgcatcccgttgtgtctcctcttcctgaccttggcgagcagcaatggcgtgtttgccgcagcaccacccaaggttgggtccgggtacaagcttgtgtccctggtcgagcaccccgagggaggagctctcgttggatacctgcaggtgaagcagcgcacctccacctacggcccggacatccctctcctcaggctctatgtcaagtaagaacagagtaaaatcttttttatgcgactagtgatcacttgttgttcgattccacatgccttgatctttctgtgcacagtgttctatacatgttccattgatttggctccctcccaattgttatctaatagagtaagtgatagtacttacatttgaggagaatgttcgtggctgtaacaattgatagtttagttgcatcttttcttcaatagtaataaagaacgacttgcatttctgatcttgcatatcataatcaagctcgattgaactactgctcgaagaagtaagattggaccacaaaagttcgatgctttgctcaattttttttatatattatgttacaatgtactcatcgtgctcctgctgcttcacagcatgatttccatatgttctaaagattactgagtcatattcaacgctagcgctctaatggcgaaattgcaatgctgcgcaggcacgagaccaaggacaggatacgagtccagatcacggacgcagacaagccgaggtgggaggtcccctacaaccttctccagagggagccagccccgcccgtcaccggcgggaggatcaccggcgtgcccttcgccgccggcgagtacccgggtgaggagctcgtgttcacctacggccgcgacccgttctggttcgcggtgcaccggaagtccagccgcgaggcgctcttcaacaccagctgcggcgcgctggtgttcaaggaccagtacatcgaggcgtcgacgtcgctgcccagggacgcggcgctgtacggcctcggcgagaacacgcagccgggcggcatccggctgcgccccaacgacccgtacaccatctacaccacggacatctcggcgatcaacctcaacaccgacctctacggctcgcacccggtgtacgtggacctcaggagccgtggcggccatggcgtcgcgcacgccgtgctgctgctgaacagcaacggcatggacgtgttctacagggggacgtcgctgacgtacaaggtcatcggtggcctcctcgatttctacctcttctccgggccgacgccgttggccgtggtggatcagtacacgtccatgatcggacgaccagccccaatgccgtactgggcatttggtaactactgcccaacttcattttctttgttttttcatcatttttggatgagttctggtgtcctttaattacgttttgtctggtagttttattagttttgttttgtctgtatagtttgatccatccatcaatactggagtatatttattagtactatgattagctaattttatagtagtaccatccagattcaatgatgagatactccaaatctccaatatttggagacagcaggggtatgggatgttggtcacatggcacacgctaatttaggctttttggaatttggggacagcaggggggcagtttgattgtgggttcatttgtcttcagtcaattcttactatgcaatatggcatttttcacctgtagtagttgattgcaattagtaactggtttccaatagatgcaatattcccctgcagggtttagtagttccaatagatgctactccagaatgaagtcatgccagctgctaggaatagtttctggagttgcattgttactctgtagaatatgacactgacaatgtttttcataagttatactagtgccctactgatctacccagctcactcaaaatgatcagagacgagagaaacaatcagcaacacatcagttgtcttgcctaggcatttcctgcaataccatgtgttgtcattttgctttcaacaaagtagtactcccttgttatcacgacagtaaacactgtttagatgcacatattgccagatgcagatcataagtactaactttaactgtcagcacatcgataaaatatggctcccgctgcacaggatcagatcaagacagtaattaaccaacaaaaaaaaatgcagagtcggtgctctaaattgtactgcaaaacaaatatgcaaataccaaataattcgtttcagataacgatgcgactctctaatgttcttctcacatgcttgttctcagggttccaccaatgcagatggggatacaagaacttgtcagtggtcgagggcgtcgtggagggctaccggaacgcgcaaatccccctcgacgtgatctggaacgacgacgatcacatggacgccgcgaaggatttcacccttgatcccgtgaactacccgcgtcccaagctgctggaattccttgacaagatccatgcacagggcatgaagtacattgtcctcatcgaccccggcatcgccgtgaacaacacctatggcgtgtaccagcgcggcatgcagggcgacgtcttcatcaagctggacgggaagccatacctggcgcaggtgtggcccggccccgtctacttcccggacttcctcaaccccaatggcgtctcgtggtggatcgacgaggtgaggaggtttcatgaccttgtgcccgtggatggcctctggatcgacatgaacgaggcatccaacttctgcaccgggaaatgcgagatcccgacgacgcacctgtgccctctgcccaacacgacgacgccatgggtgtgctgcttggactgcaagaacctgacgaacaccaggtgggacgagccgccgtacaagatcaacgcctccggccagacggcgcggctcggcttcaacaccatcgccaccagcgcgacgcactacaatggcatcctggagtacaatgcgcacagcctgtatggattctcgcaggccatcgcgacgcaccaggcgctgcaggggctccagggcaagcggccgttcatcctgacgcgctctacgttcgtcgggtcgggcgcctacgccgcgcactggaccggcgacaacaagggcacctgggagaatctccgctactccatctccaccatgctcaacttcggcatcttcggcatgccgatggtcggcgccgacatctgcgggttctacccgcagccgacggaggagctctgcaaccggtggatcgagctcggcgcgttctacccgttctccagggaccatgccaacttcgcgtcgccgaggcaggagctgtatgtgtgggagtccgtggccaagtcggctcggaacgcgctcggcatgcggtacaggctgctcccttacctgtacacgctcaactaccaggcgcatctcaccggcgctccggtggcgcggccggtgttcttctcgttcccggacttcacgccgtgctacgggctgagcacgcagtacctgctcggcgcgagcgtcatggtgtcgccggtgctcgagcagggcgccacctcggtgagcgccatgttcccgccggggagctggtacaacctgttcgacacgaccaaggtggtggtgtccaggggcgagggcgccgtgaagctggacgcgccgctcaacgagatcaacgtgcacgtgttccagaacacgatcctcccgatgcagcgcggcgggacgatctccaaggaggcccgcgcgacgccgttcacgctggtggtcgcgttcccgttcggcgccaccgaggcggaggccgagggcgccgtgtacgtcgacgacgacgagcggccggagatggtgctcgcggaggggcaggcgacgtacgtccgcttctacgcgacggtgcgcggcaaggcggtgacggtgaggtcggaggtggagctaggcagctacagcttgcagaaggggctcctcatcgagaagctgtccgtgctcggactggagggaacaggcagggacctcgccgtccatgtcgatggcgcgaacgccaccgccattgcaacgtcgaggccgtactttgcaggtgccgaggcggagctgcacgggcaccgcgacgtggagggacacaagaagagcgtgatggtggaggtgggagggctggcattgccgctgggcaagagcttcaccatgacttggaacatgcagatcgaagcatagatcgaagctttcttatgctttcatctgcatttctccattctgtctctctgattattttaggttctagatcagcaaggttatgtcaacgtgttcaacgacacaccaccatctctgattctcttctgcatttgaatccttgtggaaataaaacatgattctaaacatatatccttctttctgactcttacatgtgcgcacaagggagacagtcgaaagaacatcggctagattgcggatttgcggtacgaatgccctcacgaatacttgagagagtggtactaacttgagagagagtagataatactagaaaatctgtcacataatgtataggcagtccctagtagaaatatattacatctcccgtctctttactctttccaaaggaggaagtcgaaggtaacaaagtttgaatttaattcggattatgcttggacagcttagactgtccatcacaaaaatgataagagtgaattttgcatatgaactctgatttgaacgttttagtattttttggaaagctgttttgtgacctacttcacggttttatgttcggaatttttctctgtggtttggtacgaaacaaaccgatggttgctgcaggcttggttcatcaggaaaattattcgggccatagttatttgaagcccttgataaggaatggtcatgtcataccgcagcatgtggcccataaggaaataagcccatcagaaacttttgacaaacccgtgaacaacatttgtggaccaaatacaaaggtgggatagtgcgtggctaccaccaccgtcacgtcacgagaggcatagtagttgtgtacaaccctgaaaaattacacggctagtggtaactagtttgtctaaatcagctaccactctatctataagagttcctatccatctatacttcaaataaaattttctcttaaactactcatccaatttacgatccgattacaccgttgtatcgtaacaattatatctttataacaatatctcacgtgattatattttgatgaaaaattataaattacttttataatatatctaaattacttttagatttcactaaattacttcttcgatatataaaagtaaattcaataaggtttaaaagtaatttacatatattatagaagtaacttataacaaaaggaaagtaactttaatgcatgccttttttcattggacgtgactacacaactagtggtagctggtttgtactccatctagtgtttcctttcaacttgaaaaatgcaatatagtatgtttccgttttgttttaagatacttttataatatatataaattacttttagactttattgaatttacttttatatgtctaagaagtaacttagtcgaatctaaaagtaacttatatatatatgataaaagtaacttatgttataataaaagtaattcaaaaatataaatattttttcatcgtaatataatcatgtaagatctttttgtgaagatttaattgtaacgaacacactggtgtaatcgaattttagatcggataagtaatttgagagaaaattttataagaaggaagaaaaacacatgcatgtctaagaggaaaaacaagcatgcatgtcagcacgtgtagcagtccttcttacaaattggttcgtcgctggttaacgctaaactgagaggcttctcggtttagattttgccatgaaaaatgcgcgtatttctccgctctacacatctcagtttcgtttatcaacgacttaaatttagaataaattaattttacatgcattccaataaaaaataacaaaaagacttgaatgtttatagtttatcaaatctcaatgcaactattcaccactttatctatttccaatacaattattctctactttcataaatttctatgcaatgattatttaaaaggaaacttattttagataaatgatagtatgagtggaaataaacttaatatggatcagataatagtattacttcctctgtaaaaaaactactaccttcgtcccaaaatataagcatttttagctatgaattgaaataactgtgtttctagatttatagctaaaaattattatattttggcacatagggagtactaatttgaatattaatctgattatgtataagagctggtaaagtggtaaagtacgtactcctcatcctcgtgctaatcgagtcgacgggcgaaggttatcaagtagggatgggcattcggtctaatcgaaaatttcggtctcggttttcggtctttttagtttttgaaaagtgaagaccgaatttcagcgcaaaaatatcaggaccgacaaattcagtctcaatctcggtctcggtccaaaccgaaatttaacaacattttcatatatgcaaagaaataatggaaattttcaacacaaaaatcacaaaaaaaaatcgtaagcacttatgagtaaaaactcttattaggttacatgcttagaagaagtaggagtgtgaaaattagagtttaatcctattaaacatagtggattataggttacatttagatatttttctataattaagtcttttttgtctattcagttaaccgagaagactaaccgaattgatgaccgaatcttttagtcttagtctattcggttccgtctttttctaaccacctgcaaattgtgtcctcgaaccgattctgagttgcgatgtcgacgtcaagtacgtactcctcgtcctcgtgctaatcgagtcggcaggcgaaggttatctcaagtctggaaggttatctcactgcaaattgctgtggccgctctgctccttgtccgtgctccgcgccggacgacacccgaaagcgacgcgcggctcccgtcacgtcaggtcacgtcccccccactcgtgagccgcgcggcgccaaatcacgccacgccgcgccgaggcccgatgaggagtcggccgccatgcagctgcagccgcgccgcgcgcgggcagagcacaagttgccgaacggcacaccacgcgacgccgaaccagccaaccaaccggaccccaaaacacagagcgggcgccgcgccgttgtcaggtcaggccagttgcattgcagccgcagcgcgcggtcgcggtccgcaaaactccgcaccgcacctttcgtgccgctcgaggcgctgacccgcgactgacgacgacacacgaccccattgccgcgcgacgaaacccaccgcaccgcctccgcagccgccgcaagcccggatccacttggatgcccggtttcaccatcgcgccgaggtttgttggggatgtccggttcaagcctttcgtatcacctttattttgcctccttatcggcgcttagtggtggtggatttccggattcgtttttgcgatcgttggcgcaggcggttgtagaaagtgatcgtgccgacacaccgagaatggtcgacggagttacttgcttttctggaatttatgtgctcaccaacaataatttcctcgatttggcttggctagtggcgtacgtgatgcgacgacgaccatgtttgccaatactcggcatccgtttggacgttagcccggttttccgggcactgcacatcaccaaaactgtactggcagagtccaagacggtgtacttgctctgatcaatagagttcgagccccggccaaagactaaccaactctcgcttgcggtgtgccgcgcggttcagcacacgagaggctctccgcgtccatccatgcacgatccgtagttgccgcgcgcgagatcgacaagccacgagccaacgcaaggacagctacttttgccgcgaaacccgtgcagctacagaagagccaagccccggtttggggcgaaaggcgttttcttcttgttttttttttttggtccttcccgcgatattttaaagcctgcgtgtggatgggtccctcccaatacgaggaagccgtagctggtctagagtccgggagccgaggcctagtagtacttcgccggcaacggcgggggccaccgtgcagtgaaagggtcgtcagagaaagcgtccgcgataaggcttccgcgcaagcacaccacgtccaatgctctgttcggccatgccagactgccaccgtctcgtggatcgaggtcgatgaccgatctctctctctctctctctcgcatgcccctgtcggggatgagccttcaaaggggtcagaatcaccgctgtaaaaaaaactgtgttatttttacagggtgcgcattgtcgttttcgtcgcttttttttttttttaccgtggtggtggacactggacagggagcagttgtggtaggggtaacatggcgaggacgaggacctgacattttccggcgactgatctgtcttctcgttccctggcagtccggatcgctggtcacatgcagtgcagaggcccgtgtccggtcaagccgcggccggtgcggggcagtgcagcgctctgcgtcgatcggtccgtgcaatcagaatccaaaaccgatctcgatggtgcacgtactactgctccacaagttgtactgttccatggctggcgcggcggcagggttgggctggcctcgtcgcgtctccatcggacgccagaagctgctgcgctagctgcccgccaaaagccggagagaagcgccaagccaaaacccaggtgatcgatggaaccaacgattgctgctgccttctgccctggctgccgactgcatcgcatcgcatccaccgcgcacacatcacgcaggacgttggatggatatcatattcgtactaccatcgtactagtagtactagtcctacatcaatccagccatccgtcacgtgacaacgggtcgccgccggtggtccagcccaagcgggcgacccggtgatccagccgaaactttggccgtccgtggctggcgctggctggaccgtccgcaaccggatcgcagtcgcagcacgtaccagccatggaccgcaacgcacggattggggtctccgtctcggtattcctttcgctcgcctgcctgccttgccgccctccgccaccacagcctgtgaccaccaccaccaccactgccatccctttccgtcggtacgtgctgtatgtacgtgcgacgccgacggttgccacaggcgtccctgtcgcccaccgtggctggactggaccatctccgtctccgtctcgctgtacgaacgtatccctgccgacactgccattcggtacggcgtgatccgtgcgtgcgcaatggtgcacgtaattatacagtgttacaaggatcaagggacacggcgtgagcgttgtaaaggggcgcaatctccgccggaatcatttttagtggcgcctaatgattggcaacagctggagtagctcgtgctcaggccggaaaccgaacaaatgaacattggagccgcttttaactgacagccagtctggtctttgtgttggtagccggaatagtggcccagcagtagtcaaagaaaaggattcagcgagggtggagcagagtactcactcctacataaaggcaaaagcgacgatcggctgcgatcgattggattggattgcgcatgcaactgcggttgcccataaaacaatgccagccaggtcgagcaagcgaccaacgcaacgcaggcatgcagcacaacatgcgagcaatggagtgcagtccagacacaccgattgctaatcagtaatcacacacatggtcacgtccctttcccatatgtcggcgcgccgcaacgtgttgctgcgtgacactccggcccggccgggactactcccaggcacaaaggcagtgtagcacggccagtagccgtgtcatgactcatgcgtactagacagtgtggtctacgagatcgttcacgggatgaacatgcctggccgttccatcgtgtcacggaaccgatcgacgacctcgatcgatcgcccggacggtttgtacgacagcagcaagcacgtcagtcaatttggcgaatccaaggcaaaatcgccgagtttggacggtggatggtagctttgcctttgtacgtgcgcgtgccccaacaggcacacacctctgctaccgccaaaggagtactatgccgtcacaggcagcgtgcaccggcatgtttggtagcgtgtgacataccggtactaaatgggctatttttttttcttttagaatatcaaacccgtccccgggaggagggggagggggttgtcatacctgaattttattaaattagagggaaaatccacacagcaaatcgttcaaattacatattactccctccatattttaatgtatgacgtcgttgactttttaaccaacgtttgactactcgtctttttcaaaaattttatgcaaatataaaaatacttatgtcatgcttaaaaaacatttgatgataaatcaagtcataataaaataaattataattacataattttttttgaataagacgaaagatcaaacattcgtcaaaaagtcaacggcgtcatacattaaaatacggaggggtacaaattatggaagagaggaggaaagtaactccttccaagagaataattggccgatcgtcggagatgctcgcccaaagtgtgccgtcttcaatatagtcacaaggcgaggtagcgacttacgtggtgtttggatctaggatttaaatttagtctatgtatttagacactaatttagaatattaaatatagactacttacaaaactaattatataaatgaaagctaatttgcgagacaaattttttaagtctaattaatccataattagagaatgtttactgtagcatcacatagactaatcatggattaattaggctcaatatattcgtcttgcgaattagttcaagattatagatgggttttattaatagtcacgtttaatatttataattagtgtccaaccatccgatatgatagaggcttaaaagttttagtcccatctaaacaggatcttattcagtacgtgcaaaacaacattgtggcgacgattccataaaccccagcaacaaattatactctaaaacatttggtagtgcatgcgcggcatcctcacctggcaagaggagagagaggagggggggggggggggcgcaaaatcgccagctcctccatgggcgacattgttatctactactcccttccgtatttaaatgtatgatgccgttgactttttaatcaatgtttgaccattcgtcttattcaaattttttttataaatataaaaatatttatatcatgcttaaagaacatttgatgataaatcaagtcacggtaaaataaatgataataacataatttttttaaataagacgaatggtcaaacgttgattaaaaagtcaacggtgtcatacattaaaatacggagggagtatataccaacagattaccgaaatgcatttgtgaaaggcatggatgcacatatgcatggcagtttcctccaccttttcacttagtttgtacaccgagacgagccactgaactcttgccaaatccatctcgccgaggatgattcagtagaggcaagggaagagtggaaaaagggggggggggggaatttaactatttaccacttttaggtttggcaattatccaaatgttccttttaggtttgcgcttaataatttgacattggagagagatgatttcttaactatttgccacttttacttatgtggcgtgccttcgtggtatgcccgcatgggaagcaacgtagatcccacctgacagcccctcccctctgcttttccctctccggcctccaacgaggtgactcacgcctgtggagtgggatgagctagggcgggtcgaggcggccgtatacgtgtggctggtacctgggcacat

SEQ ID NO: 46803 - DNA, 5310 bp, Oryza sativa
  unsure (1)..(5310): unsure at all n locations
tccaccgcccttgcgaagtcctcatccatcgccgccgccatccttcgtctggctggaggaggagaggagttggaggaggggaggacgaggtgtctccgtcaagcctcctcctcctcaagacccgcgccatcgacgcccgccgacctcgcgccggccgctggccctacgcccgttggcttcgcggccgccggttcacctcgtcgaaggctagagagggagaagaagaaaaggggagggctaacgggtggggtccacgttgctttccacgcggacatgccacgatggcaagccacgtgaacaaaagtggcaaatagtcaagaaatcacctctctgcagtggtaaaatattaagcgtgaatctaaaagaggcatttggataattaccaaacttaaaattggcaaataccgggaaaaagtggttgggggcaatacgaggagaaacttgaatgtgagttagattaggtagctaatactttagattacctacactgcgaaaataaattaaaatggttgcgtcccttatataatatggggacgaggtagtaaatccgtaatatatgagcttggctactactttcaacggcaagtaaccatagcggcacaccatcaatagcatattaggtaagatgataaccaaccaacaaccatatgttacgatttaatccctccatccataaaagttttgtcaccaaaactaaagaaaaattaaatcattttggatattataaaatcaaaagtgaatttaaatatgcagccaataagtatttagattactccttgagttctaattaaatatttaatttatctaattaaaatcaaaaagtgaatgcaaatatgcaattaataagtatttagatgactcctctcattggagctcattgtgactccctttgttttatattataaaattattttaacatttttttaatcgaactttttaaagtttgatcatgtacgtagaacaacatttccaagacagaatacatatattatcaaaatatatttaatattatatttaattaaactaatagtattttgttgctgatgttgctaattatttttatagatttagtttatctaggaaaaaaatgatcaaaacgactagtttaaaaagagcaatatctattccacattccaaaatatatttaatattatatttaattaaactaatagtattttgttgctgatgttgctgattatttttatagatttagtttatctaggaaaaaaataatcaaaacgactagtttaaaaagagcaatatctattccacattccaatggccccaaactcttaaaatatcggccatcctctttattaaaagagactactcgattgttggaattgaataagcctcccattcccatcgtatgggatggacgaaaattgaactgataaataaatctttcaataccgacaaataacaaagttgtcacgagcccgatccatttcataactgtcaaccgcaaaatgctgggaatactgcattccacctttctacagcctggacagagaattccgaatgttgatagcaagccccactttgaatgatcactgatcagggatgacatgctgatcaaggaaggtataccacgtcaagtgtgatcgaaagcaagcaggcaaagaatgcaaagaaggggcatttggaattgcagcaatttgcaatctgggaattgagatgccaccacatcatcagctactccagctagctaacctcgtcaacacattgttggctacgcactcgacattgattcctgtaccacgcaacaattactaccaagtaatctaggggaaaaaaccaaagatgaatccgatcgatcacttggcggcgtaattgggtatctcgtagatttggtggatcctccaaatgtcgtcgtcgaaggccatctcggcgtcgccgcgggcgccgaggcagcggaagtcctcctccacgaaggggaaccaccccagcagcttctcctcctccaccccgaacgtccaccacgacaacccgttgctgagcccgccgtcgaggtcccactcgacggtggtcgccgccccggcctcgtatcccgcgccgccgccgccgccgccacacacgtcgggcacggtgggcgccatgtccgctccggaggagcaggaggaggacgccgcggatgtcactgccgcccccgcccccacagacgacgacgacgactcgcgcgccgccgccgccgccgccgccttcttggctgccgccgacgccgccttgggctgcctcggctgcttcgccctccgctgcggcttcgggttggcgttcccggccgcgccgccgccgtcctgcccctcctggagcttcggctgctgcgctctcgtccgcttcatgcctcctcttcagcgcgcggcgcggcgcggcgaggcgaggtgaggagaagaggggagtgacggggtgtgagcagtgagagtgggagtgttttggcagcgaggcggccgcctcttcgcgcttttgtagtgtactccagcatcgagtggctcggctggtttggcgcgccgccgtcgccgcgcgcgcgcgcagccggtatgtgcggaccaggtcgcgtcgcctcctctgtcctggcgtgcggtgtatcgggccaggtccgagtcgtgacgggagcccgtgcggcgaggcaacttgcaaccggtaaacgcaccaatcacacaacgttgtaggtaaccgctttttttttcccttcagatagtgaaaattaacgagttaattaattgatgaagcgcacgaggttgtactgtagacagggaaacgagcagcagtagtaatcctcctgatattttgttgggtgcagtcgtgctgtgcagcgtaccgggccagggtgtgtggctttggcagttttttttttccacgatatgtgcgcgtagcaacggccagtgatggagggacggctcacgtggaaacccccggaaacttggggaggttgggcgtcgacgagggcgtgcgcctgtctgtctgcgtacgcaaaatcgcatgccgacatcgtgaaccactcctttgtacaactattagcttccaaagctctccaatctctacttttcatggtattactagtgttttttagtctcgtgtttttttactactactacagacggagtatgcgtatacttgacgtgcatcgatcgtgtggttgacagatattttacgtgtatactagtggtgatagcggcattgtatatttgtatcgtggcacaagggacgggaggagaaagtgtgtgttagccgtatctcagtcgagaaagcgatggattaagggtcatttaagggccgacaggggcgtggccatatgtcggcaaagaggcgtgagtaatggctcgcagatccacgggacccaacaccttgccaacttgacgccgctcgagtcgtaataatacgagtatttttatgcaggaacatgcataatactcctacaatgcgttgcacggacgggacggcacgccactctgccagaacaaccagatttgacgagaggaggctcgtgccttgcctcgtggtcggccgggtcctgcgccgagaggaggaggcgctgcacgtctgcacctgcccgtgttcgctcgtctcaccgcccacgtttggccgtctgacgtgacgggatatactcctacagtcctactccacaacgtgatggaacaagatactagtactcgggctaatactggagtactagtagtgtatagtacagtactatttgatactgtacgtacgtacgagtatctcaaagtaccctcacaagtctcaaatctcacttatggagccacctaggagtagttagcagcctggcaggcaatactagtatctgactgggccgtgtctggtttgggacgagacgaccacgcagatgctgatctgcagcaattttgacaaacgggccggatttatatggccggcacataggccttaatctgaatgggccggcccaccattactcattgggttttgtttgaccttaccgggctgtgccctcaactgcaattctgcaaagaagacgacaatccaaagacgcatgaaggcggcatcagaacgccgatacaggtggcttccaaaaaaaaaaaagaaaaaaaaaagaacgccgatnnnnnnnnnnnnnnnnnnnnnnnnnnnnnnncagtaagacgttaagtctcacagcgagtgtaaccttcgtggtactggttgctataagtttagaatcataaacatgcaaattgctgaacaacgagatctcaaaatcttggatagatttgagttggtggccgaagagtttaggtttggacagtctcggctataactttcttattagtctagcggcaaccggtcacgctcagtagagatcgattcggtgttaatcttctccttgattatacgcggcgttatcggtgcatagtgttaatcttcttttctagctattgtcttacatgacaatagttttataattttttctactctatttaatgaatcatcgctatgtttgattatgaccgttaaaaaaggagatgccaatgacactactgtgacagcatcccagctacagcactccggtggatcttaagatatactccctccttccaaaaacctaagaactatttcattctttggtttctccaaaaatctaagtcctatttatagtcactatgtgctaaattaaatgttgatcgaaaaccaagaagccactctagtgcttattggttgtatgttcattggttttgccacatggtgagtgagttaattacttcttggtattgatgcagaaagaaataggtcttggatttttggaaggtgggagtagtagtatactccctccgtacctataaaggaagtcgttttggacagcgacacggtctccaaaacacaactttgacttcttgtttttataaaaatatttattgaaaagtgatgtatgtatacttttatgaaaatattttttaagacaaatctattcatataatttttacattttcaaacttaacaacttgagagttattcatgatttatattccccatgtttgacttaagcattgtcctaaatgatttcctttacgagtatatagggagtatatgttagtggtcacgcttagcttttcttcctgtcgccaaaagctaacacggtcaaatcgattcacacactgtagcagatagtatagtaaaaatgcatgctacatgattcatgtaaaacacacagaaacgcaaaagggaaaaaaggaagttcggatcagcactgctactgcatgctgggggatggccaccacgggctgcacgtttcgaccggccggcgtcttgcgtccctttcgcttcatgtgatttggtgcccgaaaacattcgacttgt

SEQ ID NO: 46804 - DNA, 938 bp, Oryza sativa
ttggtaacaccaacatggactaaagaccagtagtaaagcctccagggttagttcaaaagtaaaacatctcttcaagctagatgtgtgtagtaggtgagttggttacgcgtgtgagggctgaggtgagagatcttgagttcgaatcccatatcccacatatttattttcacttgctatgtatcggtactaaagattttgaacttgagtcccgatttgctcgtctcggttgctacaattggtagtaaaggagttgtaaaccgggactaaaaatcgtttcccctatagtgattgaaagctttggcagagggagtttttaaacccgcaagcactatatatagagtaggtatccgacacacacatatatgtatactcataaaagaaaatattatacacggtacacctagctaggtgtatatactcatccttttcatatactccctccgtcccaaaatataatgagttttggttggatggggtatatcctagtactacgaatctagacaaactatctatccagattcatagtactaggatttgtctcatctaattaaaactacttatattttgggatagaggatgacggagcgtggggctcctcaccgggagaccgcgcaggcccccctttgccggttcggccgggggcgctgagtgaggttcttcgccctcgatctgaggaaagtcagcgggagaggaagtgcacaagacacgggcgacgtagacaggttcgggccgctgagaagcgtaacaccctactcctgtgttctggtggatctgtgcttgaaggaatacagagaaccggagagcgagagtgagttcaggctctcgcccctcttccccagagtcccaaccccctttctcctaggcttgggcctcctttttatctggtcaggggtcaccacatgggcctctagttgcctaagaagggaaacatgcttttt

SEQ ID NO: 46805 - DNA, 707 bp, Oryza sativa
cccatcgttgagtgcacctcttatcacactcaaagaaataaatccaatcaacaaatctatggttttactatcctattaaaaagagcaattttaccatccaatatttggtatttcgaggtaccacattttacacataaaagtttggtatcttgagataccaaactttacactagaggtaccaaaatttacactagaaaatatgccgatgtaccaaatatttgtggtacactatgatttgtggcacctcttatgcactcaagcatacataatatttgtgcacactatgattcaaatctggtgggtctgtgggtggaattatgggatgcttccccgttcaaaggaatatttttgttatgaaaggtttaatcattaattgattacatgaaaaagattctctatgttatatagtactaggagtatatgtaatatgttcttctgacatgatgatgtgctaatcagtaaagtgtaataaaagaagttgatctttttaaacttgatggttattaaggtagacagattttccttgctgacagataatatagacaatatatatctattatcacaagataatattaacattgttctcatgtccctctcaagtccaggggaaacacaagtctcccaagtaacatgcaaacaccttctagcttcattatttttatttggtccttcactcagacaacggcttattgttcgagtatacagta

SEQ ID NO: 46806 - DNA, 5233 bp, Oryza sativa
  unsure (1)..(5233): unsure at all n locations
ctggacagccaggatcaccaagagagtgctgctcttcatggtgatgttcttgcgttccaaagccttgagctatttcctctacttggtactagtagatggctttacgctttgtgtttgtggttatggccaaagcccaggagagcatctgtatatataggcgttcagatctgaacaacatattagcatgttgccaaatgccattctttcatgcttgatatcgaatatattttttggggatgcatgttaggcgtgcctttgactgacgcggctgctagagtgtgaggcgttgaacacattttgtattcttccatgtcacactcacgctcctatcgtcctcgtcagcggtccaaaatggacgaaattgacaccaccagcaccaacaaaaatcgttcagttgtacagtggtaagctttgcaaatctttaagggaattaataatgatttccccatctcatcacacaaacgaattacctgttttatattattatgtataaatagaactcatgggggttcaaaacactattttatcaactagtagtcctattttttttccttggactcgtctaggatgtaccctctccgtttttttaatagataacgccattgacttcttatcagactattcatcttattcaaaaattttatataaatacataagatttgaatcacgaataaaatactttaagtgataaaacaactcacaataaaatagattataattacgtaaattttttaaataagatgaatgattaaacgtgtgataaaatgtcaattgcgttatctattaaaaaacgaaggtaatatatagaaaagcagtatgctgcggcttaactagaaatggtaatactgattactagagtccctgcgtgtcagcatcccctgcttatcaggactaactgtactgtgtatcgaaatggacccagttttattacaggtatatcatgatcttctcatcacacttggatgacaaaatgattgtacgtgcaaacttggataaccgagcaagctgagctgtccgttgggagattaatcacgagctcattctcgaaaagcaattttttttcaaacgcgtaaaaaaattgtacgttaatatattagagaaaaatagtttttgttacacggtacaatcagttaaactggcgatagaggaaggaagaaaaagaaaaaaactgtagctatagaaaagaaaagctaccgcggcgactaaacacaactctgatcaacgggagagaaggtactctgtgcccttaaaaaacccaaaaacaataatgctagctgaagaccgcacatgatcctctgagataatagactccaaaaccaataatcggtattaggcaacacgacacctttcttgcatatcatgacattccgcccaagtctataagaaacgcagattaatttggctaatccgccatgcgcatgatcaattgatcagctctagcatctcaaagccaaacaagaggcgaggataagatcacaggtcgctatcgagcgttactctcactggcccagcgttaaaccaaaccctcttttgatgtttctggctccacgtaaatacgtcctggctgccaaacctcactaccaacctgtcattagcgaaatcagagcatctgatggtctgtttggtacaatttcaactcctaaatttagctctaggagttaggtctgaagtggagttgtggagctggcagcttcacaactctagtttattttgtgagagagctcttcccaacttcgcttccagttttagtggagctgaaactgtttggctgaactccagctccagaaggggtggaggtggaggtggagctgtgtcaaacaggaggttgtcagtatggcatcgtgtggattggatgttgaaggcggcaggcggctaattaagaagcattgaccattctgatgttgcgtggttcaacacaattctgcttctcaattagtaccatctggaaaacctgataaatgggcctccatggctttttaaggaataagtttacattgcgtccctcaactcatgtacctggttaaatcgtatccctcaaccgctctcgccgtcccaccgcttccaacgtcttgctgctctcaccgctctgccaagctcccgccgtctgccccgccgctctctccatctcgctcgccgtcgagtgaggagacgagtaactgacacgtgtgcccaaaatttctttttatttttatttaggtttgttttttactgccacgtaagcgccacgtcgatgtcacatgggatgaagaccagataaacccgccacgtaagtgccacgtgggaaaaaccgcctccgaaaccatcgagggagtcgatttgcaacggtttttgaagttaagggacaagttatatccggttttgcggttgaggggtgtgattcacccagacgcatgagtggagggaggtgaagtagacttattcctttccgctttttaatctctgtatctatctgggcctaattcttcaaatcttcatgatgatgggccaaaaatctatataggcccttcttttcggggccttttctccgtttcttttggacatccataattatcctgacgtacaaaatggtcctgtgttgactgacgattgggctagcaagagtcagtcacagtagcgtgtaacccgttacagaggtaactgttcaggactggtcatcggctcttttaaggtgatggtgccacctacagcaatgtatggtggttgatttattggtactcaaatctagtttctcttggacattgattccgcgaaccaaattcagtccacgttcgcacaatcgcactatagttaattactccctccattctaaaatataaccactctaacctaaacgctaagaaatactccctccatctatttttgatagacatatttccaaatctgaaaaaattatttttgataggcatagtttaatccaacaacatatcatcttaatgaccttctcggatttaatgcatgactcttcattcttacacacaagattggctacatagacattgagaaatgtaaatattaatgaatcgcttgtttacgaggaatgactagtagcatatttaaatggatgataaatataattacttatctttggtctgtgtgccaagatgaaatatgactatcaaaagtagatggagggagtaattattatcaccttatagtttgaattatcttaataaatactccatccgtcccacaatataagggattttgaatttctgtttgcaacgtttgaccactcgtcttatttaatttttttttgcaaatataaaaaatgaaaagttgtgcttaaagtactgtagataataaagtaaatcacaaataaaataaataataatttaaaaaaatttaaataagacgagtggtcaaacgtngcaaacagaaactcaaaatcccttatattatgggacagagggagtagaatacatgcaccctacaattatagatcttgatggtcaaggatttgaataataatattttagtgaaaaatatgtgctaggtaatgacatgcatgcatgtccgtcttatattattaaataactttaaaaaatagttactccctccggtttcattttaattgacgttttgaacaatgacacggtctacaaaatatacctttgaccttattttttattataatatacacaataaataaatgcatgtttacttttattatagtgttttgaaagacaaatatatatatgttgttatagtttctttaaactaaatatttttgaagttattgatggtcaaagttattaaagtttgacctcaaatttgtccaaaacgtcaattattatagaaccggaggagtatacgttattaaataactttaaaaaatattatggaatggaggaagcaacattgattacgagatgctttctaatggaaaattatgtaagagctgagttacaatcgtgaaacccatctaacacgttacacctagtcttccgtcacaagagctatccttggtttttctgatccactgcatgcgctagttttgcagctgctctcctttatatattcgtgtcatttagataccataccacatcctgctactcataatccatcttgttaagtgcttgtgttcagatcaatggctttcatagtttgggcactactactcttccttttacatcttcccacaatagcgaccggatccagtgcccactttggcggtaacaacactgttaggtgccatccaaaccaggctgcagcgctcctccagctaaagcaatctttcttctgggttaattctccggtcatccttccgacatggcaagatggaaccgattgttgtacctgggagggagttggctgcgatgcttcttctcatcttgtcacggtacttgatctcagtgggcggggcatgtacagtgatagttttgaacctgcactcttcagtctcacatccctacaacgcctagaccttagcatgaattccttgggtaccagcagtaccaccaaagatgctgaattcgataggctcacttcgctcacccacctcaacctctccaattcgggcttggatggtcagatacctatgggcatcaacaaactcattaaccttgtgtccttggacctttccaagcgctatgttaacgataacagtgatatctcttttaatgagagtgatgatgagattatctttacaggtgacagttataatcatctgcaggaatccaggttaatgtccctagtagaaaacctaagcaatttgaaagagctctacctcgaccatgtggatatgtctacaaatgtagatgactggtgcaaaacccttgctcaatcagttcctcgtcttcaggtacttagtttagatggttgctctctcaacactcctattcatcactcccttttgaggctccattctctcacagtgataaatcttcagtccaaccctggtatagctgtcaatctatttccagattgcttcatgggtttcgccaatttaactgtgctccgactttctcataataatctcgaagggtggtttcctgacaaattcttccaactgaaaaatctaagaatcctcgatttgtcctttaatatgaatctgttagggcatttgccaaaagttccaacctctttggagacattgagactagaggggaccaacttttcctatgctaaacgaatttcttctagcaatttcaatatgctgaaggagttgggtcttgaagggaaattaatttctaaggattttctcacgtcgtttggtttgatctggtctttatgc

SEQ ID NO: 46807 - DNA, 6418 bp, Oryza sativa
aaatgtttggagagatgtttcttccttcaagtcttcttttttcttatccagctggaaacggagtagtacagtagtttttcatttatcatatgtgtgcatgccaaataatcttgcagtgcacaccgctttcgacgccgtccgagaaatgtccggttaaatccgcacaaatatacagtgtctgcatcaaatgtaaagtagcagctatagttggtgatgcagtaccattggcgatcgagatacttaattaattaactagttggcaaattgtctaaacaaatgctttatgcgcttcatttgtcagtcttgttctcctgcttggaggtgatcaaaccctagctaacttttccatttttattgtgcaatttggcctcccattccgcatacttttgccatatacactgaacctctccctgtgggggcgccgcatgcaccaagaaaatttaaagttgtccatctctctctctctctcaatttgtttctctctcttagcaagctactagacacacaccaatgctagaaaaaggcttgtctttctttctcagctgcttgtgcatctactgttaactgtacacacacattaacgtggacaaagaacaactagataaggtcatgtgcatcagagagagagagagagagagagagagagagctagctagggacagtcagatcgaaatcttttcaagttccaacttctatgtgaacccctttaccttggaggaaaattttctagtactggatttaattaatttctttgcctttttttttttggttctgagaaatatatccaatcaagctcaagtatttagtcaaaatcccatagagttatattttggtaatttatcagaaaatttgatatgtttgctatgtggaaacaaatattcatctacatatgaaaatttaagtgtgtgcatctgcatcatatatatatgaactcggaattatttctgttaacaaagaaattcgtctatatagttcctgtatcataaatagcatgcatgcacatatgcatgacgtacacgaatccctttcaggtgctatatatcggtatcatagtcacgcaagcatacatcaaactctctatacatggaaaatattgatctcaaactaaaaaggataagagatgaaaagagaaaaatgaatatgacagtgtatagaaaaaaaagaacaggtggatgattattacatcgatgtctccaatattggaagacatcaaatacacactagctagctcctatgaattaacacctaattaattgacacttatgaccgtcaaaatactcctcctgatccatatatatatatttctctatcagtatatgtccattggaaatttgatcacaaatatttaggtatatattgatcggtcattgagctgctactttagttgagatcgccaagccgagctccaccggcttctccttccgatgatcgtgttgctgctggctgccgccgtcgctgtccgccggctcggtcttttgcaccggcggcggcggcggcggtagacctaatgtgaggtctaggccggcgtcgtgcacctcggtcgccgccgacgtcgctctcggctccggctccgactggctgacgtgggagccgtccacggtgtcggccgtgtcgttgctgtggccctcgctctccggcggcgcggcgtcgtggctcgccgactcgtggctgagcgccccgggcgcccagttgagcggctgcgcctgccttatcacatcgacggccatggcggcggcgggcttggagaagacgagctcgaaggcggcatggtcggacctgtgggcggcggcggcgccgccgccgggcctcttgaacttggcgcgcgagctgatgtcaagccggtggaggtcggcaaccgggccggccgcggcgccatggacgtcgcctctcctggcgccgacgtggcggatgtcgcaggtggggagcgggggcacggcggtggcggacggcggcggctgcgcgatgggcatgccgcggaggacggactcgacggcggactggcaaagctgccagttccccgaccagaggaggccgacggatccgtacaccgggttcagcatccgcccgcaagcctcgtacagcagcgaccggaatatggctgcacacgtacgcaacccaagagtcagagaacgaactcaaacgccatggccatgtagctagctagcaacaagggctaagcacacgtaccaggacggacgtgctcggggccggcggtgatgaggttgatgaggccggcgcggccgtagaacttggcgaggaagacggtggcgttggcctgcgcatcggggctgcgaatccactgcaggcaggggcggatggcgcagttgtcgctgcaccccttgcgcagcacgcggcacccgttgcagctcatccgcatgatcctcgcaaactaacccgcgcggctcgccggagacgacgaccggtgagatcgagctagcaatgccgagctagaggtagaagaaggaggaggaaatggtggtgggtgtgtgggcggagaggttgggtgtatataaagcattgggaggtggagccgtgggttagctcggcagcggactggaaagcctccggtttccctgggagtggaaagctggttttctcccctacatgtgatgttaccctaatgcccctcacttttccatctcatgatctctctaagcttcttctaaaacttataactaaactttaattacttagataattatatatacatactaggtatgtgatggtgatcgatctggctgaccaagtggtcctaggttgaattaacttggttataattaatatatatatatgggagttgaatatatattgtgtacttgcctcaaaaagaaagggatctgacagaaggttctgactaattagaaacccggtattaggaggaaaaaaaagaagtcatatgtttactccattcaagctatagtagtagtactgctatagctgttgcaatatgctgacctagctcggaatgtatatatgacatgaaaaccacctcagtgtagcaaacagaaaactaaatagataagtgtaacgactctagaacgaagcttaatttacttgattagctgtggtcttgtcaaatcatcaccttacttctcaacatttagttggttttgacggtttctccgcgagggataacatgcgcgtttgctttttcttcttctaatataatatcccctatgttataattattcagttttataagaacaaatcaactaagtgtgttcttgaaaattccaacagtagtaatatagtagctacgactctcactagccttgagcaataattagggcttgatttctaggtttgtctctttaatatcttttacgatcctatctaaaaattttggaaatacacagtaattaagatgccctataagccctatatgcttggctcattatcttggcttaattcaccccctggtttgctccctgaaattaagagtgaacatacctcaattagtgtatagtgacatgtttctcttagataactccgcgaagatgaatgattcttcctcccgctcaacctttaccatagctctagttgacattgtttatggtcgagacaagtacggtatcagatctccaagttcataccatcctttaattattggacttaattgtgttgtgcttgatctatcttgttttcctttcctcaagactcaagagagataatttccttaggatcttgttagtctcttggatcacacttatttgaccattgcatttttctgattatttgttattggataaattccttattgattttgggcattaacatggactcatatatatacacctgtattaatttggccattaaccacttccctagttgtatgtttgtagctagaaaaatactaaatatttcccgcaaaaaagaaaaaaaactaaatatgatgataccaacatatatatttttaatgataaacctaaaaatcatttcttctatgacaaaagaaaaattttctgtctgtgctttgctgcagataaaatgtatttttcgtgaaatgttctacctgtcgttttgctatggaaaccatttatcttaatttgattctaggaatcactatccatttagattgattgtttttaatatagagttcaggaggtgatttaaaaatttacaataggagtagttggggtggtagattcactactaccaccactagagccttttaaaatagtatatatagatgagcggaagaagttcaaatattgatgttggataataaatatatagtcgcaatgctaattaagtaaaataatacgtatgagagcagagaaaatgtcaaaacatatatatatatatatatatatatatatatatatatatatatatatatatatatatatagagagagagagagagagagagagagagagagagatatagatagacacacacacacacacttcctgaaagttttacaagatcgatttcatgcatatatcctaatacatagtagaaacaaacaaaagtgcaccatacacgcacacacactggcaggcgcatcacattaatataatacacatgctcagagagacggtatgcaaaagaaattcactaaagtcactaaatgtaggaaatgttttcacccctcgagaggatgtcttatcgtttcttgcatgcatgccacctaaagagttatatttcttttaaaaaaacacaagatagattaatatgaaatatatcactacacaaacatgcaagctcaaattcgacttccaagttgttacaaaaataactgcaaagtgtacgttaactagttgcagtttaatttgttctttttacaacttgtgaaagtcgaatttaacctatgcatgtttgtagagtgatatatatcgtattaacctatattgtcaaaaaaaatatgttttttactatttaggtgacatgtaggaaaaaagctagcggatgtcgaaggatgaaaatccatatcactaaatttctactgaaaccacaacaacaattgtgtaatatctgttggtacttggcaccttgaatggagtcatatgaagaacttcagtcaatcggttttgtacaatgcgatgaatacatccaagcaaacaggaattgtggagaaaaggggattatgactgaaaaaaattcagacagttcgatggtgatgaaacctaactgtcatcagcatgcatgcatgcatggaagggcacaagctatatatcatcataaaatagttccagatggaaccacatggtatcatgcatgcatatgcattactagctagttacagcattaagcagcaggcaagaaggcaagggcaattaggtcaagcaatccgaggatagcatactaattataaatccggtgcgtgtgggggacacatgacagcgcgtggcggtggttgtcagcgtcgtcatcgccatccatcggcgggcgaatcgcaacgctcgtttccgggaggaagtgcacgcggcgagaggagggcggcccccagcgacctgggcgtggggcccccacggtatagtcgtacgagctatagctaggcttaagtgggccccacgcactggctggtgattggtggaggtggtcgtcgtacgtcgtcgtcttcctcctcgcgcacagccaccaacatctgtgggcgctcgagagagccgattcgatttccatgggcggttttgctaacccttttcttttccttttttttcgatccaacttggtaggaggcagcgagagtctctgccgtgcaaatcatatcatatgcttctgtgggggatagcagctgctaaccattcatgcatctgccctcctccgatcccaaatgctatagctgcgtgaatcatgatccagttttacgtgcgtttcagtttggcacgcttattttatgttgggaatcaagctagtacctagctttgatactccctccgtttcaaaatgtttgacaccgttgaatttttagcaaatatttgaccgtttgtcttattcaaaataattcgtgaaatatgtaaaactatatgtgtacataaaagtatatttaacaattaacgaatcaaatgatatgaaaagaataaataattacttaaatttttttaaataagacgaatagtcaaacacgtactaaaaagtcaacggtgtcaaaaattttgaaacggagggagtatatagatagatcataggcctacgacagtttaggttgagagctcacatcaccggcaagttgaacctccctaattagtaccgttttatatgtgtgtgtcctctctctgtgtttaattaattaactttgtgtagtactaagagaaattaagggggtccccgtacgccatgcatctccattggggaagctatatagttacaacttaaaatggagaatcctaggagcggtcgtacgttaatttctcttgtttaattgttgcccttcattaattaattaacaaaaccaaatgtttttcttatgctaata

SEQ ID NO: 46808 - DNA, 1119 bp, Oryza sativa
aacaaagactacatgttcacagtgtaatttgtacgttgttttcacttacctcatcaagcttcaatttcgcgccgtcgtttatctaaaaaacgatatgaccatatgcggctgattaattgaagtttttaccgttctttacttaaaaaacaatattcaagacattaattactgatcaagattaaacaataggcttgaacaagcctatatatagaataaatccaaataattaatatattaattatagatgaaaaatcgtttgcccttccgcttatcagccacaaccaaaatttattttttttctaaacttatagagttgattttgatttttatcatattttatttttagtattagcttttaagttactaagaacacacatatacagaagttttatgcattaattaatttttttttgcgaatcgaatgtagcttaactgattagattcttttggtgaaaccagcccacccaaattcaaatcctagattatttgacatgggttctcacatttacgtctaattattattttttaatggtacttgcgtttgtaatgttaaaaaaattatttttaagtcgctgataatcaggccaaacgatatagcactactacaagcttgttcgagcctatttatagaataaattcatcgatatgtgtatccttaaaataacagacaacttctaaaaccaccagtagtacgcgccgcgggaggatgtgcttaactaccgagattgcatgtgattcgatccgtttaagattcccgagccctcattagttgggtattttaggtcatcacaccgtgaatccaaaccttgatgaaggctccatcagcaaagaaattgctagtttaattttgttgtacgacacaagaacaagtggtcgatcgattagattattagcacacatatcagagacaatgaaccaagagtgtagtacgtacgtagtacacctcatattgacccggcgatgtttttgtggtactagtactgcatcccattaaatttgccacttgctcatatacaaattaaagattaattaacaaggaagttgctgatttataaataagcctttgttatgaccagacaggtacggcgtacttagggaaaatgggaagagatgccaaag

SEQ ID NO: 46809 - DNA, 1916 bp, Oryza sativa
gaatatttgagggctatttaaatgagaaaatagatttcaagagcttaccttatattgcttatatatgtaattaaatttcagatattttgagggttcatattacttatatttgccttattatcttacaaaaaaaatataatggattttcttttgttggaaactcggtgcacattgttttttttttgacaagtcaaattccaagttcaactttcataataccccgtacttctcaaattaagttcttgtaaccactgtttattatgtaaaaaaaacacatttatatcctgtagaaaacttatatgcaaacttagataaatgctgtgaacttttaatgttgcaaattaattaacaggcccttaattaggttgacctttgtaaaccatttcattatctaaacaaaatatatagttcgaccaccggtacgtacagtgacgcccgcacattatacgtacatggagtacatatatatgtacgttagaacatcactaccatgcatgttgcaattttctccattaaataaattaaaaggaaaatttcttcaaagcctctttcttgatttgatgtgagtagtttaagtttctgaagcgtgaggccttgcatttgggctaatggtactgaatggcttacatttattaggagaaaaacctagctactactacctccgttccaaaataagtgcagccatagaaatccgtgtccaacgtttgacggtcggtcttatttgaaaaatttatgaaaaatttaaaaaaatttagtcacacataaagtactattcatgttttatcatctaataacaataaaaatagtaatcataaaaaatttcaaataaaacgaatggtcaaacgttggagatgaatagtgtaaaattacacttattttgggacggagggagtagtacggtaaaaaggcatagggacaataaacaaaataatctagcttggtttctccctaatatttgtgcctccacttgtccaatatgcatgagctgtgtaatataatgtgaatcgcatggtacatgcatgaatccatcatatcgaaaaaaattaaaaaaagaaagcgcccatggttttgggtaatcctgttcgtagcatcaaggtcaactaaacgtacgaggcatcaatcaatataattcaggataagcctaataccctcttccttgcattattccacgagtattgcctactgttttgcaaacatatttccatgacgagttcccactaagatttcgtgttgaatgagaataatatcataaaattcatgagaaacgaattaattatccatccagaacctcatttagatccgtaccactaactaaaactatttgaatagtatgctgttagtagccgcatttaaaataaggattaaacaaaatttcgatctctgcattccttgcaacatggaataaagaagaaaggtgcacaaagagaggagccattagataaatcaaagacttctagacctaggttaatttaaatctagccaggcacgcacagtgcaaacttgcaaccgctcaagaatctaagaaaaaaataattcgtatgactacgtcgtaccctcataaactttgtaggtatatagtttttgtacttacgtgtaatcgcacagctcatcaatgacataatcctcgaccaatgtgtcatttgatttgaggctctcccgacgaagctgtgtgcaaagttgcaatgcatctggaccctcctccggcctaatggtggtatatatgctaacctttatcaaccgcccacttgatggctactccactctaattacgttttatttactgctactagtcaatgtgatcaatgatatttttctcaatttagaattgttggattagattaacgagaaggcgtgtggtctccacgcaaaattgttccacgcgcgtcgtgtgccaggactactaaattggtcagcac

SEQ ID NO: 46810 - DNA, 1832 bp, Oryza sativa
ggccacgtcaccctcgggcccgacccccccgagggggtcaggccacgtgggtgaccgcggctacccaagtctctagtcacgatacccccggccccatgtcaccgacagaggaagtacaaattatacatttacccatgtgagatatcaatttgaactttaatcggggattttactatttacgctagattcacattgagttggcttggtgcaaatcaacattgagagggacgagtttgcacaaatgaaattttaggactaaaccgacccaagaaacatggcatttgcatttctatccctgttttcaatagcaaattgtgtgactttatctttactcttttaaccttatgatttttttcccttgttgtatgtttgctagtctatctatactccttataaaagggagtagctagcggtgatgattgttctgtcaccacccgaccatcaattcccaactttcttttagagcgaaaatggcatgtcggttagaggacccacgtgtcaaccaactcccaacaatagccgattggaataagaacgtggagcactactacacatattttttttaaaaaacaaaaactcttacaaataataatttcaacaatttgattaacatagatgagtggatatctagtgatgtacccacagcatatataacacatcagtgttattaaaagttcagtaagaaagttttagtatgtatagcctttttcgtcaagaacatagagcatatttggtcaggtttaattcaattttaagttcggacttaactatatatgtacttaattatatatgctatgaacgtacgatgtctcatcagctaggacgcaaacatccaaaaattcagaaacagacacacaattatttcggggaaagtaaaagtatatatgctctgaaacagtaaacccatcttgttgaggacaaaatcgaactaaaaatacatagaacaaatcaagctgtccaacaaaatttggggccccctcgctcgagacagaatctcctggtgttcatggcgcattccccaatcagatggcccgatcgattggtagagatgcaatgcacctaataagcacttggattccgagtgtacagggccatcagcaactggataccaatttatttatatatggtttagctgcaaatgattctaggacacttgccataaaacactagttttattgctcaacttgtggcaaacttgtgtgctgctggggctgagtgcatatgcaagtgttcatcctagttggcatgatctcatcaagcttagctcgtggtggtgattaattatatctagtgcctaattacacttcaggctttcctagttgatcttgcaaagcagtagtatatactatatgtgggaaaattaaagttgttcccatggtttcgaccttcttttgaaccaagatagcgtgtaactttttgtttctcgttgcttgattgagaaattataatttgacgacgcatgatagagagcgtgaattacgttgtcacacggatcatcagtccactgacagcccagttaattaattacgtaccggtacggtccctgttttcaaccggccgtcgatcgctcgttcctgccctgttccaagtcaagtggccacaattgttgacgacttgagttaatttgataatgtgcattaaattatgtagatcaagtgcttaattatgcagggcttttgctcccattcttcgacagtaacaggccagttactgctggttttagagcacgtctaactctgttaattttatactgatgaaagcccaacctgcttattggttaatgattggttaatcgatatgttaattgaacgaggtaaaatgaagcactaagg

SEQ ID NO: 46811 - DNA, 2117 bp, Oryza sativa
  unsure (1)..(2117): unsure at all n locations
ctgcacccccactttggttcctcccatttttcatttcaaagtgatactaataagcaagtgcaaggatagctagcttgacagtgtggaagtagtagtaggagcaagaggcaaattaaggggaagctgcaggtggtagatgcgtaatgcgagcggcagcagctgctgctctcgggtggcggcgccgttgcatgcgcaagtgcttggctcgccgtctccttctcatggctacggcggcgccggcgacggctgtcttctgcaggcacctcccccggcagtcgtctgcggggagatgctggcactgacgacgccggcgccgccgtctcttctccatgcactggcctccctcaacgtcctcctcctcgtcgcctacctcctcctcttcctcctcgccaagctcgccgccggccttcaccgccggtgagtgagtgacagagctagcttcagttcagagagatctttgtgccattaattgcatggacgtgtcacatttttactgtgcgtatgtatgtagaggccatggtagctgtgacgagcaccaggtcacggagacctccgggagggaggagttcgccggcgccgacgacatcgccggagtgcagcagcagcaagcggagatgctgttctggttcgacgaggccgtgttcgaggacactgctctgcttggtggcgaaggaaaggatcagctcatgtacgacgctgccaccacaccacctacacctacacctgcacgttgcttgcaggtggagagcacctttcccatggtggaatccacccgacgaatctcgccgcaccatcgccagtgcagcttcagccatgaggagcccaaggccgccgccgccgccgccgccgccactgcgtcgagccagaaggatatcattccggccgccgtgccatcaccggagaacgttcccgtcgaaggtataaccattaattccactaacctctattacttcttgttaaccatgcatttcatcctggttctgacactcgtcgtacgtggttgcagccggggaagaggacggccatggcgaacacggagaagaagacgatgaggaggagaagaggtttaggggagatgacgtgaagctgttcgtgaacagccgggcgctcgccgacacgaagaagctgcttctggagggcgccatggccgggaaaggaggagtgcagcgcgagcgcgaggaggagagcaggttgggcgcgtcgacgctgacgagcgagtcgacgtcgaagagctcggtggagtggcggagctcgacggtgaccaaggactcggagacggagtaccccttctcgtcgtcgtctcgccggagctcgtcgcggtgggagtcgtacgctctcttccgcaagtacgacgaggacatggtctacttccatcgcgtcggcgcccagaagctcaccgagacaggtacatactaattattcttccaaaatcaagtcatcattaccactcattacccaagctagattaattaaacctttctcgagaaacataaacctcaatcaaacgacgcaattccagctccctgcaactctttctctacacacaatggggctcacacaacaaaaaatatttacagaaagtttactgatcagttgcgtttgctggaacggttaatttgcagagtcgtacaggtcgataaagtatcagccgcgatcggtgtcggagcggatcgtgcagaagctgacgccgaagccgcggccggcgatcgggctgagggacccgtacccggagctggagcgggtgtacgtggcgcagatctgcctcacctgggaggcgctcaactggaactacgccagcttccgccgccacgccggcgacatcgcggcgaggtgctgcccggcgcgcgtcgcgcaggagttccagcaattccaagttcttcttcaccggttcatcgagaacgagccctacgagtacggactccgcccggaggtgtacgcccggatgaagaactcatccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46812 - DNA, 1116 bp, Oryza sativa
atgagaggtcaccgtcaggtttgcaagttgttgcaaatggcgagcatcgtccacgtgatatgtaggaagagttgcttaattagccgtggtagatcactcgactgtactgtgctgtgtgtaccatcagattatgctgtggaatgatgcttctctccatgttactgatactgagaagtgacgttgggttatacattgtaaggaggtataggttttgcaattgccaaataagtgaggttaattaagcactgatgtctcctaatagctacagttcttgtactttagaaagtaagcttgggagaaacaccaagctgacatgtgcattccagatcgcagaccagggtcaaaaaaagacgcacctgacgaagttaatttccaagagaaaaaaaaatccgatctggacacctataaatagagctggtcagatgcgcttagccagcagcaaccacaaccgctcaaagcactctgcaagtagaccgagcaagggcaaagctttgtgcatagctatagcacgataacaatttacaggtggccatgaagagcagcacgctcatggtgatcctggttctccaggccgtcctggtcatggggatttttgcagctgtggctaaggagaatggttacgtgtgtttcttaattgtcaaattaagttttggcccgggaaaatgctagttaacctgctctgtaaactggatttacactctcacgagatttctaataactggatccaacaaaagccagtcaactactttacagttttagaaagaacaaccatggagtgtgcctttccattcccgtactgtgttgttgttatcaggattcggaattgcggtgattgatgattatgcatcgtatactttagagatttttctaaggcataccgaatgaatgaaactacaaggtcgccgtcgagaggataggctcgtagatcttgccatcttggggtcggccactctcattcactgggctcactgtcactggcactcgacatgcacaaaaacatccaaagcatgcattggctgggctccatcatgccaaccaacctaacagcctgtatacacaagcatcattcatccacataaatggatataggctcaaagccggaaagaacccaacaat

SEQ ID NO: 46813 - DNA, 31509 bp, Oryza sativa
taactatccaaattagtgtaaaaaaatgtctgattaatcactgaatggttgcacggataattggttgcagctgtgggagagagcaagggcaacactgagaccaacggtggcaagctcaagtgctgcagcaactgcaacttctccttctcggggctctacacctgcgaggacgtcgtcaagaagtgcgaccccgtctgcaagagctgcgccgtcgtcaagactcaccctgtgaagaagttcaagtgcaccgacaccttcctcggcatgtgcggccctccctgcaagcactgaaatcctctcaatccaaactccaatgtgctgtgagagcatggccatggtgcttgagttcgtgcatacgcatgccgtcccaagttacatgccaacaaataagccgttgtttcttagatatatgtactacgcagtgagtgaagatgtagctggttgatgtcagtacttcactgacagtcactctgccagcacatgtaatgcatctctatgtgctcaatcgagctggggcaagaataaacgcagccgctgtttctgtgcttttcatatgctgcttcggttttccatcaattatcctaacgtatggcagatgccaaattggaaagagcattttgcctaggatgcacaatgcttaatcgtcatgttcattagaggattgttaccagatctacatgtgtgagtctactacagaactgatcagatagagcagagctgctcaagatgtataggagtctggcaggttgaactctgagagagccattcgatcccggatcattacaccggccttgggcatgacatgccagtgtagaacaagctgaactttcttcccgcgcaaactgcttccctgatgagagcagagcagatgattctagtcaagagaaattccaagaatgcatgcaaactaacactcgattttgaagcacgattgacgctttacctggtcaatcagaggatacttgctcttcacctccacttgcaaattcgctttgtccttgtcgggtatgatgtggtcccacaatgaaacctgtcaaatatcacaatttcaacatgagcatggattgatcaaccgcaaccactagaatatagaatataaattgaccagcttaattgtatatctgactacatagtatcaaagcaatgagcaacttgttggaacaacttgatcaaaagtttacttgctggttaaaggaaagactgcactataccagcacaatgaatacatgtaccagaacattactacagatttcagccagtttctataaggtagcgttcaaaacaaattattcacagaattattgccgcagattatctacttggttatagggaaattaaatattttgagaaataaccttaacagatagcttagaacaagaggtctaagcaattgtatttgtagaagcgtggagcaaataatccagtgaaaaagctaaaaagaaaggggtaggtatgtacagtagtctaaacattccatgcatgattacagatttcatgtaatcactgattgaagaccagctacttgttcgtaatagtacagatactggcaggaagaatctgctggccaaggtaaaatgtgaactagttacctggttaagcgaattcttcgagttctcatactcagcagtcagaaaaacgaacacctgtatcaaaggaacaacttagtaactggctacgaaaacattgaagtaaaccaaaactttacaaaatcatgtgataaaaattgggaaatcctacaactgaagtatggactgccaaattaaatatgtatgtagcaagtcaataacattcagtagatcgtcggtgaccatctttttattactggtttcacaggataagcaatcatgaaccatgacaatgttaaagtatcaaatagtgatggtcactcattgctcaagtttttcaatgcttctatattgaggacagcagtccagtttctcagtaacattatgtgaattgctcaatccctacccgagcatgttacttgcgatgttcagctaatattgttcgccggactggcagggataaacgtgagcgcagttttctgatataccacatttgaaacatgagctgcatattctagtgaaatcaaaatatcacctgttttgtgctccaagtgaatagtgactccaaatttgcggacaagttgaaggtcagtgtcacctgtcacacaaatttacaaagttttcattgtagttgcaaaggaagtaacacagtatatttatgagatcgatatattcgcagaatttcacaaaggaaatattgcaacagcaaatcatcaagtaattcaaacagatgtgcatattagtagttgaggagagaaacatattatatcataagcggatttacaagactctgttctagatatgaaagtgagataatattactttggaaaaatcattgttgtatatttatgaatatcatgctattggaagttgacagattttgttctgcaggtggttggaagttggaacatgtctactctattttgcattcagtataagatagtaacatttgaagcctttgcacaagaaaggttttttactaaaatgtatttcttgattacagatatcaaagcagatttgcattaaaagaaagcgaaggcaagcctttgactgttaattcataacatcggaacttcagaccaagcaaactctccatagcacataatgaaatgtattgaatctaaactgaaaaggcgaaaatacacaatggcagaacccaggctacttgatgagaaaaggtaaaaaaacgtactatgacataattatacagcgtagaagattataacagaatagcacatattgaaatcttgctctatttagaagacactactctgaaactgtgatttggataatttgaaattatcgcataatgaaactaaatacgtttaggcctctggcagcacacacacgcaagcacgaaaggttaagggccttaaggcacagaccttgtcgttgccattgagctgcttgtggaatcggtttatctttgtaacctacaagaaaaaaaaattacataagcacattgatgctaatatcaataggcaacaagaccaacaaagagatgataaccgagcactgcttgcagagataactgatactctgatagattcacaattttaccattgttgaaagaatcagaatttggcacccaaccttccaaaattctacatttcagccagacaaatcagtgtctacattctatatgtacatgatctagccgaaaatgacaacaacctaccagtaatagcatctccatttgtaaacaagaatcatcaaagatcctataacccccaaaataccacctattttgccacaccaatgacctcccagacatcacagaaccctaaaccctaaccctataaagatcttccagtgaactgtacaatttcgcgttgctagatagactacgataaccggctagaacaaatacctaaacatttcagaactatctcagccatatcaacatgctgcgcaatgcagagaagatccccaatttcgagggttccgagtcgcggatgattccaggcgtgatagtgcaaagggagcaaaaagaagaagaagaacagacggattcgtacatgggcttgcgcctggacggaggggacgtggaaggcgtcgagcgcggaggcggcgcagcaggcggcgaggaggaggagcgccgccgtcgtcgccgtcgtcaacagccgctgcacccaagagtgcatcgctccgagtttttttttccctttttttttcttttcgggctctttctttttctttttcctctcgagttttttcctcgccttttctatatgtgaatcaacggacggcgatcttgcaactgccacgagtgcacggacttgcgcgccgtccgattagaaatggtgaaattgtgtctatgtttgctcgtggattagactgagcttgggccaggtggaccaatgcatcttcgttttgggctaaatactgctgtgttctccggccaggccagtatgggcctatactgcaatattgtacttattataagtcatctgaatttttttagtcgatttttttattaattttgatcaagattatagaaattttatgcaacatttaaaatattaaattattttcattgaatttaacattgaatatattttgataatatgtttgttttatgttgaaaatactagtactatatttctataaacttggccaaacttaaaaaggtttgactaggaaaaacgtcaaacgacttataatatgaaaaacgaatagagtatgtgttttcttaatacacggatggttgaattttttatatgtgtgtcattaacaatttcaaatgtaattttaaaaacaaaaaatgctgaaaaaaataattttaaattttaaatttcaataacggtttataagatggaagtcattcgagttaggaggagacgaggagtggagtttttagtgttcaagtgatagaggttatagcgtgggacttagcaatggatgtcaacgacgccaagagcgtcctcatctcgactagcgcataatatggcaataagatgagggtgatttcccaatgtgatttatacagggagattctattttcagtttatgagtaccatataatgcgagtaagcttcatttaaggtgggacgaaagtcactctagttgtgttcgggagaaggggttgagaattgttagaataaatgtcaaatatactagtactatttagttaaagttggacttggagttgtaatatttggtaggggtgaagttaaagtcggactttataacccggtattctcttaaagagaggagggcaccacaatataaaagatggcgactataatgtatcatagacacgcaggaagactatggcggtgaggccatagactcgtagcgtcttggtgttgcccataattagagccctgggatgcatgtaggcttaggctaaatctctttaacaaatatcatgtgttcttatgtcgtcatttagcgtgtcttaggtgaccaatgactgaagcgatcgaaaaagttaattgtcgttccattatatcgacgtacttttataacaatcacattagtgtgcggttaattaagtataaaagcttaaaaatagtttgatataactttttaaaagcaattttcctataataattttctaaaaaaatatcatttaacggtttggaaaacatacacgtgaaaaagaaacaagtgaaattaggaacattgacttaaaaacacaacctaaataatcaagtgtaccttagtctctagtggactgatcacatacatatccgcataacatcctcctcatgtgtgtgcctacgactacgtgatatcctactcaatgtactcgacgcagcaagaattgatgcggtttgccgttttggtgtattggtctgaggtttttacatgttcatgtaacaggctacacctaccttgtagctccgccaacggtataatttactcaaaattagttcaacatgttcggggaaaaaaacattgaggctgtccccttttctctttttaggattttcactttagtacatatgattattttttcctcaatatattgaaataaactcgactctattttattactagtaatgccttcgtcctaaaacaagttatattccactcaccctacatatcgatataaaatcgaaaggaccataatatcccgcttcagttaaatcccgatacaattatccattaatttatctatttctgatacatttatttgtactttcacaaactcgatacaataattggtaaaaatgaatttgtttgggaacaaacgtgagaggaaaaaaagttactagaacggagtgaatgctatttatgatgaaacattcaattttctgcatatcctaaacaggctccgtacaagaagatatgcgcaacagtggagtttgattagagtgacagaaagaggaacattgctccaagcgatactaccaaagtagcgagctggcttgacatctctcgaagccgcaggaaattgtaaacaacactttagtgacagcattagtgcttggatctttctactaaaagcgattcagtacagtgatccacgcactgctcagctctctagagtgaaagcaaagcaaccggctactacctactacgactgacaatccatgagttgcacaggtcaaaaatatcaacggcaaagatgagccaggtgatagccaagccaagggatcgagtgagagtgctccacaccaggtcacgaatgattgattccacgacagtaaaatacgccaataatacactccctcgttcgtccaacttggctgcagcctccggagtcgttttgaccccagatcatcagcagggtcagaggctggtgctctgtgtctccctcgagccctcacactcacctcatctcgcgcacaacaccacgtgacagcgaccacaccactggccctgcttgcgggcaccacggtaccacacggcaaatctcgtcaggaaaacgttgagaaatcgggggcggagctcaccatgtcgaccggcagctggtcggtcagacgctgtcgttgaaggagaaaaaaaataaaaattaaaactgaatcttgtctcaacttgcttggagctgtagcaacgagcagtactacaactgtgcgatgtaccgcgattccttttaccggcagctttggatcttctcgcaggaggacggacttgtcaccagcagtagtagtatatggacacgtttgcgattttgatgttttgtcttcgccgtaagcggcaatagccagagggatagtagcagtagtatactcctatatcacaggtttcggccgactaatcaaatggattatatttttccatcgacgcaagcgatatgttccaggaaaagagtggataattggaagaagttggactaagccacgactttgtgcgattttctccccctggttccatcaccgatttgactcgggatgtcgctcgcgatggggactgtctacctgatcggcaacacgaagcatagatcctgtcaaaactcgagcaggattagtgtagatccggatctgatgcagaccaaacagggctagggccaattcaaggccgcattaacaagcgcccatcgtgcgatgcctgtgatgagctaacgtgaagcgcgagcgatctgcgtggcagctgcacgcgccatcaagcgcgccaccgtgtcgtctccgtcgagttcggccgtgcggcgcggcgcccgcgtcgcgatcggcaaatagcagcgccgcaccgggggattgaaggaagattcaacgaacgaacgaacgatacggacgatggagccggcaataactcctcttccaacacgcaacattgcgatttgataggcgatgcgccgcatgccgccaccaactgtttcggcatgcggcaaagacgaccgtttcgatccacacacatcgtcgagtggtggcgagtcactcgacggccagatagcgtacaaacgagaagacgaaaactgttagtacttcgtaacaagattcggcaaaaatcgcatggatacactgtatctccgtaaagacgaagtaggaacacgccaagttcttaagcttggatgtctgctggattccgcacagaacgttccagaaagaaaaatgacacgtcactcggtcactcgtattcccggagggagtgaagatgtcaacatggaagtgaagttgggggttccaattcttttggggttaggactgttcctttccaaatatcctagtgctgttaggtgccaaaaatcctagtactattaggtgcggtcttaataatcatcattattgccttcacctggctcgtggccattcttcttgttgcgtggactttgttgacgagtagtctatggcagaaatcgaaccacctatctgaaccatttttctccgaaaagactatggttagcgatcatatcaagtgtgactgccaacagttttacttttgcaccaccgtaagtccgtaactaacctacctacacacgtggattattagccaaacctagtactgccacaggtagcctaaaccaacttagcgcaatgattcgatgcgtgcaccgggcgcaagagatgagcagcagcagccgccatgacgtcgaacgagacaacacagccacacgctatgacgtgcgcggcaaaaggtggaaaaagcagaggcaacaaagccgtgcgcgagccggcaattcgatcggcgccgcgccacatgtcaacaaccgtggagcaacaagcgcgcgatatctcgaccttgcacggccacgccaagctgacatccgacttcgattcatcctccacccacctgacccaacccagccacgtccccgtcccctaccagctaacgcattcactcacctcactccaccttcgcagcgtggcttccagctgtgccgtaccccgtcccaagtgtgccgatgcgtgcgagtcctttcgcaaattaaaacaagttaagctctgggaaatggtctttcggaaaaaggttaagcttgtgggaaaatcacaacagaaacggcatggacggcatgtgagcgagagagggaggaagcgaacaaaacgcggggtgccatgccaaaggcgtcgacgtcgtggcgtaccagcgcggccggtcctagaataggatagccacgccatccgtatcggtatcgcccgtatatcgcctccccgtcgggttatcccgcgccgcgtcatgtctacgtacacgactacacgacgccgtttcgcggccggggataggacgcgcggacgcgcgcggggcgtgaccacgcgcgggatttgccctggtgagccgcggtctcatcgggaaccttatcaccacccgcgcgcgcggcgccacaccacacagcaccacacgcccccgcgggggaaaaaccatggccccagccggccagccgtctcgcgtcgccgcgcgccgcgccaaaacgagacaagcagcggctggcctgcgactgcgaggtgactcacgcccacacctccgtgactcacaccaaatgctactgctcccagccgtgagctgggtacgcatttgctgtaccttgtcacgtggggctcagttttgtttggcacagggcgagcgaaccacctgtcgcggcctactctcccccacgccgccttcacaaaagtgcacctataaacgaagaaaggagtgagcactctctcactcactcggtcgatgcctatggccaacttgcttgatactctctccattctccaatatgctcaagtctcgcaataaaaatctcaggcggctcagctcactactactgtactaatactagtatactcgctcagtccctctctaacaggtcacaacctctgaaaatacttttagtacgcaccaccgtgcaacgaccaagctctctccacataaacaaaacgcatcactgctcacagctaacactgaacccggactttgtctagcagcttgtacgcatgcgtatcggatctagccgcatcttgtataccagcacctgtaaaaaaaaaccgcacgatctgcccaccagcgtccaaaacaaccagctgcacgatcacagcataggtaaaatatctagcctcattagtcaaactcataaaattagctgcacatcctcagtgcaggaatctcagggtaacagctcattaactacacaatctcaacattaaaccagcagagtaaaatgcatacagacgagacgagttgcaatgcgacgacatgaccagatctcgagagcaaaagatatgtaatgtaatcaaaacttatttttctttccataacagagacgacagccccaaatacttgacttgtccactatgattttcttgacaaacttaggtaccagataacattgagaaaagaaaaagaaaaacataacataccacctataacttaccatacttttaacctaacaaaattactctccgaatgctaaatgtgcgttggagttcttatgggcggaactgaaatctcaagggcacgagcagattgattttgctcggggaaaaaacccaagaaatctcctcccaagcacccacactcacaggcccatcacaccaacatgaataactttagcaagctcttaattcacacgcagaaatccacctgccggaacatatcaccacggccgaagtcgtagccgctgggtatctctgggaaatcctcgcagaagtcatcaccgatgtcgtcgaggtcgaggtcatcttcttcagcgaagtctccaagcagcatgtcctcagtgaagagtacgtcttgttcgccattcatgtaagccggcacatcggagatatccagagcatccagcccagctcggaaatccatcgggtcaatgtccggcagctgtagaccgcgcagtatatccttgtagaactctgggtcatccggcagctcggcggtctcgttggtagcctccaccaggaggggagttgcagcttgctccggcagcggcggcgactctggctttggagctggcttggtggcttcgagcacagacgacggcgaagggtgggcgaatggcgcggcagaagtcgaggacgacgaggacgcagtcggagtaggggtcgccgaactagcaggtgaggcagaggaggccacaccacggcggcgcttctcttcggcgaagttgcgggaggcagactggtaggcggcggaggccgcatcagcagtgtcaaaggtgccaagccactccctatggccggtgaaggggttgcggatctccgccgcccacttgccccacttccggaggcgcacaccacggtagcaggtgctcccaaccttgccgatgttggcgtaggcagcgacggtggacgccggagaggcctgcttcgtcgacgaagctggcttgccaatgaagagctcaaagtagcgcttctttgaggcggcgccggcgtcctcgtcgtcgtcagagtcggagtccgtcgcgtcagggtcctcgaacacgacgcggacgcgacggcttggctgcagggaggccgccgccgacggcacatggggcctggagaaagcagcagagggtttaaggccaaacccggatagcctcttcgtcttgggcttcttcgccatcaccttcttgaggagcatctgctgctgcttggaaggggccatttctctcttcttctaactcttgccggaaaagaactctaaaattcctcaccaaaactgacaaaactgaaggggaaaaactctaaaagggggaaactttttttttctcttgtgcaaaaatttgacggagacgaacacgaatcgatcgaatccgtcaatctcctcgacagaaaccacacggccttatgtggaggaacccggaatacttgaccccgaacccgtccctgcaaaatcacagacgagaaacaaacccatcaatcaaaaaccccacaaaaacccaccaagaaccctccagatctggacgaaccggccgcgaaacccggtcaaatccactccagatcggcgtaaacctcgccaaagatgaaaaatttcacggtggggaaggggcacccggacgcacctgagcatcgacgtggacttgttccagccgtggagcctctggtgcatagatcggcgggcgcagacgagggggaggaggacggctgcggcgacgacggcgcagacgaggagcacgactaccaccagatcggagaaggggctagaagacatatacgggtgctggtactggtgcttccgcggccttattctccgacagcggcgcggtcgtcgtcgtcgcctccggcctcccacgcgctcgctaaaaccccgaccaaaacggcgagaggagcaaaaggggttgggctcgtctcctccgccgatatttaatcccctcccactcctccacccattcctctccctcacgcgcctatcccccaccccatcacactgacgcgtgggcccaccccaccatatggtccctcatgtcacgcgggagtggcctctctgcctccggatgatattctgcggcttcacgcaccagatttctgcacagtcgcctgctacgaacacagtgacgggtgggccactactacgtccgggcccacgcgcagtgacagagcggtcacctcgcggagtaaaaatctcggtaccggtgctaccgtccggaagcatgcgggggttttagctgacatgtggggcccgggcgatgtgtccccaccactcatggggataagcaccaaatggcagaggtggggagggttttgggggggctttatgacggggaagcgaatgggcgagatgaggcggctagcaaatgataaatgcttcacctacacgcctggcctgtacatcatcgtctccatgacatgtgggccccttacacttctgcatagtgaccagatctagtgatagggcaacggaaaagaaggggattgggattctatggttgagattccacgcggccaaggctaatctcccaatcaagacgtccttaactcagaactaatttctgacacatggaaatggcgatagatatttttagaataaataaagtacttaatgctgaaattatcgtgagaggccccacgacagaattggaaggattttgtgtttccagctaacttgagggccaaggtaaacgggcaccgtaaaacggaacggaattttttttggaaaagcgggcaaaaacatgtggccacggaggggccgtcgattggtcagcttcctcttttttcgtagcgtgcctcgtttgacacgtaagcatgttttgtgcgagaatctctcatctgatgacccacgatatattttggaagattttcctctacgtggacttggcacttgctgacaatcccaagatttgtttactatacagtgattctatttttaggagagactgtttcatatggccagataaaaagacggaagctaaaacaagtcttccgttaatccgcagatctgattctgttctcggcactgtatctgcatgcagttaggcgtgattcttcgatcttattatgcgccgtaaacaggattcttcgcagaaaaagtcaaagatttgtacattcgatctatattgaaaaccgaaaaaaaaagtttcttttgattatttaaggttggttaccaatgtaaaaaaaagtgtatactaacagtaacttctgcacttgttatgtagtacccctcaatctacttttgatagtcatattttattttggcacacagaccaacgataagtgattctacttatcatccatctaaacatgctactaatcattcctcataaacaagcgatttattaatatttacatttctcgatgcccatatagtcaatcttgtgtggaagaataaagagtcacgcattaaattcaagaaagccattaagataataatttgttggattgaaatatgtctatcaaaaataattttttcagatttagaaatatgactatcaaaagtagatggagggagtaattaggaaaccttggaaattattctatgtaaaggtatttttttttactcaatatgcataagatggaaaaaaaattctttactcaaaatgcagtgactcgaacaaaatattcgctccttataggagcacgagcactaatcttgtacaaacatttaaaccctaatatgctatacctggaatatagcgagtatatttacacgttggaggagaaaaaaataaagagggagataatattcgggaaggaattagttcggcaggaaaaagcaaaaggaatttctcatcgtggcgagaccaacgtggacatttgtcgcaggagatgggcctcggctcgcctttgcagctggcacgcccgcccgcgtgaggtgtgtcatgtgtggactcgatgtggtgcgcgtaggcggccgccacgcagacccagacccaaaggtgctcactcacgaggcccagggagtgaagcgagccggtccggttgggtgggtgggtcccagatggaagcccttgtcggttggtgtgcgcaatttgactaatctttctttctttctcgctagtaccggtagtgtccctttttctcttcttctcctcttttcttttctcccttttcgaggcgtgcaagctgtttgcactgtgcacgcagcagccttccctcatggcccagcacgtgcgagctgcgtgcgccgttttagtttttcattttcctctctctcttttcagacgggataatatacagtatcatcagctgcagcagtatgcatggtcgagtagtagtagacagtatagtagagtagaccatgccggtttttgtttcggcggcgaagaaaagcatcggcgtcggcgtggcacgaccacgagcggatccgatgagtcgcacgtacggggcggcatgcgcgccacgtgacgcgcggccgagtcgccacccacttggacggactctcgctttctcatatggtggtacagtacgaaatattttatttttgtgaaggaaggtgcgaaatattttatgcagccaaatggattcccaactttgtcgtggagtcgtgcggtgcgtggagtggagatcccctgcggtgaccaagcgaacacaaacagcggaccggtcagcgtgcagcagttgcaccgctgcgttgcacgccgagtaggagtagaaaggcgggtgaaacgagtaaaaaatgcagtggacggtgcgggccaaaggttaactgcagggtatacgtagcgcgcatgcgtgccggtggggatttaccgttacaaaaaggttcgtgtgctgttttacctttgcagtcgcggtaaatgtcagtttgttagcgcactgcttctttttgtgaggtactactcgtttttgcgtgtgctcgtaaatggctatgaacaattcatgcgaatggcatgaacatgtttcgagagaaaaaggttggccggatatttgtttggcccatcacagtccagatccgcacggtgggctaacaggccgcatgatttcaccatattcgctcgccgtgttgggctaagggaaccgagctgcccttaccagtcattgatacatggaataagtacatatgaggtcccttaacttgtcaacgaatacgattttcgtgcttcaaccggaaaccagatacaacgggtccctcaactatcaaaaccagtgcaaaaccagtgcagatgaagtccctcggcggttttgagggtggttttagctgacgtggcccctacgtggcaaaatttgacttagtcttcttttgatgtggcattgacgtggcgccatacgtggcaatttgatccggaaaaataataaacttcgtgggacccacatgtcagtctcacataaatcaataaaagaatggtagggcccacgtgggccccacaagtccttctcggctctcgtttctcttcctcttcgctcttcctcgtcctcgcgggagcggcggcaggagcatgccggcggacggagcggcggcggggctgaggggcgggcggagcgacgacaggccgcaggcagcggaggttgccggcgagtgcgacagctacactccgtcggccgctccgcccgcgatgcccagccggacggcgccgcccctcctcgcttagtagccgtacgcgccacctccctcctcgcccggccacctccgccgacgtcctcgatggtcacatccgggtcggagctgcccttcgtcgcccggccgccgagcgccgcctccctcctcccccggccgccgcgcgtcgcctctcctctccaggccgccaagcgccgcccccctcctagccgcgccgcctccctcctcgccggtccgccgcgcgttgcctctcctcgcccggccgccacgtgccacctccctcctcgcccggctgccgcgagctgtcatccctcacccggacaccgcccgccacctcggggatgggagaagggagagagaggaagaagaagaggggctctaggtgaagagagggagatgctgagaatgacatgtggggcccacgtgggcccccaccatttttttattaatttatgtgtgaggctgacatgtgggtcccacgaagtttattattttttcggatcaaattgccacagatgcgccacgttaatgccacatcagatgaagaccaagtcaaatttgccacgtaggcgccacgtcagccaaaaccactctcaaaaccgtcgagggatctcatctgcactggttttgatagttgagggacctgttgtatctggttttctggttgaaagacgaaaatcggactcgttgacaagttaagggacctcagatgaacttattccttgatacattgggccttaggcccaccaagcgtatgtcttttctggactatgtttcagtagagtagaccgggggtagttcagtgagagtgatatgctcccgaaatttcaccgtcacgcaccagcccatcagaaccaaaggaaaaactattcaacgtcactgcattgcaacaggtcgcaccgtttgcagttacagctcgatattattataatatgggcagcatcagccacagaatcacccacttcagaccatcgttttctcaccacatcctgaaccggttcatggctctctgataaaccacccacctttgatcgtttgaacaagtaaagaaagaaagggggagagctcacatcaaagaccagaccaccaccagcggttgcaatgagttgaacacaaagtcggttatttagatgagatccccgatccaaccaccggcaccggcaccagtccatgtgcgtgatctgcagctcgtcgcacgctgcatgggccggcggccagtttagacgctgtaccggtaataaagatatccacacacacattcgcatgcaatggccatcagatgcagcctctgccaccactccacctccaccttttcaattcctcctccgccattattgccgcctcctctcgacctcccgtcacgtactgtttgcttgcgttgcaaaccgccgtggcagcggtcggtcgccaccgccgctgcccaccatgtggccgtgtgcggtaaccgatctcgcatgccgtcctctcgcgatccaaccacctccccaaccgaccgtgcattactcgtacgtactataccccctctccctattgcataccacgcaaaacgccaagagaaaaaccgtaccgcacttgaccgagaaaaaacgcggtgcagtttgttgcttctggactactatagatatggggtactgtaccggatcgatgagtttatgtgtttcgtgaggggggatgacgaggaaacagccaagattggtgtccatcgatctatacagtgtacatgatgagtttggatgggtcgggtgcagttggtgccggggagtaatggttttgatcggcgcgccgcgaaccacatgagagcaggcgagatatcacacgctacaaacgaaatgagaaaacccaccggcaacgcacatctgaaaccggccttactcatacgagaaaacgacgtcccgagagagagagagagaaatcaagcaccgattattcctaaacaagcacaacgccgtgggtggctttagcttgcgtggtttgaacacaaccttttgtggtaggactactttgcaatccggggcaagcacgacgtgtgcgatgcgatcacagcaattaaattttcctggtaaatggccctatcagctttccatctcccaatccaactttcctgctcccaaaataaatattgccagagaattacagaaggtttgattgcgaataagttactgatgacccgtaaatattatacttgcagttgcaggaaaagtatttttgtggtttggcccctagcgtcaatgatagcactagacaggcactggaaatcttcaaccaaacatggaagacacaaatggagagggaacgaaaaaaaaaaaaagaagaacactcgattttcgttatgtcatgtgaattgccgcctaacttaaaaacgcaagtgttaatcaatgtcaagtagtactagtagggagtttttcagaacaagatttggtttgcgcacatacgacctagactttgatatcatatgcacccacaagatattgttttttattttgtttattaaagattaggagtagtaaagaaaggatgattccacgggagtttcgtgaactcttctccagcgttcccatttacctcaagccgacggcaaacctgaaaccgacgtgaaagacgttggctcaccatcttttcctgtgggctttatctcgctccacgaaattgcataaagatttcatttctaggtcaaccatgccggcctcaattatccgctccttttcaattaaacgttcacaatttcccagcttcacctttttcatgcactccaaggaggactggaagcttcggatttcgaattttccgtccattttagtgctgtacagttcatttcagatcttttgttccatctcggtttgtcatgtgtgcaggtcaacgtcgacagttcatccaccatgaaattattttctcttccgttcacaatatccttttgaagtttgaactgctccatgtaatttatcgtggcagctgattaaattaaatctttcgtttgcttgaaataaaatatttgtaaggtcgtagtactggtatgaaggcatgaagccattcttctcatttttgttcgtgaggcattgtcatcagattttttcttttaaccatgcctacatctgttttttttttctcctctccatccatgaaacttttttccaagtttcctcccctctgtttttttaaccttctactagaaactttacatccaaggttaaacaagggtagagctaaggttagccaaatttaaaaaaaacgaggaaaataaaaaaaaactaatccacttcggcccaggcccatcagacggccggcatggtctcgtggcgaagcgccgagacctcgtcgccgaagccgaacaagccggcgtcgaagccgtcgtcgtcccactccgccgcggcggcggcggcggcgaccgcctccggcgaggtgagggcgaagccagcgtagccgcctccgccaatctcgtcctcgaacccccagatctgtccgccgaacccgatggcatcctcgggctccccagccccggcctcctcctccgacgaggacgcggtggcgggcggcaggccgagctcgtcgtcggaggcctcgagaaggaacccgagctcgggctgcgtcgtgggggcaacgtccccggcgacatccccagcaacaatctcctcctcgaagctccgcatgacggacgccaggtcgccggcggcgcccccggcgtcggtatcatcgtcgagcatgtcgagcaggtcctccgcccgcagcctcttggcctcgtcggcctcatcctcggcgtcgcgcgccctcttgttgttgttgttgttattagaactgtccatggacgacggtgtgttttgccgcgtaaggaagagagagagagatagagagattgtgagatggaagagtacaaaaagcaagggggggttgctttgcggtgcgacgccgagttgggggccgcgtaatatatagcgttggacgcgggtgccgggtgcgcactcgcgggggggtttttgcgcaaaaacatgtgtggcgtgcgtgcgtgggagcggcgcggcgcggtgcggtgagggcttggttggcacggctggctctcgtgagcggagagacgttttctttatttggttttggtcggggaggggtgcgtgtggcatgtggaagaccagcaagcagccggcaagtcaggtttctatggatgtggtcgtgcctttgccttgacgtgccgtgcgttctagacgggggttggaacggagacgccttccaaagggagtgatatttttctgccaccggtttggattttgattcgctgtaaagtcatccgtctctgcctcgtgggaggggtaattgctaatcggtgctgttttaacgggtctctttttagttaagaggggaaaaaagaatggctatattttacccacgcggatcttgatatttcttctttttgttctgtgtgtgtcactgctgtgcacatttatatggttttacaatagtacagtatggtgaaaggaatacctttagaacaaaaaaaacttaattaattgttttggagtgataatgacaaaattaggattccaaatggatactacaactatagaatcgaccatatatattaatcgacagtgaagggttagtgccggcagctatcatggaacagtgtgaagatctgaccaacacccaaaaacttaaaaagcatccctcacaaaaaagaaagaagaaaacagtattcaagcacggtttctttgttgtccaaaatggcttaggcagaaaaacggagacgacccggcgcaccgtacagaatggaccacccaacccaacccaagtacccaaccaaccactctaccctttatccgggcaaaaaccacgctcccaacccaaccagccaaagcgccaagcatgtgaccccaactgtcggatcaattctcaaaacatgaaaatcttggggtcttaaacgcaaatacaccgcacattcaagcaccagaacagtgggtactttttcaaatacttttattcagaggattgataagataagaaatcttggcaggggctaaagcgcaaaaagtggcgggagcgtggagatcgggattctggggccatccgtcacgggcgcgtcgcctttttccagtttctatttaatttcccgatttaaatttcgattcttaagtccgctatccgctgcgcttcaagtccgcgggtttggcgtccgcgagccgagccgacccaagatgagccgatagcgatcttcttttccgaccaatcgcgagtggacggctcgcttggagccggctcaactacggctggtggttttgctttttttctattttttgacttggatttttcaacggtgggttctcggcgcttttacaaattggcaaggccaactgtgcgcgagactgcattttgcccactagttttatggaaaatgcacacccacgtaaccatcaccaagttgtggtttgtctgatgattagtcgtaaatagggttgcagctagcagcctctcaccaggatcttgtcttgtatattatagcctctagagtttgaaaaatagtataacccctttttagtttcattttttttgtgtatttgtgtttttttaattatccatgcttatatagtcatggatgctaccagtactctgccagtcatatacttaaagatcgtacataaaaagcaagctagtatatcttttaagatcgtattcttagtaatctactaccttcatcccaatgtaataacttttggctataaatctgaacaactactatgatgttatccagattcatagctaaaaatacttatattttggtacggaggaagtaattaatagatattcgttttacaaactctataatagttgtttgtatttttttgaactctataatagttagttgtaataacttttttaaagtaaagatcgaattaaatttcactatgaaaaaaggtattcattatatttgcagttcaaagtatgaacatgagttaagacaatcggtacctccaattatatttttcatatgtaaagtagtctcaaagtaataacgacggtgatgtgttatcgatgagttatgcctcgataatccaatttgtacatatatggtttgtttggaagatgtaggaatcaactgatataacgatacaatagatattataccgtcttaaaatataaaagattttagtttttattttgagatagaagtgtcattcgttaatttttgaatttgtgccaaacatgaccgagcacatatttgtgccaaacactagtatattttaactcttttgtcatcaagttctgccattttggtttgttccctagctacttagtattgtatcgattgtgtagaaaaaggttgaagttaacaactttttgtagacttaattaaattagttgctcaggtggtaacttgttaatagagacaggcaactaaacgcaggccatttgcaaattgattagttctaaacacgttgtcacagatccaaccacaaccagagacttgtagcatcacttgtattgaccgcaagccagaacgagagaacaacaaagcaccctgactggtggttgctcccttgcaaacgaacatgatgcacttgtactaccttgatcttttgcacctaagaaatttcgttggacaattacgtgttccatccaagaattgcaccagcggcggatcgaggaaagaattttgacaaccacgttaaattcgtccttgcataagttgaataaattcatccaaagcaactgtgtagatcattaaccacctcatatatgcaaggtaataaatagtattagtagcgaccgttgtaacagtgtagcggacatctaccgttactgctagaaggcagcggactgaagatagcgtgttgaaacttagcaggtactgcagcgctccgcaaccattatagtagcctgttatagcatttcgtgaccgctatagcaatccactattaactttgttggatcgctataatgcttaaatgatattattcacatataatatgaaaactttgcatcttgtgccttcttctatattttaagtgaaacttgatgttaatattgatacacaatctaaatgtatggttattttttaatttcgctattggaacttagcgttcgttatctttaattcgctatctagacactagtcctctgtcaatctactatatcctatttattagtccttgcatatacaataacaacatagtattaggtaaaaataacaatcagtagacaaactcgtcagttaacttttctgacgataactcatctgattggaatagccttaacacatatagaattctttgagcgttttccctcgtacctatggaacaaagtcgtgtgtgcacgatcctgaaacgccgtattgccgtgggttgtgtaccaggttatggtgggaaactggatagctaggccaggtcaaacacatgaacacgtacaccctagtgaccctgcggctacacgcatgacgatatattcgattgatgcaaatgggtgcgtacacggtggaggtcgctttcccgtgtgctgtgcggtgcgtgcaatccatcactcatcgcgatccgtcgatgggtctagagatatgctagctaagctaacggagtacaagtcaagtcgcctgcatatgccgagatccacaggttggaaggcatcaaggaaggcaggcaggcaggcagccggtggatcgagtccgagtcgcgagcgtggacgcacgcatcgaccgatcgctcgctttgcttcacgtatagtttgcccggcacgttggttcgccgtgtttgcaacttcgaatgccataatctaaattattttctttaaaaaaaatacattagtcgctcatatacacatatcggcacactatattcctactactacaattaaagactggatcaactttgtcgaattcaccataagcgtctcgttgtcatcaaaaattcgagcatcgtgtcactagattaattccagtcaaaaaagctatagtaaatgtgagcacctatgtcaccaaacttgatttcggataagttttaccaacagagaccttactggctgagcgtcgcgtaatctaaattatttctttcacacctttatggaaacacacatacatctcttacctgatgagcatctctaagtatctcgctatcaatcaacacattgcatatcaatgataataacccgtaaacataattatccatgccaaacctataacttaaatccaacactactgtaccctacgccttaaattgttccccacgagggacatgaacaacatagggaaagaaaatatctctaccgtattataaatcaaacgtagggaaagacaacactccctactatcatttcaatttcgtatgaagaacctaaccaggtgggtcatggtcagttcgtatataaatcttaagggtgtgtttttctcctctttcgtaacttctattttcttgttttttatgtgcacatttttcaaattaggtgtgtgtttttttaaaaaaataaacattattttttaaaaaattatattaatgaaccattccgttttatgtgtcgagagggaagggttttgaaccctcaaaggaacccaacctaattaattaaaatgagaataaaaggtgcgtctctgtatgtgacatatcacacgcgcaaacgtaataacacccgttcaaattggggtactaaatggaaagagtactcctagttgttctctctttctttctctttttgttctttttgggtgacacgttatttcggtttggcctcacacaatcgctatctgtgtattcatggtttccggcggctacttgttgcgtctctggcaacttggattcgcttggcagttcttagccaggaacaggagtgaaccagcgataccgttccgatagataagaactgattgggttctgcaggtattttttttctcgaaaactattcgatctgcaggtaaatgtaaacatcatccacggatccggtgcaaggagaaaaaggccatgcatgtccatgcatcttctctgttctaaaataaaatatgaaaatgcccatcttctcgattcccggatgtgataatgtgcttgtcagtttctcgtccgcaacttctaataaaggatagagtaggctacaaggtgatgtatgagtcactgtttcatcatttctatcttcttaaataatgttacatcagtaatgtaattattgacaaaaacgtgtccctctaccaatggcgaacccataaaaaaatcaccagaatcctatacatgtcctaatacatataatactctaatttgcaattaataatatactgtaattattataagcttaaacagctaaagaatggaatatccggggtcttgtgaccccggctacaataccgtaggaacaccactgccctctacaacacacaccgatcattctgtttgcaacccacaacggtctgaagatgctccgctatggggatactgaacatcccgtcaataaatcggaacttccggtgttagtataaagggacctcgtcatggcacgtgctctcgatcggccgatgaaacctaggtagtagaaacaaaagaaacctagtgccaattctagaaaccggcaagaaaaaatagggtagcgcacgagattaaagtggatgagtaaaaggataaagatttagatatgtttagactctctcgacgagaagtaatgctctactcctgtttcaggtattgtatctaaaagaggttgtattgatctgaagatcttaatgtgtttatgccctgagggggctctttgcccaccttataaggggaaggatcccaatcgtacatgactcggtttcctcatatatttacataattgtacactactaagacttatggaatatgcctggataaacaagtctagtctatatttacataatatacatatatagcccacctcctatctttagttggatatgctatccatgcgcgtatacagtatctctgatcttcacacctaggtagtagaaataaaagagagaacgagattcaaagggtaaagggccaaggagaaaaaagaaaaggtaaaactaataaattgattttgtcaattggacgatgttttaatttaactataagatctattaagacaagaccacaccttctaattaagccaatgccgattgaaacaatagcccatcaataaaactaatatattatttctcttccttttcctttaaaatcgggttcaaatctgtttcaaaatcgacctaaatctttctaaaaaccccagtcctgaaaaagaattccaatccataactcggaaattctggttagggttgttttgtttatcaaataattccaataagaagtttttttttaagaaacgacggtaggagatctatcggaatttataagcataagagaattgaccctgtttataaggaaaaccaggcccaaaaaccatacaactgcactgtttactacggggaaaccggcaaaaacccacatagaagacaaagcgaaaaagcatgtgataaaacaactacgagccacataagagaccgaggtaagagctagaccttcaaagcgaagcctccaaggagggaagcaacgatagaagccgctgccatcgcccatccaaaactggattgggttttaacctgaaggggaagagagtcaaacaaagcgacacctccaaggaggacacggcacccacaggtgtcgatgtcgccgatcctggaatactaggtagggctttcgcctgagactccctcgaaaggtgcagaacctccaagaaaccagagcaaaagtgccgagagttatcgttgcccagctcatcggttagacccgatgcagtagctccgactccgcctaagcactaaaactctagcactacagaggacaaagcacaccgctccaaactcggccctatgacatgttcactagcacacaaggcacttgaagcacgggtgagaccaaaaagccctgaccacgaacaagttggaccaacttcacggacgaacacgtctcctcatccaccgatagactccacgaccaaggtttggaagcagaccggccaacagaagggtggagcatcaaggaaggcgaggaggtctggcctgctggaggaggaactgaaagttgaagacagggcaacagagacatcggagtcttccatgtttccgacaagatccaagaagagctttgtggcggaggccacatctccaccaagaaccatcgggctttgcaagagaccgtccctggcaactaagacaaccacctccaactttaccaccaacgcagcgaagagctggggcgagtagagcagcagagcaactagacaactaggtgggaaaaagaggaagggaggaaaaggaaggggtgggaggaggagaggaagggaggtggcagcagaggtgggttgggggaggggatggacacctggagaggcgccagagtcgccacggtagtctagagaggcgcagagtcaccaacgcgccctgacgacgaccgtcccaccggaccatcgaaagggcgacgcgtgccagcctccgccacccgcgcgcgccggcctcgcccaccgacacacactgcagcgccccaatgccggctacacgccatggcgtcgccacccgcttcgaccaaatccagcctgtggcgggccagatccggcgactgcagtggcggatctaccgccgccttgccgggagggcacgttgctgccactcctcgccgtcggcgctcgccgcctcccccgcgcctaaaaggatgtgccgccgtcggagaaggccccgtcgtcgccctcctcgctcaccagctggctttccggtggtgagctctggcggcggccaggggggaggcggcggcgctgggcgtttcgccccccgtgtcgcctgcacaagggcgacgtggggagatgcgatctcttaacgaactatccaataagaagtttcgatatgaacgacggaagttccagaaatactgttttctggaaattaaggtgctagattctgatgtaaacagtaatattttcatacgtagacagtagaagtacaacatctaggaaaataatgggggctttcatgaaggtcgcttgtgtgtgtgtgtgtgaattgagctgttttttttttggatatttttatttttcatccaattattagatgctacgtgaaacgcaaggatcgttacgtggtactgtagtagaatattgtttggaagctgctggtggacaatgaaatagcgcgtgcctgtagtaattctcacagcagacacgcgtggcttagtcaccgttttgttggccacatctaaatttgtcccttgcttcgttgcttgtacatgcaactttaattaggctagctaaattgcatgcatagcaccaggattctttcttggaaggctatagctaggtatgtacactttagcggactagcggtggaagttacgggtgcagaacactgttcgtccgtgttgatatatcttagattgacaaaattagggagaaatttagaggttgttagacgtccaaccattgagaaaagaatggctgccaactcattcttgatcgtgatcgaaaagagttgcacaagcaaggccctctatcggttgaatctcatcacaactcgatcccacctcatctaaaagaacagtaaaattatcagctcaacggattgaacagaaccaaccagatactagctgagcaaggagatttataataatacttccttccgataaatttgatttatcatattaaagaaaaaataattatattttattttattacaaattgatttattatcaattttattcaagaataacttaaattctatatttgtaaaagaaattgaataaaacaaatgatcaaaagtttgttaaaaattaatggcgtcatctattaaaaacgaagatagtatcatagttgtagagtcaggccctgctttgatcccaaccaaaaattttactccatgtcatatcaaacgtttgaacacctgcatgaaatattaaatataggctaaaaataactaattatacaaattgcgactaatttgcgagacgattttttaagcctaattgcttcatgatttgataatgtggtgttaaagtaaacatttgctaatgacggattaattaggcttaataaatttatctcgcgatttactaactaattatgtaattagttttttattgcaaaacacccttacgacatcatactagatatagtacaccaaaactttctgaatctaatcaccccttatatagaaaaagttttacgtgtcaaatagtgggactacttttgtgggccagagcacgtgaggtgagacgaagaaaccgatagtggcacaggggtaaaaacctctcgatgcgggtggcttgggtagcggtgcggcaggcacggcacgggatcggatccagatcggatgcggcgtagtagtaggtgtccatgcctatccccgagccggatcggacatcggagcccgactccgagccgatgcggcccatccaaagcccacgtgtcgccctcgttgcgaccgagacgtcgcgctgcgcgaggcctactccttgtgggccccaccggctgcgtatacgaccggaggtggggccccgccgcgttaaattccgcgcctccgcggcgcctgacctcgagtggatgaaaatgcccgttttgcccctcctgtcactacggtgccacgtctcaggttagagagggtgtttccgtcattacgggtgcaaatgcgacgagtgcacggatttggcacggcgtggggtaccggagtttatcgctttgccccctgtctttctcgttaatcagttgcctcggcaagacgtgggtccaggtccgtagtggtaattatggcaaagtagaagtactccctccgtcctataacataatggatttcgaggtcttactcttattcaatttttttaattattatttatttttttacttactttattctccaaagtactttaaacacaactttttattttttataattgcacaatttttttaataagacaagtagtcaaacaatacaaacaaaaactcaaaattctttatattatgggacggagagcaggggcagagctacagtataagaatcggtgtcaggcgacaccgacgactttcggtaaaacctatagcaaaactgcttatccatatattataatatcatgatctaagtataattagtatactataacaccgatagatatatcatgatactaacggaccgatttctggatccgccactgacggagagagtaccatagaactatggagtactgtattgtattccatggagtaatagtgttactggtactgacgactttgtttggtggtgtcacagcgagatgggcgaaaaagtccgtttctaaacttactggatcgttgtggaaaaaagagcaggttatggaaatattaaacggtttatttttcgcgtagattagggtagcacacgggacatgatgaaggcgcggcgacaaggatgaaattacttatttatcgtggtagactaccacgttaataaatctggtcggtgtaaccagggggcgtggtccacgtgagccggacgtggcttggatgggcattccggtcatttcagtcgacgtggtacacacgccgtgtcaacacatgtaaccaagccaaagatgctcgcggtagagttgggacccacatgtcagtataggagcgtccgtgggcaacgcaagcgccgacgccaaggtgatcgatcttcttcttttttttctctcttttgtttcttttcgtttcgcggatgttccttgtgactttagcctatagcaagcaacccatcttatcttggattactccatgcaacttggcggtgtaggacaaattaatggcgcgactccatcgatgggggtctccttcgccgctgtacgtttttctctccggcgcgcgcgcgcaactacaaagcacgcgcccaccaccaccaccacgaggcggcaggcgcagccggccggagtccggagagtacgcaggctgcgaaaacgaagggggtgtttagattcacaggtttaaatttttgacgttttatattggatattatatagtgtgtcgtattaggtgttttggcactaataaaaaactaattataaaatccgtcagtaaaccgcaggatgaatttattaagcttaattaatctgtcattaacaaatgtttacagtagcaccatattgtcaaatcatggagcaattaagtttaaaagattcgtcacgcaaattagtcgcaatatgtgcagttaattatttttttagcctatatttaatacttcaagcaggtgtttaaacattcaatgtgacagggtgtaaaattttagggtgggatctaatgggctgtttagttccaaaaatcttttcccaaaaacatcacattgaatcttcaaacatatgtatggagtattaaatatagataaaaagaaactaattgcacagttcacatgtaaatcgcgacacgaatcttctgagcctaattagtctatgattagctataagtgttacagtaacctacatgtgcctacatgtactaatgatgtattaattaggctcaaagattcgtcttgcggtttccagataacgagttatgaaattagttttttcattcgtgtccaaaaactccttttgacatccgatcaaacgttctgatataacactaaaataaaatttcatttcactaactaaacatactctaaacacccccaagatgcgtttgcctaacggagctggcccagccggccacgcacatatcactggtgaagaaaccatttatactctcggttggtaacccccctttactcccggttggtgttaccaactggaactaaagagagggtagcgtcagtcccattaggtctctttttttcattgttttttagctagagtttaatccctgtattttctcccaaatcaagtgggatacatatccccaaatcaaacctcaaatcaaagtaacatcccaaaacattcacatcacaaatcttaagttacttatacacacaaatcaaatacatcacaaatcttaaaaaaattacacacaaaccaaatacatcacagattatacatctcagatcatgcaacaaattataaaattatacatcttagtgaatcacaaattgtaaaaaaaaaaagatgccggcagcgtctgccgcctaccgccgctcgccactgggcccgtgcgcggcccagccggccgcctgctgcgtgggaagggaaagggagagaagagggccggggatgggaggggaaggggaggaggtggagggggagga

SEQ ID NO: 46814 - DNA, 2446 bp, Oryza sativa
atgcccactggagccaccaaccgggactaaagatcatctttaatcccgatttttagtgggaccgggactattgtgaatttcggccgaccgattaaagatggtttatccaccacaccagcgtatgcaccggcggttacacttgccaacatgctagctagcttagctgcatctcgacacaaattgggcatgtcaagtcggtgaaggaacgtccttcacgttgcccaacctgccagattacaccaccgatcctatctatctccttcgtcgtcacgcggcgtagtggttattttctggcaccagcaacgtactggtggtgattattcttccagaggagctcgctcgctagctaactagtaggcacggatttctctcttttttgcatgcaactgggaagctgtagctactagtcgtcgtcgtcgtcgtcatctactgatctgcaacgaacttccgccaccgatcgatcacacagctagcacagctaccgctccgtcgatcgaaatcattcatgttgacgacatgttcatcgcgtaccagctgtattattgtcgccgtaaatttgattaagctctgcaccactggatcgggatctcatcctacacgtcgctgcgtacgtacggattgcaacttgctataattgccaagtgctgactcaaccgtcaccgtccaagtgtgtatatacgtgcctactggacgtatcaacagcgaatccagctagcagtacgtaagtcaattatggccttgtgtagtttccaaaacaaaaacttttcatctatcacgtcgaatgtttagagatatatatatagagtattaaatgtggataatttttttaaaaaataattataaagtttgcgtgtaaattgcgagacaaatcttttaattctaattgcgtcatgatttgacaacgtggtgctacagtaaatatttgcaactgacagattaattaagcttaataaatttgttttacagttttctggtgaaatttgtaatttgttttattattagattacatttagtattcaaatatgtgtccgtatgtccgatgtgacaaccaaactcaaaattttttcccaactaaggcctatattcctttggcacgaacaacacgtaagtactgtacttaatcacgtagcttaagctagagcctgtagaactcgtggagacgatccatcgaccgatctcgattcaattcatcactccttgtttttcttgtcttggcttgcaagggattaatggatgtggatccttctgtcgtacaagcatatgcagttgtaaaatatctctctaaaatttatggccggtgcttgtacatgtttagaaaacgaccaaccttttaaagtctctcgcaagcgtgccaagaccaatcgaatcgaaccccagcaattgatcgatcgatcgagccaacattgcacatcaagcaatcgtattcaacagtggatgcatgtttggttagttgggttagcagcaaatggaggtttgagtatagtactactaacttaattagtacgtttgccattatgttcgtcaattgtcacgaagccaacaattagtgcacacgaaaggtacatatggccatctgggagaaactactgctgcagctgcatgcacaccagttttgcttgtctgcagatagggtcactcgttatgatttgaaaattaaaaacattgattcaacaagaggacaaatggataataatccactgcagagatgttcttctcttctcttctcttacgaggctaagggcatgtttagtttgagaaaaaaaaatttggatgtcacatcatatgtttgaccggatattggcaaaagagtttttggacacgaataaaaaactaatttcataactcacctggaaaccacgagacgaatcttttgagtctaattaatttatcattagcacatgttggataatgtagcacttatggctaatcattaactaattaggctcaaaagattcgtttcgtgatttcccccctaactatgcaattagtttttttaatctatatttaatactccacgtatgtctacaaagattcgatgtgatgtttttagaaaaaaaaaattaggaaactaaaccaggcctaagaacgatggtttaaaacggttggttatctatgcactccaatcctagtcttgaattgatactactccctctgttccaaaatataaagaccttatattttgggatggagagatcacttatatttattacattatttgactagattttgacaagaatttcttataaaactagtataaagttgtacccagacaaattccaaccatccaaaagcctttgatatatttattttgtcactgacatcaagaaaaaaaattaactagttcaccatgtacaaaacaaaagaacatgtaaccaataaatattaagatgattgtttggtttttggtcaacaattttatttatcaaataaagactacaaatatgta

SEQ ID NO: 46815 - DNA, 20686 bp, Oryza sativa
  unsure (1)..(20686): unsure at all n locations
agtggcctataaagagaacaatgaagaatgtgaatggtgtttgtgacttgctgtgtagtgatctgagggttggtgatggaagtggatcggtcttcatctctgaccaatagaaggtaatgctcctgatccactgtttgcttttatgttctgtcaattctgtcattacacaatgcatacctaatgtcttgtgcatgttactatcaaatgcagggaataattaatgctgtctctaagtgggctccagaagctgaacacaggaactgtgccaggcatatctatgccaattggaagaggcacttcaatgataaagtgtttcaaaaaaaattctggaagtgtgccaaagcatcatgcagaatgcttttcaacttgccaagagcaaagctggcccaactgacccctgctagagctcaagcaatattgaacacacacccagagcattggagtagggcttggttcaggttaggatttaattgtgactctgttgataacaacatttgtgaatctttcaacaaatggattcttgaggctagattctttcctatcataacaatgcttgaaaccattagaaggaaagtaatggttaggatccatgaccaaaaaaaatgttctaatagatggagtactgtcatttgccctggtatacttaagaaacttaatgtgtacattgctgaatctgcattctgccatgctatatgcaatggggctgacagttttgaagtcaagcataatgagcataggttcatagttaacctagatatgaaggagtgctcatgcagatattggcaattgtcaggtttgccatgtcctcatgcaattgcttgcatctactatagcaccaacacactagatgggtgggttgctccatgctattaagtggaatctttcaaaaaaaacctatgcccattgcctgcagccagtagagggcatgactagttggccagatgatcctagagagcctctcaatgccccaggatacatacagatgccagggaggcctaagactgaaaggagaagggagcctaatgagccagctaaacctaccaaagcttccaaatttggcacaattatgaggtgcagatcatgcaagcaacctggtcacaatagcaagggctgtcacatgcacagtggggcaggtggtagcacatctgcagctgcaacatctgctccaggaaatacagtcactgcaaataacaacttagtgttgtcaagcacacctagcagcattgcacaaagcaggaaaaggaaggcagctgagctcagtactagcacatctgcttgccacactaggaagagaacatctcctacaaaaaaggtatgtcagccagtcctcattcaattaaacttttgaaattaacattcatttgctaacaacacttgtttcttttccttccagtcagcaaacacaaacagttcacttgtgaaggttgcagccagtgctaggctggcaactgaaagaggtggttcaaccagtgtgaaacttcaggccatagtgccacactctcaatgttcttcttctgcttcaatgaggatcacttctgagaaagcaagtgtttatgtgcaagctcaagaaccagccactaccaagcccaagaaaacacctacaggtccactgatgctgattcccccatgggaaactgacaagctgtgatgccatattgtgctaactatgcaatgttatgtgctttttgtgtattttggcagactctaagccaactatgcctactgtgaactttatgtaatttggcagactcttagccaactttgcctatctgtttagtttctgtaatttggcaaactgcttgccaactatgctgtgatatgtgcttgttctggcagactgtaagccagctaagctatgtggattgttatcatctaaattgagtgactttgctcaaatgatgtgtcatagcctaatctgatatgagatggtatttactgagctgatctgatgtgatgaattgactcttatcaatttgttatgctaaaatttatgtgcaaagttacgaatactcagccactgcaaaagatgatattcagtcacaattcaaccaaccactgcaaagtcagctcaaatatatgcaatgtcagtgtcattactgaatatcaatcacaattcagccaaccacaaatccattcacttaacttagatagtcaaagagcacagctcagtttcttggcaaaatgcagcaaaatgctttcagctaccagcattttgacacatagattaacacattgcacctcacagctgaactaaaatcatagcaaacaacacaagcatgcatcccaacgacatcagtacaagccaaactctctgtttctctagcctactgttacttgctctcatagcagccatgttagcttcattctcagctgccacaatcctcaattgtgccacttcattcattgctacccctaattctaggcactgctcttctacctttggcctcagttcttcaacacaatgttgcagctcattcttctcccttcttagcgataacacggcttcatgaagatcgttcaacagctccctcaaaaaactacttgttgcaggctcataccagtcaaaaaaatcgcagccggcgccctgaaaacattacatcccaaatcacccaaccatactgccagctcaaacaaaaaccaagcaagcaaacgaaatcttcatcactcacccgattgcggcatcggtagtaccatcgaccagggttgtccacnnnnnnnnnnnnnnnnnnnnnnnnnttcgcaccacatcggcacatcaccgccggctgataatcatagggcccaactcgcgccgggatgggagcacgactgctgggatgcgacgaccccgacgaccggtcactgcaataactcgccatcgcctagcctcacctcctcttgtcgcccccgccgccgccgccgccgcttccgccgccgccgccgacctaagctagggtttcagctcgagaagaggaaaatgtcgcggcaacgcctggaaacagcgaggacagagcctttaaccccgtctattaactccccaatggtggactaaccagtgggtcccacagcgcgacacgtcaacaaaaccgggcaaaaactgagtcaatactgccgagggaccttctacggacggatttagtaattttaggggtacacatttctggtattctagtttagggaccttaaaaaatctcggatttagtaattttaggggtacacatttctggtattctagtttagggaccttaaaaaatctcggtgtcaatttgagggacctccggtgaacttattccatgtaaaaacacgaggcctgggagatctgcttaactccagtgtaagtccagaagcttgcctttaggtgtatgagcgtgccagttgatttgatcctgcaatcaacaagaaacaaagacaaagaaaccacggttaaatccataaacgatagccgatcggctaattgccgatgaagtatcatttatcttggagccgatgtcatatgtggatcgatcggcaatcatgaataagtaagaaagaactaattaaatctactcgatcagttgtagatattaacaatatataatccttatgtcgctatatacttaaatcaagtgattgggattgatctgtcgccatgacgagacagtataaatcacatagatcgaagtatatgttaacaacgagactatatatgttcatagcatagccgatcagatagatctagcatgtataggctaatactccgataccactctatatcaagatattaaggcaagtagaatacaccaaacaaaagcctaatatacttaagggcagatttaacatgtcaattaagcatatgagaaaatggtagttaaatcaggtaagatcggctgaaactctgacgctaccctaatcggcagccaaaggcagcctagagattgagattctaatcatcactcataagattaaactcaactgatgcagctataagtatgaaaagaaggacaatatctagacaatcaagtcgttggatgtttcatagagtggtagatatcctatataatctaagtcagcatcgatatttaacctaatcggctgccttctagtaacagacgttagccgattagaggttagatagcgatattgccagagattatataagatatatgaaaactcgacgaattacataaacaagattagtgtatcataaagatggaagcactaatcccgagaacgcaagccgccataacgagttttacctctagttgaagatcgaaaccgatgcagctcaacccgaaagcaagaactcgtcaaaacaaaatgaaagtaaaaagggtggcgatgcgccgagattgtagtgaacgtgtgttagttcgattatatggggctcgggtctatttatacccaaaaattacaaaatatgtccatatcggacacgtttcttatctctaacaaactctaagataccataagtctttgcagcagacttttgcccaaacatatctctaaggaaattacataaaatatcctacttaatagatacaattgccttcttaggactctatccatgtgtggcaatcatcatgaagcacgtcattctaacccgacaacatatgccgtgtcatattgtcggattcggctcaatcggctaaccctgtccgactaacacatgccccccaagtccagaattttggataatgtttcggatttgccatacgtcgactgcgagagaatattgcacttgccgttttccgaccgttattccaacgctttaaatactaaccgttgtccccgagaaatctcacaccgtttcctccgttttcaccgccgaagcaaactccgtcctctctctccgatgatcccctcggtgcacgaagcgattcccaggcgatttcctctccggccaactttctgcccacaacgatgtagacctccgccagtccatccgccgcatcttcaaccgagtacgcagaggtaagtttccattggctagatcctctcttttcgcatcagattagttttccctttccttatcttgttttcttcttctctgttcttttggatccgtagcaactttccaatctgatcgcagttccgagtttgtcgcataaaaaccactactttcttggtccaatcggcaatcccaatcccactgagtttatcattggtgaaaccaataggatccctttcagattagctaacccgaatctaggtcactggaagaatacttttaaatcttggccagccctcgagaaaacttcacccgagaaaagctggaccacatggtacaagcgtgtatcggctagcaagcaaacacactgggatgagattggaatcggtcaagcacttgcccttaccatagcgaattcggctaaggatgaacccctaatagctgccgccacctatttctcgtccaataccatcaacgcctttttgttgaaccaagggccgatgacaccaaccctgatagatatcaccatgatcactggtctagatgtgacctcatcggctaaccctacgagtctgaacaccaagaatcaatatgacttcaagaccaagagcataggcggttggtctggttacgtggcagcatatatgggccaaggatctgttactgctcaagaacacgtggcctttttgctcatgtggctagaaaagttccttttctgtggatccagttgtggtcctacaaccaactggcaatttgtagccgaggctctagaatcaaaaagacaatttcctctaggcaaaatcatcctcggctacctataccaaatgctgaacaatgcatcgactaagatagtcgtcggctcagtagttggagcaggtggaccatggtggctgctgcagacttggctgaatctggtagtcatgaaagctgtcaatcggccatccgtgatagaagccgaattcccaagactgcagccgattgtagaagatgatggagaagaaagcactcatcgtagatgcatgtcatatggagaatatgcattcacaccagccgatgctggagcgaagttatcagccgagctgctcaaagattggttctgcagcttctatgagggttttcaaaaagatgctcgagtttggtttccttatgaagattcagtgcatcttgatctcccatcagactttagattcgaagatatcaacaatgaaaaatctcaaaaatctaaagaagtcttctcagctgcgattagcccatgcattcttcctgtcggcatacatcaagggaggaacattcaggtttcctatgaattttatcactcgatgagctctgccagaccacttgggatgggtcaactaccaatcggcttgctctttgctgataaaattcaatgccgaggagaaatctcatcaaccttgatgatggatcggctgctgaatatccaaggacctcctttgggcagcattgaaaatatagagctggcaaggttcaggagcaagaactttgacagatggtggggtgaatggaagctgtatttgttccaccaaccggcctcaatatatgtgacagatctctttcctaatgttatccctcaggtaaaccttgacttcattaatttcttttgaacaattgtcagccgattcataacttgactaatcttctcttctgttttgcagacaacagaatcttctcctccacaccaaagcaatagtggcagagatatagagtatgccccaggcctcttgccaaatggtggttgaccaacccctccagttatcagctatcatgcccccaagaccgcaagtctgcttcaagggcagatgatagagccagccgataccggcaggaagaggaaacccagggcaccaacaatcgatccattagttctggctcctaagaagaagactaagaaacaaaaacccaaggtagctgatgatctgcctgccctagatccatccattgagcaagccttggatgaactagagattgaagaggatgttgacgaagctgcagccgaggtaagtgatacagaaagaactccatcggcttcacctaaacagactcctccgactccttctactccagctcacttctctagggtaaacagctctctttaattccttcttccaattgttttattcatagttgattactcataaatcttgtcttttgcagaagaagaagttcgctgtgaagaagaaatcggcagcaacccaatccaaaccaactctgccggtaagattcttctgaaaatatttcagttccaatcatactctatgtggactaacatctattttctttagcctcctcctcctccttcacctcctgtacagcatatgtcaagtgaatgaactccatttgctgtaggaagccacaatattgaggaagcagaacaaccagccgctcctactatcccagtaagtttccttttgacacaaggatttagatcggctatatctatttggcatctaattctctttgaattatttttgcaagccttagccgatctgttctcttttgatatcaaggactacttatagaagaggacaccacaaacaaacccttagctcccttatccgatgatgtgaagaagactcttgaagatatttctcatcagctagaggcatcttctctagacaccttggtggtagattgtggatcaattacgactcggctacacgaagttcaagctctgattcctgaagaactagccgatgtcctcactccagctgcttatcttgaaaagcatcaattcaaactggagaaatgacacgcccagaaatttagcccaaatttccagactattttgtgtattaaatccctgtccaggaccagccagggtacacaaaaagacaagtaatacacagttccaaacgtaaataaaagcgtaaatacttacagaagaggcacttagtcctcacaccgaaacgaaagcagcagcagcggaaaaaggctatcctagcggggcttcagctccactccacaggcaaaactcaactgaggtctgagccttggtcttctaacttcgtcttcagctcagaagcactacacttctgaaaaagggggaataatagcaaggctgagtacaaccaccgtactcagcaagccacaccaatgatgcagacgtgcaaggggaacacaaggacggtttgtggctatttgtataaaggcggttgtaaaacattttattgagcaaaacagtaaaactgttgagtaattaaggtaatattaaatctccactgatcaacgctacaccacgttgaacaggcccaaccaacccacctgaactacagtgcattgggttgatttattaaggtggaactaatcacggtgaatctggtcgaccgcccataaccgcaggcacggctattcgaatagttttactctgactagaggtgtacaactgtacccaaaagacacagccccacgacacgtttctgtgcgctgacatgccaccacgaaataccggaaagaggccgtgacaggacccttcgcataaccccctctaaccgattgcaccacaccttagggttcgcccccgtccacagcaagcaacgggtagcccccctctcgtgccgcggtgaatccggaagccaatcaaccggaaattttcccttaaaaaccattggccgagaatattttgcaatattctttgtgccctaaaatactctctgaaatttcccgtcaattttcggagctcaagagataatttcaaagtcacaaagatcatttaatcaatttaaataaaaagaaaaacaaaataaaacctcccttcctccttgggccattttcggcccaagtccctttcccctcccgcggcccgctcaccctatctccctctctcggccagccttcccttcctctcacgggccgtcgacccgtcttcctcaagactgctttgcgtccctgtgccagcctcctccctcctcccctcactgacaggtgggacccacggccccacccgtcaggcccatccccttcctccggctccaactgtcgccatggctgcccgagccaccccactccgccgccttttctgtaccaccccgccaccgccgcgatgccaccggaggaggacacgaggccggaggtcgctcagagcggcggcgagggatggccagaggcggtaaagatggttgcggctcgggttggcagtggaggtggaattccaacgatggaatggggaaacggagtggagaacgagcttgcccgcaaggcggcgaagccggcagtggaggcggcacagcacagcggcggcgggagcggcggtggcccgtggctggaggcgacgagaggctgttgtggctcgggtgcacggtgaaaccggtgcccgggtggtttattgcagaagcggagcggtggacggggtgcggcaatgcgtggcgaggccggcggcgcaaacggcgcggcgcggggacggcggcagcggccagctggagggtcgtcggcgagcggcggcacttgggatcacgtgggaagagcgggagagagcgcggggagtgcgggaaagttggggaaaagggagaggatggccgggggagtgattttataggctcgggagggagtggctcgggccgggatgggcggcaacaggcatcgaagtgggaggcgacgtggagctcgtggggaggtcaaactggtgccgtttttttgggggaaagtgggggaggagagtggaggaggtggaggggatgcggtttctcttgattcggatgcggtttctcttgatacggtgtacctcttcgattatcctttgctaactcttcctgggttgacggactattaggccatgcaattgcttttccaaatatactgcaatctgaacgtctattggaaactgcctttgatgttgccgagaatttctgccctttgatcataacaacttcacatttgtatcttcggtaaagatgatccgtcgagaagaggttctctgccatacgccctgctgattacacctttcgggacttgattcttgtatgctgctgacccatgtatggaacaatttctaccaacttccgagaaacatcatgatgatttctagaatttatattagttgccttgaactaaggaaaaccatccatgattcataatcacaccactaaggtgtaattattgcatagttaatttctcaaaactgaactgaccgactctgcattggaacagacgcagcttgacaaagatttgtaacgccccgattttctttcgggattaaaaatcatttaataatgcattcctagaaattaaataaaatttaaatcaatttaatcaagtgaaataatgggagaattaaaatttcctttaaaaatcattggccgagaatattttgtaatattctttgtgccctaaatattctctgaaattttcccgtgaattttcggagctcaagaagtaattattataatacaaagttcatttaatcaatttaaataaaaagaaaagaaaataatcttccccttcctccctttcaggctcggcccaaattccttcccccttcccctccggcccggccgcccataaccgtctttgggccgctcggcctgctcgctcccctccccctccaagtccacttcgcctccctcccagccttccctctccctccggctgacaggtgggacccatgggctccgtctgtcatctcctacgtccagccaccccacagcaacttccatggccgctgaaaccatcccactccgccgcaaaatccgccatctcccgtcccccgtgctcgcgtctaaccccacttgcttccccacgtcggcatcccactccgccgccggttgccgcctctcccaggccgccccgttgccccgagccctataaaaaccatccccgtgccatcctctctcgtttcccctcctcacccaagctcgtcgcgctttctcccgcactctccacgccgcccccatctccgcggctctccggcgagctccagccgccgccctcgccgccgccacaccgcgccgaggccacctccggcttcgccacctcacgacgcacatcggtcgtcgctcattttccctaaacaatcactgttacaccgcttcccccgcaaggtcgagccatcgccgcctgtaccacctccagcagccgctcctcgccgctttaggcaccgccgagccgtgccgccgcaaccgccagcatctcccagccgagctccaccccggcccttactctttttcccctatccgcctacgaaacgccgccgccacgctcaccacctctcttcgtcgccattgccgactccaacggcgtcgcgccgcctctccggtcgacgccgacttgcgctgccacctccttcggcttcgcagggacgagggcaagcccggccaccactcttccgaaacccgccctcttcgctctaggtgagctcctcctcatgtgatcgtcgtcagccgccgttctcggtcaccctgcaccaattctccccttcctaaccctcctaccatctctcccaggccgcgctacactgtcacgcccagaaattcactagtaatttcagaacttatttgtgcataaaatcctcgtccaggaatcagccgaggtacacaaactgacaatttaatatacagattcatcaaaaaaaactaaagcaaataatacttactgaagaggcaattagtcctcacatcgaagaaaactacagcggaaaaaaaaatctagcgaagctcaggctccactcccacaggcaactcaactggggtataagccaaacgtcttctccttctggatcatttttcttcaactgaggtttgattgataattacaaggtgagcatatgacatactctgtaagccacacatcaactatgcaagtgcacaaggataccaaagtatggcataatataggctcgtttgcaaaagcagcatttagcaaacatttaagagtagtaaaacagtagagtaattaattatcaattttaatcaacactgcatagcaccccaatgctgcacaggcccaaccatcctgtacaaccatacccggctgtacagatctaactccaaacttggagctaagcaaattattaccagttatagcacccataattattgtgagaggtgtgagactaatcacgaaaaacattgctcaactcgcccatgaccgtgggcacggctattcgaatagttttactctggccagaggtgtaccactgtacccacaagacacagctccacgacatgttaccatgcgcctcaataccaccacagtacatcggaaaggaaatgtgacagtacccctcgcacaacacaactcaccacagttcaccaatcctggatcataatcacccctaaaaaaaaccagaggcatggactccccagcgaccccatggacttctcgccgcttctcagtctggtgccccgcaatgaaccacgctatacgaaaggtaaagccgctacccacgctgggttgaggttggcacggttaatgtctcacaacagtagctcgcgaaccggtccttaattgtcatgagcacgaccttcaaaaccatgtgctcacaacccaccattgtcaagttttaattatcaattaattatcataacacgattaaccatcgtgagctaccattaaatataaccataaataataatgtagtttgattcatcccattagtgagctaatgtttctaagcatggctaagcaattatgtatatagcaattagctgaaccaatccaatatataaggtccaagctaatcaatttattacccatatgaaaataaagtcatcttcggccataattaattgagaaaggctcaccacccgatgacattcgaaaataatgcataagttgaaataaaacaatagctttaagtaggttcaacatgctcaaagggttgtttgggatctgtgtgacttgccttgcaataatcggtcttcaattaatcttcttgaacacttccgacgcactcacgaaccttcgcaatgacggaaacgataagctaacacgtaaaacgaagaaaaagactaataaaaaaacaaataaacagtgcataaaaagtagacaaacatgtagatcatgattttagatgaatttagagacttgaaccacttaattccgacttcatatgaattagttatgaattttacaagattaattccaattaaacctattaaagaaaagactattccaaattaattaaacaatttacatataatttataactgagacataagcctaaaccatcctccggaaattattggaatgaatttagtagacgacatatagtaaaaagaactaatatgccattgaaaagggataacaggatttatattgattttggacggctgagatcaactttgacctagtcgaccaaaattggatggctcggattgatctgatctaaggttttagatggctgtcacgtgggatctgagagacggcgtgacacttagatggtagggacggcagctaacaaggcgatgacatggcaaccatgcgggatcgacgccggcggctctattcggtggtgaggacggcaaacggcggcacaacggcggaaaccgagagcacggggatgaagaggaggacacgacgatccttactaacacttacgcagcgatgaacagcaaaggagatggccggcgacgagaacgggagtgacgacggggtactgatcgatgatggcggcggagtttcagcgacaggagacgacaaccgaggggtgaacgggcttctcctcggtgctgcgaatccaatggaggcggcggcgaccgaaggcgacgacgaacggtgcgagtggagatcaaaccatggcaacaacccacgggttcacggtgacggcaaccttccggcgggatttggcgcaaaagaactggcggccgtggtagagatcaaccttgcggagcagagggaagtggcggcactgatcgggaacggccggcgcgacgggaaaaggcggctggagatggcggccggagttggagagagaaggcgagcgtggggaggcggctagggttagggaaaacttcgggaaacagagggaaaccgaagaggaggccgaggggctgctatttgtaggcaaaggtggaggagatcggctcgagaacggatgaattcggtgaaggaagttaagatttatcccgagttcacccggataaaaacgactgaaattcgtgagatagataacgaattttaagggagttcttggagataagatagaggagatagagaggaatccgtttttgcaatcaattttggaagggaagcaacggatgcatcgaatttgatggaggacacggcggctctcgggaagaacacggcctctggacggctggctggagcttgaagacgcactgtagcaggagggagggcaatacagactttcagctgggcttcattttccaaggcctgattgaaggagggacaagaaatggacttcggaaaagagagggagagggctgcaggctgagaggagactgggccgagagtgagaggacttttcctaattcggcccgaaaaggaaaaggggaatttaattacttttccaattaaattaatcaccaaaatgatctttgaattgttaaaaatacttccaatgctcaaataatttcaagaaaaatcctgaaactaattggacactcaaagtacttaacaacgttataatcagaccatttaatgattaatttattatttaaataattgctgaactgctctttgtattattaaaattaagaattgagctccgaaaaatccgagaaaatttcagagagtataattaaccatggagaatttaatgaaaactaaatccagccatgctttatatttaggaaattttatttcctacatttagcttcacttgaaaattaatgaacatttaatataaattctaaaaataatttattaaataatttatgaaacctaaagcgaaaatcaggatgtgacatgcacctcggctgcttctctgccttcgccggaaaccgtcgggccgccatccgtgccgcctccccgaggagcgccgtcgctaatcctcgtcgccgactgccttcccgtcctcgcctcatcgtcccgtccgctcggtgagcatccctccctctccctctatctccactttgccggccatcgccgtcagcgaccatccggccgcgcgccgccgcctctcggccggctggcgccgctccgccgcccgtggaccccctgtggtccgggtccacggcgtctcctgggccgcggtggacttggtccaccgtgtgccaacccttgtagccactgacgtctggggcccacatgtcggcgccggcctccccttcgatgacgtgagcgactaccttttccctttgaaaaataaatagtaattgcgtcataattcgataataattctagaaatccatttaaatggctcaaaacttctaaaatttatatctaattcattcgaactccaaattgggccattcaacttgcaaaattcatctaaaattaagatctacatgtttgtttactttttatgtactgttttcttggtttttattagagtttttccttgttttgcgtgccaacgtgtagaatccgtcgttttggaagtccacggtcgcgaggaaaagagttcggaagattgttttgaagaagcaaggtaagtcacacattccccttgagcatgttgatcccaatttataaatgttttaccgtttacaaataaacatgcatgtcttgctaattacatgggatccgggtactacctatctgcttgcttgtgctatgtttacttgatatctgtcttttgtcaaccttgggtaataaatcgactagctcatgttacttatgtgacctagctagaactatatgcttagccatgcttaattaccactagctcagttgatgggataattacagtattagacctttatagtatcagaatgagctgcgtgcttgagacatctggccatgctttatggtcgtaattatccaactaaaatgcgactgaatggtgggctgcgggtgcatggttttgctagttgcacccatggaaattaaggaccagttcgcgggaaaccctggaagaatttatcatgcttaccacaagccagcgtgggcaacggctgggcttgtagtgtagctttcgtctagccaatgtacccaggcgagggtgggcgtgatggagttgggtcggccggggtgtctggctgatcggcttccggattcactaaggcacgagaggggggcttcccgttgcctgctggggacgggggcgaaccttgaggtgtggtgcgatcggttagagggggttatgcgaatggtcctgtcacggcctctttccagtatgtcgtggtggcatgtcggcgcatggaaacgtgtcatggggctgtgtcttgtgggtacagttgtacacctctggccagagtaaaactattcgaatagccgtgccggcggttgtgggcggtcgaccagatccaccgtgattagtcccaccttaataaatcgacccaatgcactgtagttcaggtgggttggttgggcctgttcaacgtggtgtagcgttgatcagtggagatttaatattaccttaattactcaacagttttactgttttgctcaataaaatgttttacaaccgcctttatgcaaatagccacaaatcgtccttgtgttccccttgaacgtctgcatcgttggtgtggcttgctgagtatggtggttgtactcagccttgctattatgccccctttttcagaagtgtagtgcttctaagctgaagacgaagttagaagaccaaggctcagacctcagttgagttttgcctgtggagtggaactgaagctccactaggatcgcctttttccgctgctgctgctttcgttttggtgtgaggactaagtgcctcttctgtaactatttacgcttttatttacgtttggaactgtatattacttttcgttttgtgtaccctggctggtcttagacagggatttaatacacaaaatagtctggaaatttgggctaaatttatgggaatgacaagaaagccatgcaaagactagccaaacgccgagaacgcaaagagaatgaatctaccatctaggccaatcggcaactcgtgcatgaagaaaagtccaagcttgatcagctatgtgaggggccaatcaagtctaatattgatcggctcgaagctcgcaagattgaactcttggcacaatttcaagaatgcaacgccaagctggatctggaacacaaaaagttagccgatctcccacaagctgtcgaagaacagaaggcaaggctgtaatcagccatcaaaaatgttgctgatatgaccaagtccctaaaaatcatctctgggaccgatgctcaagatgcccaagccatagaagaagtagaacaaattagccaaagagctatatcggctatccagcgctacttgtctcagtgacatgttgtgtaatagactctatgaatttttgtaatcggctaagaaactctggatctttgtttaactagtcttaatgtgccgattaatataactccatgtttttgctcaaaaattttacaatttttgcacatatatgccccctaattttacaatgacgaagacattgctaaaattataagttgaactaagggcgatatcataatatcggccattgtacatcggtaaaccataaccgattacaatatgaaaaacatctaagggcgatagaacaatattggccatctcaaggcaatgtgaacacatcggctatcatgcatcggcaacaccagccgatcatgcattgacccaaacacttgggtaatatttcttcaagtatttgccatttagcgatcgtccataaacttctccatcgagttcttgcaacacataagctcccttagacaaaacctgatagattttaaatggtccttcccaattcagcgaccacttgccaaatttgttatctcgagtcccaatcgacaaaatcaatttccatacaagttctccttccgaaaaagacttgggcacaactttcttgttgtaatgtcgagcaactcgttccttatcctaggtaacttttgcaagggctcttaatcttgattaaaccaagtcttccctttcatcgtccatgagattataatactcatcggctatcaaatcattttgcaactccgttcttcttgagccaattctaacttcccatggtaaaacaacctcatgtccataaacaagcttataaggagggacttggatcgatctatgaaaagccatccgataagaccataacgcttcggccaatcgagtatgccattgccgaggataatcggaaatatttcgcttaatcaatttgatcaaactcttgttagatgcctcggtttgcccattagcctatgcaaaatatgttgaagaattcaacaatttgatacccatactatcggcaaactgaacaaactcatcggacacgaagattgaactttgatcggttgtaatagtttgaggaatacctaatcgatagattatatgctcttgaacaaattgtatagcatccccagaatcagctttcttcaaaggaatcgcttctagccactttgtaaaataatcggttgccaccaatataatcttatgccctttgctcgatggtggattaatcataccgatcatatcaattcctcaacctctaaatggccatagtttaatgataggattcatagccgacgccggtgccctttgaattgctccaaatttttgacaatcttgacatcccttgtaatatttgaaactgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtcttttttccccccctccccttcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgcacccgccgcctcgcccgtgccctagcgccgccgccgccgcggattccgccgcatcccgccgcccccgcgcgcaataaagagggggaaatcactccccgtgattccctctccctttccccccacttttccctctctctctccctcggattcgtttggaaactctcccgcaaacttcgccggcgcatcaatggcggccggatcttccgcggccgattccccctcatccggccgttctctccccctcccaacactatataaacgctccccgtgccttcctccaccgtttccgccactcgccgctctctctccccgtcggaatcgagctcgcgccgtcgttccctctctccgccgtcgccgccgagctccggtccgccgccgtcgtcgcctcggactttctcccgcctcggcgtcgcctccttcggctccgccgcgaccttgccgacctcttccacccctccgtttcgcccgccgaccgccggaacgccgccgtccccgtcgacccgagccgcgccgccgcctctctccgcttcggtcgccgtttccgttgtcgccgtcgacccggggtgagccgtggaccgccgtttcgcttcccccttccctcccctctctcgggcgccgctccgccgcgccggtggtcgccggcggcgaccatcggggcgcgggcgcgtcgcctcccgtcggctgtgccggcgaggcagccttcgggcgcgccccgtggctgccatgtggggcccggccgtcagccgcccgctcccgcgggtacggctgacgcgtgggacccacggcgccggccggcgtaagccgcgtgcacgcggtccaccgtggaccgtgaggctgccgcgtgggccccactcccgtggacccggtccgcgcgcccctcccctcggctgacgcaataaatccgattttaaatcaaaatttaaatgaagaaattcgtaaatatccatttaaagagcatataagcttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattatttgttattgttattatttccttgttcaccctagaataaacaaaaccccaactagtggacactctactcatggtatcactagtatgattttaggtagatgcttcgcttttaattaggtaaccttaggcgattttacaactctagactttgggaatattcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtcta

SEQ ID NO: 46816 - DNA, 8627 bp, Oryza sativa
  unsure (1)..(8627): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctcatgattcccactatagaaataactatgaaactgtttatctaaatcggcccagctataaacagaattataaggcagtgaagaaaaccattgaaatgtcgatccagactaggtcaaaggaaacaatctgacccataaagcatcaacagccgatgcctcaccacattgagccaaaaatcggctgacatgctcataagttgatacattgtcctgccctgagaattttgaaaagtctaggactttgtatcggtttggcaatggaaccctctcaaaccactcaggttaggggtgccgatacaaatttccagtatccttcggttttagcccaaactgctccttcatcacatatgcaatcatgtcagcccagggcttttggtgagacgctccttgcatctgctgttgaattggatcgaactagttgaactgaggcagaagctgaggttgaggtgatccccctagttggtaccgaacctgaggtgaatgaggccgatactgaaaattcaaattaccaccaagatagttctgaggcggttgttgcacattatgcatttgttgttcagggataaattgagctccaacaggttgaggtggcttgaacattgctgcaatctgttcctgagtcaaccgattgatgttctgcctagcgtgttgaggttgttctctggtcagcaaataaggattaaccggtggcctttgtgccgatgaagatacacctggtctagaagccgaagccgacgccatcggctgccctggaggtacattggtagcaggctgttggttgccggtcactaaattcctgtactgcggaaacacgccttctggcagaaagactggtcccttagcctgatgctcagcaattgtgccatcaaccacaaacttgatcatatttttcaaagtattgacaagcactcctgattggttgattagagcttgatgaacagtgtactcgacttggtcctagaagttattgaactccaagggctcttctcccccagtttcatcatccttaggttcatcatctttgtcacctttatcaccttgccatccttggatgtacttgattctggatcatcggcagaaaccacctttaccttgtacctctggataactgtgcctgaatgcatctgcttgaatgagtgcaagtactgagtcttcaaattgttaatcatctgctcatactctgccacttgttctggcgtcagcttatctagtgttattgggatgatgttctcagggatgacttctgccgtcggcggtggtttagaggacgggggtttagaagtttgcttgctatccaccatgttgaagaattgttacaactcggtcctaccgggcgtgccaaaagcgtgttgatgcgaaaaacacacactggcctggaagatctgcttaactcctgtgcaggtccaaaatcttgtttttaggttcaaaggtgtgccaattgatttgatcctacaatcaacaagaagaaaagacaagaaaaaggaggttaaatctataaacgatagccgatcggctaggagccgatgacatatgatcaatcattgagccgatgttattggcattagaccagcaatgaagaataaagcaatataaaactaaatctactcgattggctgtagatatcaacaatatttaatccttctctcaatgtatatttaaattttgtgattgggatagattgaacagtatgtcgagacagtataaatcacttaagtgaaaagatacattcagataatgattatacgaacgtttatagcatagccgatcagatagatctagcatgtatcggctaatactccgataccactctatattaagatattagaacagacaagatatattaaacagaaagcctaatatactttaactcaataagatcttaatataaagggcatatttagcataacaatcaagcatatgagacaaaagtagctactctctaagagatggtagatatgtgctaacgaccaaatttggtaatccaaggatcggatgtgaaggaggattcaagacggagttcgagatagagactgtcccggaaacagagtgaggatcggctggagtccgaatcggctacgactaagatcggcagagtttgagtcggacagggttagccgattgagacgaatccgacaatatgacacggcatatgttgtcgggttaggatgacgtgcttcatgatgattgccacacatggatagagtcgtaagaaggcaattgtatctattaagtaggatattttatgtaatttccatagagatttgtttgggcaaaagtctgccgcaaagacttatggtatcttagagtttgttagagacaagaaacatgtccgatatggacatattttgtaatttttgggtataaatagacctgagccccatgtaatcaaactaacactcgttcaatacaatctcggcgcattgctaccctttttacttccgttttgtttcgacgggttcttgctttcaggttgagctgcatcggtttcgatcttcaactagaggtaaaacttattacggcggcttgcgttctcgggattagtgattccatctttatgatactctaatcttgtttctgtaattcgtcgagttatcatatatcttatataatctctggcaatatcgctatctaacctctaatcggctaacgtctgttactagaaggcagccgattaggttaaatatcaacgctgacttagattgtataggacatctaccactctatgaaacatccaacggcttgattgtctagatattgtccttcttgtcatacttatagctgtatcagttgagtttgatcttatgagtcatgattagaatctcaatctctagcctgcctttggtcgctgattagggtaacgtcggggtttcagccgatcttacctgatttaactacctttttctcatatgcttaattgacatgttaaatctgccctttatattaagatcttgttgcatttaagtatattaggcttttgtttggtgtattctacttgccttaatatcttgatatagagtggtatcgagtattagccgattgtaataccctgaaattaaaaataaaataacatgtttggaattgggccgaatcaatttgggccaagtcgcagcagtccagcccacctcccccacctaataccctagggagaggcgactcccaccttcccagccgacgccgccacacctccccctcggcacctatggaacttacatattcctttctcccctgttagccctactccatggatctccaagaaccatagccctaatcaagaatctgattggaaaaacggatcgaggaagaggagaggagcaggaagagtggtgagttggttttcccatcatattctctcaagttctccaaaccctaggtgaggcttaactctcctgtgcagaggttgtaggttattttagggttgtaattcggcgttattcgaaggttagaggatgggattaggtgttgtgttttggattagtgtttctaggccctgtcagctttgttgtgtctctgtatttcgctaattagaggatcaaaatgattttgctgcgaaagtttataactaggaagttgtagagtttttccttagctttccatattggtaaagtacactttgattggcgagtagaactccagatatggctgttttaagtgtggcagtctgaattcttgggcagattctgaagcttgtcttgatttgagctttaggccatctaaatggcagaataaaaatatgggttctacacgaaagttgtaggtctcattctgtagatttccaaaatgtatttatttgcagtcatacaatttttatatttcgagatataaaggtttgaagcaacagtattgtttatagtccaagcggcgtttcttgtttttgcgttttgaggtcttgaggccgtagatgcatgttatttactgttatatattcatatttgagagtgtttgctgaggctttgattgtgattaggtggtggtccttcagatcgtgtatgataccaacccttcattggaggcaagtgaatgtagctgtggtttgctacggttttatcatgttattttttccaacctccaccttgacactttaatacctacaatcactataattccatatgtgcaaatgattattttatgtatcttgctctgagctatctccgctcggctaactatggttaatgtggtatgcttttagtgagagtaattattatatgtgatatcattggaaggatttgtggatgtgttatctttcctctattattgtattgcattgcatttcatatgcatttcatttgaagttatgtcgtgaacctatggtcgcgaccgtaccgatacagcatcgtgtattgtcgtaacacgatgcagcttcacaccttgttgggtgtgaaggcaggaatatcattgcatttgcatcgcattgcactttggtattttggggtatggaagttatatactctattgagttcatgagagggcttctttctcctgaagtctttgcagatgtggtttatcctccttactcttgaacctatgaacactagatgtttgcctttatatttaatgttatgttcctttgttttcttataaatatattttaatgatttggtaggttaaataacttgataaaacaattctcttgctgagatttattctcacacccctacagtgttttcaggtgcttaaagtgatatgctcgcttgggggaaacaggagtagaagcacaactgcattccacactgccaccttaatctttcaagttgtcatgattttgataataaaggaactgtacccttgttaagttgcactagatgaatctgagagttgaaattagtttatttcatccctgaatgttcctttctccttgtttttttgtggatggctacttgcaatgctatacttatatttgacgcttccgcaatgcttatgttttaaaggagttgcagtcgaaatttctccttctttgttaaatgtatgtctatttagtagcatcccggtgtcattgtagtttctggggtgttacaccgatacatgctagatctatctgatcggctatgctatgaacatatatagtctcattgttaacatatacttcgatctaagtgatttatattgtctcggcatggcgaccgatctatcacaatcacttgatttaagtatgtatcgacataaggattatatattgttaatatctacagccgatcgagtagatttagttctttcttacttattcatgattgccgatcgatccacatatgacatcagcttcaagataaataatacgtcatcggcatttagtttatggatttaaccgcggtttctttatctttgtttcttgttgattgcaggatcaaatcaactggcacgctcatacacctaaaggcaagcttctggacctgcactggagttaagcagatctcccaggccttgtgtttttacatcaacacgcttttggcacgcccggtgggaccgattagaagttagaatcacaacagcgttctctcatggctgagaaactaccagcatcgccgtcctcagctagcaaagagggtcctcccaaatctaggatccctaagcttggtgggtctgaagttaatgagagcaatatcgtgcccatcactttggacaagttgacacccgaacagaagaaggatcttgaggtaatgatgcagcagacacagaggtaatgatgaaattctttaacccatttatggagactcgccaaggaacaatcgttcagaggtacaagatgaaactagttgctgatgttgctgggacaagttcttccaaggatggagaaatacaacaggtctcagatagtacgactcaatcaggtgataaaggtgctgcagatggttctcaaggagttcaaggtgatggttctcaaagagctcaaggtgatggttcttagggatttcaaggtgagtgaaagggtcaattaggcctagaggggggtgaatagactaatttaaaactttatgcggaagctaaaactgagttagggtcggaaagtctgattcacagtcagactatccgaaaatatcagatagtctgatgttggatcagattgtctgatccactaaaagaacactacaagtagatcaagtgcacaaacaagagtatggcgcaaacagcgactagatttatagcggcacaaaaaacaaagctaaataatgggagaagagatatcaccaaaaatgaagttcactgagttgttcccggagttcaaatccttgaggggatctactctccgttgaggagctcactaagagccgggtctttgctaacccttttctcaagaggttgcactaagcactcctccttccactaaggggtatctctttccttgtggaggcgagatccggccttcacaaacttctcccggccaaccacatgtagatcggtggctcgggagtgacacctagccgtctaggagtcctcaacctccaagcgtaacaaacaccacacaactcttggtcaaccctagtgctcaagatcgagtgaaacacacactaggccctcaaaccccaaatccacaaccaccaagatccaccacacaaagaacaagaggggatttgagagagggagagagagctcaaagatccaaagcaccttagcaccaagctcaacccaaagtgaatgtgaatgaatgagttgggtaaccctagaaaagggttaggtggggggtattcatagaagcccccaaaatgtggccgttgggagagaatcttttcatcccacctcggaaagtccgaggtgacatcggatagtccgatgtttttgacccccaagcaggccagagacagagaacgaaattctggagaatttcggacaatccgatcgatcggatagtccgatgtcatatcggatattccgttatttttgaaccaaaaatttcaaaaggaataaaaagcaattcaaaacagagagtgaagttctgagaaatttcagatagtctgacgtatcggatagtccgaccttatatcggatagtccgatatattttagccaacactcagacccaagacagtgagcaaagttctgtgaaatttcggatagtctgatcaacatcggatagtccgacagacataaaacaggaacacttcaaataaatgattttgagtactagtggttttcccattaaaaggaagtggcaattctttttattgtaaggcatcctaatactcaagaacacaagatatacatggattagaagacaattaccacaaaagatgctgcaatacttattgtgttgacatccactcctttttctccttgcatacatctcaacaaaaagcattagttaccctctaattatgttgtcattaacaccaaaataaatgtggggtcctagatgcactttcaatctccccctttttggtgattgatgacaacacacttagaagtaataaaagattaggattttggtggagctccccctaaagatatgctagaaatgaaataggagagctccccctcaatctatgcactagattagaaatgacaatataacctcatgcatatgccaatgacaagatatttcacacatttgagcatggataatagataattgcacataacaagacacaaaagcccaaggttcgactagccatcaagaaaggagatagattagagatttttgttgataggtggttctccccctttggcatcaaggcaccaaaagggaaaaagaggatcactcatcctcattagaatcctcgccctcctcacttgactccttagcatagtcaccttcctcctcctcttcttcttcctccataggagccttgccacgatccgcacgagaggagcttgcctcagctgcaaacgggtcctcaatcacatcctccccactgtcctcaacctcagaaccatcgggggaacacggcaaatgggcgttgcgaaggaggttcttgatccgtcgagtgtccttcttccttgctctgcgttccttggcttgccaagctaagatggtcttgcataagttgaagatggacttgaagaacctcaaggacgagttggaatccggcttggtgacggtagcggagggaccggcacgagaagaagcacgagtggtttgtccagccggcacagcagcagccttgatgggacggacatggtaaccggtatgtgccacctccttgtgaaacttcttcttggacataatctcaatcatcttcataatgtaaggcccatagccaagtcctcgcttagggcttaggcatcatggagataagccggatttcttcaaagatgaagtcaaaggcgtcaaagagctgtgggtgagccttcatcttgtaaagc

SEQ ID NO: 46817 - DNA, 30881 bp, Oryza sativa
ccttctccactaactcggctgcggcgaggaggaagaggagcaccacgctccacattagccacttgagctgcttggtcagaggcttgagcttgcgcgtcaatggtatctttgcgggattcagacatacgccgtatagcatgacgagccttggaagagggagagcgacctcgagaactcattgacccacggcgagagtaaacttgattcttgaactgatccttgatcatgaggatacactgatttagaacagaggataatgattaagaagaagtggaagaagaatatttaaatgtgaagcaaggagaaatttggactgggccaaaaggaggtcggatagtctgatttgacgtcggactatctgatgtacattggactatccggcggcatattagacaatccgacggccttttgccctagaccaacaaatctcgattcacacaaaaatatccaatggaatcaaaggatcttctaggtactagatctaggcactaaaacaagaagattcaccgaaggaaatcttgaaataatataccatgagggagatagaggaaaaacaaggaaatacctcaagaaccaccaagagaatcactggggaacaagtgatttggaaggagttgagggagggaaaccaccctaaagagaaggaatagcaatcagagactctgaaacgaagatttttggtggcctagaactagggttttgagaggagaagaggggtggagagagaaacgactgagacaaatgactgaaggggtaaaaaaaaagagttacccccggggaggttaagtccccttgcccttggccccacgtcggatagtccgatttgaaatcggactgtccgattgtggccggatagtctgacttgatgtcagacagtccgacatcctttgtggcagagacaataaaggatggctcaaggaagattttttttttcaacaacatttttataggatgaactcggctagactattacttggacaaatgcagcaaaagaaagaaaactaggcaccctcaagagagggaatgtacgaatctataggaaattgtgcaaggaccaagattcattagagaatgagatccccgtacacatagattcaagttatcctcatagattatgactagtgtttattcatgaattgaatgttcactttgtcatgatgtggcaagcaaacctattctagtaaatgaaaaacaaatgcatgcaaaagatcaagccacattccgagaatccaagatatttagctcacttctcaactcacaaaacctagcttcatctagaggcttggtgaagatatccaccaattgtttgtcggttcttacatgttggatgtctatgtcgcctcttgtggaatggtctcttaagaaatggtggcgaatatctatatgcttggttcgggaatgttggacggggttattggctaacttaatggcgctctcattgtcacataggagtgggattttggacacatttaggccatagtctctcaaggtttgcttcatccaaagaagttgagcacaacaactccccgccgaaacgtattccgcttcggcggtggatagggcgacggagttttgcttcttggaagatcaagaaacaagggacctacccaagaattggcaagtacccgatgtgcttttcctatccactttgcacccggcataatccgcatcggcataaccaatgagatcaaacctcgctcccttaggataccaaagactaagattaggtgtgtgcactaaatatctaagaattctcttcacggccacaaggtgacacaccttcggagcggcttgaaatcttgcacacatgcacacactaagcataatatcgggcctagatgcacaaaggtaaaggagtgagccaatgatggaacggtataccttttggtcgacgtctttaccttgctcgttgaggtcgaggtggccatttgatggcatgggagtgtgaattggcttcgcattctccattccaaacttcttgagcatgtccttcaaatactttgtttggcaaatgaaagttccttccttgagttgcttgatttgaaggccgaggaagaacttcaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatttcaaagccgttcttcacaagaaaattgcgaagacactcataccaagctctaggggcttgcttaagcacgtagagtgccttgtggagtttgtacacgtggttgggatacttcggatcctcgaagccaggtggttgctccacgtataccaactcgttgataggcccgttgaggaaggcgcttttgacatccatttgatatagcttaaaattgaggttagtagcaaaagcaagcaatatgcgaatcgactcaagtctagctaccggcgcaaaagtttcaccgaaatctaatccttcgatttgggtgaacccttgcgccactaacctcgccttgttccttattatgaccccggcctcgtcttgcttgttgcggaagatccactttgtgccaatcacattttgccgaggtcgctccaccaaagtccacacttcattacgggtgaaattgttcaactcctcttgcattgccatcacccaatccggatcatttagagcttcttccacccttagaggttcaagagaagacacaaacgagtaatgctcacaaaaatttgcaatacgagaacgagtggatactcccttgttgatgtctcctaagatgttgtcggtgggatgatctctttggatactttggtggattcttgggcgagctaagttgatcggtgagggtggcacttgctcgccttcttcaccttgatccatgcttgaggtagagggaacgtcggcttgggttgatgtaggtggctccacttgtgttgaggaagaggcttggctccctaggacgcacgttcccaagagccaatcttttgattgcttcgcttggatcctcctcttcacctaacacatgtgagtcaacttgctctacttgagagccattagtttcgtcaaatgtcacatcacgcgcgatttcaacaataccggaggttttgttgaaaacacggtatgcgcattcatttgacccatacccaagcaagaatccctcatccactttgggagcgaacttagaggatctagccttcttattaagaatgtaacacttactaccgataacacgaaagtaagagacatttggtttattaccggtaagaagctcatagggagtcttcttaagaaggcggtgaagataaaggcggttgatggcgtggcatgcggtgttggcggcttcggcccaaaaacggtccgatgtcttgtactcatccaacatggtcctcgccatctcaatgagagtcctattcttcctctcagccactccattttgttgaggtgaatatggagccgagaactcatgcttgatgccttcttcatcaaggaaactctcgatgcacgtgttcttgaactccttgccattgtcgcttcgaatgttcttgatcttgaggtcgaactcgttttgtgctcttcttgcaaacttcttgaagatagcttgtgtctcactcttgtcatgcaaaaagaacacccacgtgaagcgtaaaaagtcatcaacaataacaagaccatatttgttacctccaatgcttagataagcaattggtccgaagaggtccatgtggagaagctccaatggtcttgtagtggtcatcacattcttgacggggtgatgtgctccaatttgtttgccggcttgacatgcgctatacaccctatctttctcaaattgaacatttgttagtccaaggatgtgattgtgctttagaagcttgtgaagattcctcataccaacatgggctagcctccgatgccaaagccaccccgtgttggacttagccactaagcatgtctcatgtttggctttacttgaggaaaattcacaaggtaaagctttcccttgagaacacacttaaagactaccgaggaatcattccttctatagacggtcacatcaacatcggtaaaaagacaattgtaacccatagaacataattgagaaacggacaaaagattgtagtttagagattttaccaagagaacgttggcaatagaaagatcattagagattgcaatcttacccaatcccataacgtttccctttccatcgtccccgaagactatgttatcttgtgaagtgccatttggatcaagagatgaaaacattgattcttctccggtcatgtgattggtgcatccactatcaatcacccaacttcttccaccagtgacatattcctacaagggatcaatttctagttttaggtacccatacttgcttgggtcctctcatgttagtaacaagtgccttaggcacccaaagaactctcttgatagaaatattcttgccccttgggcctacatacttagcaacaacacgaccactagcattcttcctaagaacataagatgcatcaaaagaacaatgtgaagcacaatcattaggaaggatacttttggccctaacaaagttgctaagaccttggggcctcttgatcatcacactcttgtccacctttccttttggtggaggaacatacccaagaccctcatggttgaagttgtccctttgatagcctaggtactcttttagggccttactacccatatggcacttaagtaggccattgtgaaggagtcccataagcttctcattttgcttttgcaaagcactcaaggaaatagagttagtagcacaagcttcaatatcaatatctttgcatcttgcacaaggttcattgcttggggcaattttggagcatgatgccttgctagggagagagacactattctttaaggtttcaaacttctcttcaagagagaggtaagctttatccaagccatccactctctcttgaagttgagcgtttgccacctcaagattagcatgagactctttggtttgcttgtaaagccgtaccaaagcctcatttttctctctccttagcaagttcgcacttgagttcatgagatcgctctttctcatgaatgagcaattcctcttgcctctcaagtgttgcatattgatcctcaattctcccaagcaactcactcaagtgtggtatggattctgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaatacccttcgcacaacacaactcaaaacagtgcaccgttcctggatcataatcacccccttataaacaaggcatggactccccagcgacccccatggacttctcgccacttctcagtctggcgcactataatgaatcatgctatacaaaagataaagccgttgcccatgctggcttgtggttggtacggttaatgtttcacaacagtagctcgcgaaccggtccttaattgtcaggagcacgactctcaaaaccatgtgctcacaacccaccattatgaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaatatgctcaaaggattgtgtttaggatctgtgtgacttgccttgcaataatcggccttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacgggaaaaagaaaaaccgatgacgtcatgctgacgtcatcaatggcagccgactcggatggcaagctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcactggagatggccggcggcggctgtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggaatatttcccctcaacaaaattggagaaaaagagcaacggggaggcgagatttggaaggaagaggcggcggcactgtgcacggcacggctggctcgggctctgcctgagttggaagatgaacagtagcgcagggagggaaaatagacttttccggctaggctgagaggagaggaggcggctcaggttgggccggcggaagagagaggaaggaaaggaaggaatgggctgaaaatggcccaagctgaggaggaggattttattactttcccaattaaaataatcacttaaatgatctttaaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatctgagaaaattccagagagtataattaaccatgaagaatttaataaaaattaaatccatccatgctttatatttaggaaattttatttcccacatttaacttcacttgtaaattaatgaacatttaatataaattctgataataatttattaaataatttataaatcctgaaacaaaaatcagggtgtgacagattccttggttatggatttaagcaactcatcatccataacttcatcctcaacctcatcctcctcgtcactaataaaatcaacattaaatgacttgagaggagaaggtaccttaggctcctttgccatgaggcaaatgggagcatcctcatcactttagtagtcgaagagtcttggtggtgatgaaggcttgacggcgaacgtggcgactccttctccatcacttgagcttgactcggagtcggagctgaaaatcatcccaaggtgagcttggccataatgttcccgcttgctatgcttatacttctccttcttctcatccttcttcttatcttccttgatgtgggaaccatccttgaggtgagggcaatccgcaatgaagtgcccgggctctttgcacacgtagcacactcttgcggaatgtcttccacttgacttgctggagtgatgcttggaagaatttcccttgaagaagccgcttcgcctcatgaacttgccgaacttcttgacgaagagaaccatttcttcatcatcgatctcctccttgctcttgctcttgtggctctcttcttcttcttcctttgccttcaatgccaagtcttccttcttgatgcttgtcgttgagctttggttgatgtattggatgacctccttggactcttgcacaagaatgtcatgggcaagaatgcgtccgagcaaatcatgaggtgtgagagtcttatagtccggacgctcacgaatgatggtaaccaaggtagagttccttggagtgattgctcgaaccatcttcttgaccacaacctcatcggtcatgtccttggagccaagtcccttgatctcattgacgatcttgctcaaccggtcatacatgtcacttgggctctcaccatccaacatcacaaatctctcaaattgccccttgaagatctccaccttggactcacgaacactatccgtgccttcatgcaagttccgaagcgtgtcccaaatcactttggcactctcaatgccatccacacggttgaactcacttccactcaaggcactaagtattgcattggcggcttgagcgttcttgtgcttattctcgtcgtcctccttggtgggatcttcgggattctgcaaaacatagcctttttcgactattctccaaatagatgggttaatagacttcaaatgcatcttcatcttatgcttccaagcggcatagtccgtaccattgaagtacggagctttgctgctataggtactcacataagatgtggatgtagttggatagtgataaggaaacttagctcccttatcaccatctttgccttcccccatttggcccgacatgatccctccaagcggttaagcctaatttggagattaggctctgataccaattgaaaaggtcaattaggcctagagggggggtgaataggctaatttaaaactttatgccgaagctaaaactgatagtctgatccacagtcagactatccgaaaatatcagatagtctgatgttggatcagactgtctgatccactaaaagaacactacaagtagatctagtgcacaaacaagagtatggcccaaacagcgactagatttatagcggcacaaaaaacaaagctaaataatggaagaagagatatcaccaacaatgaagttcaccgagttcttcccggagttcaaatccttgaggggattctactctccgttgaggagctcactaagagccgggtctttgctaaccctttcctcaagaggttgcactaagcactcctccttccactaaggggtatctctttccttgtggaggcgagatccggccttcacaaacttctcccggccaaccacacgtagatcggtggctcgggagtgacacctagccgtctaggagtcctcaacctccaagagtaacaaacatcacacaactcttggtcaaccctagtgctcaagatcgagtgaaacacacactaggccctcaaaccccaaatccacaaccaccaagatcgaccacacaaagaacaagaggggatttgagagagggagagagagctcaaagatccaaagcaccttagcaccaagctcaacccaaagtgaatgtgaatgaatgagttgggtaaccctagaaaagggttaggtggggggtattcatagaagcccccaaaatgtggccgttgggagagaatcttttcatcccacctcggaaagtctgaggtgacatcggatagtccgatgtttttgacccccaagcaggccagagacagagaacgaaattctagagaatttcggacaatccaatcgatcggatagtctgatgtcatatcggatattccgttatttttgaaccaagaatttcatcctctcacagagactcaagttccattgaatttcttagtctctggatcattagatactccgatcatatcggatagtctgatttaaaactcactcaaaaggaataaaaagcaattcaaaacagagagtgaagttctgagaaatttcagatagtccgacgtatcggatagtccgaccttatatcggatagtccgatattttttagccaacactcagacccaagacagtgagcaaagttctgtgaaatttcggatagtctaatcaacatcggatagtccgacagacataaaacaggaacacttcaaataaatgattttgagcactagtgttctaccaattatatgcatgtggcattcctcttaatagtacggcatcctaatactcaagaacacaagatatgcatggattagaagacaattaccacaaaagatgccgcaatacttattgtgttgacatccactactttttcatccttgcatacgtctcaacaaaaagcattagttaccctctaattgtgttgtcattaacaccaaaataaatgaggggtcctagatgcactttcagtgagaatcataatcaagatggcaacacggcacagctacaatttaacaacttccaggataggattgactatgccgtgcaacatgctttaattaatcaatcttgggtgttagtcaatactttgtcaaacatggtgaagtcgatggttgattgctcgatagctgagtatcaggctacaggaccggtttatttgccaggaggtgttttcccaaactatcggcccttggtcactaataatcagccagctgttcagccaattcctcacagtgcaccatcggctcaaccgacagcaccagtctcggctcctgcaccggctgcaccatcatcggcaccaggtcaactaattaatccttggttgttggtgagagaacagccatagcataatggacaaaatgtgaatcggctaactcaagaccaagttgctgctatgttcttaccagctcagcctactgttgacacaatctagcaacaaccgattcagcagatgccaccaagacagcaggttgtgtagccgattcagcagacaagaccgaggcaacaggttgttcagccgattcagcatcaaggtttggtgaatgcatcggctgggttcggaacacctgacaattagctaagacagcacgctgcgaatcaagttgtcccagagcatttggttcataatgtgcaaccagataaaatggtggtacctcaagttattcccgaacatttggtgcgtaatatacaactaaactttcagaattatcaagggggcaatttgaattatcagtatcagcctccatcaccacaagttcaatatcagtaaggggggtcgactcagccccagttcgctcctcaatacaatcaattcgagccaatgccacaacaagcgcagggagtgcctcagcaaagaccatgggccgatatgattgcagatgtgatgagagagcagtttgggctcaagccgaaggatgctggaaacctgtatcggcatccgtacgctgagtggtttgagagggttccattgcctaaccgattcaaggtttcatatttttcaaaattctcaggacaggacagcgtttcaacctatgagcacgttagccgattcttagctcagtgtggtgaagcatcggctgtggatgctctgagggttaggttgtttccattgtctttgtctggatcggcttttacttggtgttcttctttgccatgtggatcaatcaacagttgggccgatttggagaagcattttcatagctatttttatagtggggttcatgagatgaaattgtctgatttaacagcgattcggcaaaggcatgatgagcctgtgcaggactacattcagacgttcataaagatgaggaataagtgctacagcttgagcttaactgatgctcagttagccgatttggcttttcagggcagctccaatcaggaaaaagttctcatccaaggactttgatagtttgtcacatcttgtacagaaggtaaccttgcatgagcagatgtttgcagaagccaggaaaagctttaagaaggtcaatcatgtatgtccctatatgtatggatctgatgatgatgatgatgatgatgattctgagatagcagcagccgaatgggttagaagcaagaaggttataccatgccaatgggtgaagagttctggaaaagaagaaagatatgactttgatatcacaaaggctgataagatctttgattttctacttctggagaaacagattcagcttcctgctgggcacacaatcccatcggctgaggagttaggcaagaggaggtattgcaagtggcataattctgggtctcattctaccaatgattgtaatgtctttagatagcagatccaagcagctattaaaggaggcaaaatcaagtttgatgactccaagaggccgatgaagatcgattgcaatccttttcccatcaatatggtacacattgctggacgaactgccgatgcaggaagagctagaggttttcaagtgaattcgactaagattatcgataagtattagaagaaatatgacaagcagcaggtgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccgaagccttcatcctccaggaactcctcttctgggtttgggaaaaattgagcaagactgagtacaaccaccgtactcaacaagacacacccacaagtgcagaataaatgcaaaggagtacaaaggagttacactataaagggttagggttgcagtaaacagcatttaaagacattagttgctcagggctattttgcaaacacgattctagtactatgcaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccattccatagtgtccaggtgatatgaatattcccaaagtctagagttgtaaaaccgcctaatgttacctaattaaaagcgaagcatctacctaaaatcatactagtgataccatgagtagagtgtccactagttggggttttgtttattctagggtgaacaaggaaataataacaataacaataataataaggtcataacaaaggtaaataggcatggctaaataaaacagtgataacgcgggaatttaaataaagcgataatgcaataagttaaatcaacataattttacaaactgggattcaatatgttcaaagatgatgtgacttgccttgcccgctttcccaaacgtcggcttcaacttccacgaagagcggatcttccgaagctgcagcgtctacacgaccaacggaaaagaaacggcttttactctactaaactccatataacaagcagaaacaaagcacaaaaatgggttcttgacttcttaaggaaaaattagagacttgaacggtccaattccgagttcaaatggcgaagttatggccatttgaagtttatatgctctttaaatggatatttacgaatttcttcatttaaattttaatttaaaattggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcgacgcacccgcaccccgatggtcgccgccggcgaccaccggcgcggcggagcggcgctcgagagaggggagggaagggggaagtgaaatggcggtccacggctcaccccgggtcgatggcgacgacgggaacggcgaccggagcggaggaaggcggcggcgcggctcgggtcgacgaggacggcggcgttccggcggtcggcgggcgaaacggaggggtggacgaggtcggcgaggttgcggcgaacccgaagaaggcgacgccgaaacgggagagggtccggggcgacgacggcggcggaccggagctcggcggcgacggcggagagagagagcgacggcgcgagctcgattccgacggggagagagagcggcgagggtcggaaacggcggagggaggcacggggagcgtttatatagggttgggagggggagagagcggccggatgagggggaatcggccacggaagatccggccgccattgatgcgccggcgaagttagggggaaactttccgaacgaatccgagggagagagagagggaaaagtggggggaaagagggagggaatcatggggagtgatttccccctctttattgcgcgcggggacggcgggaggcggcgggattcgcggcggcggcggcgctagggcacgggcgaggcggcgggagcggcgggaggaaggggatgacgggtgggccccacccgtcagcgagggtggcgtgcgggcccgcccgtcagcggcacgcgcgcgcggggagggggccggatgggccgcgggggagaggagagagagggagggaggtgggccgcgccggcccaagagggagagggggagggaaaagaaactttttagggtttttcttttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttacttattctatgcatagttttgaggatgtattttagagtcgttttgggacgcgacagcaggagaggcgttatgaagaagatgatggcggttttggtcctcattggggttgtgagttctttagattttgctggaatgaaggtatgaggctgccatctattgaagactgtcctgggtgtagcaatgttgcagaaagttcaagccaatcgtataatagaggcaatcggctaaggcaaacaagagttcctgttcatcaaagattgagtccagtgaaccaagactgtgaccaagaggacagtgaagacaggaagacccaatggtgtccttctggtatttttacaaataatcagaagagaagggttcaaaggttgaggaatagggaacgtttttaggaggttgagcaagagatcaaccatcggctgaagaaaacgaattcgaagcaggaatggcgcattaagaaacaagttcctacagccgatgaagtaaagagattggctagaggaaaaagtgttgtgactgcctcggttaacatggattttatactacctgcggaatttgggatcaagcaagccgatgttgatgaaattgaggaagaatcggctagattgattttatcaccagaacaagcagtctttgagaaactggaagggacagagaatcggcatcttaagccattgtatgtaaacggctatgtcaatgggaagcctatgtctaaaatgatggtcgatggtggggctgcagtgaatttgatgccttatgctacatttaggaagctaggcaggaatgctgaggatctcatcaagacaaacatggtgctcaaagactatggtggcaatccatcagaaaccaaaggagttttgaatgtagagctaacggtcagcagcaagactatccctacaacattttttgttatcgatgggaagggttcctacagcttgttgcttggaagggattggattgatgccaattgttgtattccttcaaccatgcatcaatgcttgattcaatggcaaggcgacaagattgaaatcgtgccagccgacaggtcagtcaacgttgccagtgccgatttagctctttgggagatggatggtttcgattgcttatctggaaaagtttgggatggagaatttctaaaagtatccgattgtgatatacagccaattgaagatggagagcccaagttattattttgagggcatcgtggagggttcaaacgtctataacaaggatacagtagatcatctcgatgacaagtaagaacagggtttcttgttggccgatgatttggaagaaattgacataggtccaggtgatcgaccaaggccgacatttatcagtaagaacttatctccagaatttagaaccaagttgacagagctcttaaaggaattcaaagattgctttgcttgggagtattataagatgccaggactcagccgatcgattgttgaacatcggctacctatcaaaccaggggttagaccacaccagcaacctccgagaagatgcaaagccgatatgctcgaacctgtcaaggctgagattaaacgtttatatgatgctggttttattcatccttgccgatatgccgagtgggtttctagtatagttcctgttatcaagaaaaatggcaaggttagggtgtgcattgatttcagagatttaaacaaagctaccccaaaggatgagtatccaatgccagtagccgatcagttggttgacgctgcttcagggcacaaaatattgagtttcatggatggaaatgcaggatacaatcagatcttcatggccgaagaagatatccatcagacagcttttaggtgtcatggtgcaatcggcttgtttgagtgggttgtaatgacttttggcttgaaaagtgctggagctacatatcaacgggctatgaattatatataccatgatttgatcggctggttggttgaggtctacattgacgatgtggttgttaagtctaaagagatagaggaccacatagccaatttgaggaagtttttcgagagaactaggaaatatggccaaaagatgaacccaacaaagtgtgctttcggtgtatcggctggccagtttttgggatttcttgttcatgagaggggaattgacataactcaaaggagtgttattgcaatcaagaaaattcagcctccagagaacaagacggagttacaggagatgatcggcaagataaatttcgctagaagatttatttctaatttgtctggaacattagagccttttatgccattgttaagattgaaagctgatcaaaagtttacttgggggctgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggagcatggctgtgcgctgacgatatggtcagtgtcagaccggtcgcaaatcggtcattcttgtccaccgcgtgtaatcttggcaacgtgcatgtttgcccttcttcacacaacattttgcttgtaatggttaggatgaagcctggcatatatcgatcggggctaacgtgtcatctctaagagataacacgcttaacgccggcttgagacgagtgcctagaggctttcgtcttgacgggatggggcatggcgtgcgtcagaccgccagtcgccacctaacccgtgatctgaccggtctgtgactggtcacagaccggataaagggacgcgccgtgctgcactgcgtgcagcgtgacacgcttgaccagactgcaataaatgctgttaggtgagcacagctgtgctcacttatcccatatacgtggcgcagacttcctaaagggggtcggggtgccccggccctcggggccagggcaagcgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccactcctaaagcctggtgacaggtgggaccggtctgcatagttgggcaaaatccccaacggtcccagtccatgcacattggtattggtaactttggttgtccataatgggcggtctattcaagactgccacatcacttgagcagcgcgcgaatctgggtgagcagatttgtctcgcccggagatacggtaacgccgcttcggttggcgagcgtaattaacgcgcgcacgatacaatccgtttcgattgccacaaccgcatatccacttcaagcgccgtaagcgggcgaatgggattagtggaagcgtgggcacgggaaacgagggagcaagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctaccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccgagccagcccccggcgcaggtctccagctggcgggcgccggtagatctgggggaggagtacgacgccgtcctcgaccgcctggcgggcctgcgatcccaggggctcaccggggccatggtgtacggcgattacctccgtcggcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatcgatcccgaccgcgtctccattctaaccattatgctgggggtcggggcctcagaggagagagcccctaagggccacgacggcgcgggcgagagtcgcccggggaaaaaatctgccccaggagggggtcgtgcttctgggccccgcgtcgggggctcggggagcagccgccctgccgacgccccggggaagaggaagctgggaggaacacctcccccatctcctccccgagggggcggggcagtgcgtaccagcggtcggcgcccggagggggctgcgccgacgtcacagcccgagggggagcgcaagaagaagcggctccgcaagatgggggagacggaaccagcccggggaaacctaatttcccctccaaggtggtcattcaaccgaccccctcgcaggttcgtctcattctcattgcgaccacctttctcccaaagagaagttttttcttacccattttgttcgtcttttggttttttcttctgcttcagcgatgtcccgtcgcattcctcccgccgccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaggctgctcgggaggaggccgcccgggctcgccaagccgaagaagctgcccaggaggaggccgcccgggctcgccaggctgaggcggcagctgctgctggcgcgtcactcgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggcttttctcctcttctctcgtcgccccagtgagcgccgagcccattatgcaggccttggccgccgcaaacaccgcggtgctagatggatttagcgcccaggtggaggccttgcaagcggaacgagcggagctcgaggccgcatgggcgcgtgtcgaggaggggcggcgctcggtggacgccatggtggaggtgggccgtaaggcccaccgccgccacatctcggagctcgaagcccgcaaggcggcgctggcggagatcgcccgggaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggccctcgaggcccgtgccatggcgctggaagaacatgccggcgccgtggagaggagcttgatggaccgcgaggccgccactgctctccgggaggcgacgctggcggcgcacgaggccgcctgcgccgaggaggagtccgcgctccgccttcgcgaggatgcactcgccgagcgggagcgggctctcgaggaggccgaggccacgacgcaacggctggcggacagcctctccctccgcgaggcggcgcaggaggagcaggcgcgccgcaaccttgaaagcgtccgcgccgagagagccgcgctggagcagcgggctgctggcctcgaggcgcgggagaaggagctagacgcgagggcgcctatcagcggggcggccgcgggcgaaagcgacttagccgctcgcctcgcggctgccgaacacaccgtcgctgacatgcagcgcgcgctggactcctccaccggggaggccgaggcccttcgcttggcgggcgagatcgggcccgacatgctctgggatgcggtctcccgcatgaagcgcgccggtcggcaagcgggcctctggggaggccagacgtcggtgccccccaccaatctggaaggcctcgctccgcacctcaacaggatggcttgggttctcgagcgactccccgaggagcttgagaagaccatcaaggcatcctcgagggacctcgcccggggggcggttgaactcgtgctggcgagttaccaggcccgggatcccaacttctccccctggatggcgctggaggagttccctcccgggaccgaggacgacgcgcgcgcgcgggtcggggacgctgccgaccacatcgtcaacagcttcgagggctcggcccctcggctcgcgttcgcccccagctccgacgaggagggcgacgccagcagcgaggacggcggtggcgacgaggccggcgacccgggcgcatatgaatgagcccccaggcccccgccactcttatcttttttcttgttctttcttctaaggccttcatgcctcttttttgtacaatctaacttaatctgcaatgagaaatgatgaaaaatttttgtgttagttttattttgctatatatatgagttgaggatgatctgtgccatggtccttttgcgccttagcttgaaataagggctcgcgcccaagtcccggtcctcgaatggctcgggtcggggctagtgcctggggagatccgcatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttaggaaattgaaactgcttctattgaaatgctgaaaggaatatatatgcatgtgtggtagcccccggctaaccctgcacacccgagggggggtgcggggttagcccgagccaaaacctgacacccgacccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagctcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacactctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcgaaagtcgagacggaccaaatatctgaggacgtctccgttcggagaggtcaacgtgacccctgcaccggcgccctgaagagacagagaaccgtcgaattgcatcacccagtgggcggcgtgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttccttgaggccatcagaatagcgtaaagcatcttctgggcctgtgggtatcgggtcttggcgtcccggagggcctcactaacaaagtagacaggccgctgcacctttcggcggggccgatcctcctcgttaggggccgtacccccggggcgttcttcgtccaagtggcccctcggggcgaactcgtcttctgcgctgatgacctcggggtcggaggatgacaggagcggccctcccacagtggcctcggggccgtcctgggggtcggggactcctggcatcgtcggacaagcgggcaaagggccaactccggtcgtcaggggcctctggcctccgttcggctcgggggcctcttctccctgctctttcctgggtcgagtcagcacagggttagcctcggggccaaagggctttaagtgcagccttccctcagtggccttggggccttcctgagggtcgggggcacccagcaccgtttgacaagcgggtggagggccgactccggtcgtcgggggccttaggccaccgttcgactcgggggcctctcctccctgcctgctcccgggccaagtcggcacagagcgggggtgcgcagaatgaggattgtcctcatcgcgctccacaaccaacgctgcactaactacttggggggtcgccgctaagtaaagtagcagggactcatttggctccggggcgactagaaccggaggagagctgagatacgccttcaactgggcgagggcattttcagcttcctccgtccaagtgaacggccctgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttacccgcaggtacaccaaacacacacttatcggggttcagttttatgcgggcggagcggagattctcaaaagtttccgctagatctgaaagtaaggtctcttggttgcgcgtttttacaaccaagtcatcgacatacgcctcaacattacgtcctatttgactacccaaagaaattcgagtagtacgctgaaaagtaggacctgcattctttaacccgaagggcatttatgtataacaataggttcctacgggggtaatgaacgcagttttttcctcatcctccctagccatgcgaatctgatggtaaccagagtatgcatctagaaaacacaaaaggtcgcactccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacgaatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaaaaccaccgatccgtgtggtcttggatgggccgtcgcccaaggcaacctccttgaccgggacctcgtcgcaagtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccaccacatcgaagctcacccgctccgtgcggaagttggcgggtccaccgaaggtgaccggtaggtcgatgtgacctaacggccacgtgtgccccggcgtcacaccgatgatcggttgtgacggctggagcaccatccccggggccttgatagcatcaaaggccgcgggggaaaggatgttgagagccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggtcagaagctctcgcttcatagccttgaagctccggcgagagacgtgagcacatgctcctccatcgacggtggcaatggtggctccaggttcttggaaacctagatcatcatcaccatcatcaatgtcaacagcgggggccttcttcttggcctcacttcgccgtttgtcggaaggaaccgccggggacttgccgtcacggcgttcctgcctcctgtcctcctcccacttcctcgttcgctcagccaagtttttgactgcacgacagtccgcgagatcgtggagggaggtgttgtggacggagcaccacctgccggcggggcgctccctgccgggagtaccagcctctttctttttgtcgctcgcaggcctcccctttcgggtggcccgcggagcgccctcgacggcgaggacatgaccctcgtcgccggaacggtccgacctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgccgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctggcgcgccagatgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccgacgatctatacaggttcgggccgctgagaagcgtaataccctactcctgtgttttggtggatctgtgtatgaatgagctacaagtgtcagctgacttctcccccgttctaagctcataatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggagcatggctgtgcgctgacgatatggtcagtgtcagaccggtcgcaaatcggtcattcttgtccaccgcgtgtaatcttggcaacgtgcatgtttgcccttcttcacacaacattttgcttgtaatg

SEQ ID NO: 46818 - DNA, 1664 bp, Oryza sativa
accccccctcgggggaaatcaggaggagggcggacacctcaccctcgggcccgacgtccccgaaggtgccaggccacgtgggcgattgtgtctgcctcaagcctctagtcatgatactcccggtcccatatcaccgacaggggcagagcaacagaaggctttggatattattaaggaatatcttagctctcctccagttttgatttctccacaaaaggggatacatttagattatatctatcggccggtgagaagtcaatcggttcagtcttgattcaggagcttgacgggaaagaaaaagttgtattttacctaagtcgtcggctcttggatgcagaaacaagatattctcctgtggaaaagttgtgcttgtacttatatttttttgtacaaggttaaggcattacctattgcccaatgaatgcactgtgatatgcaaggccgatgtggtcaagtacatgttatcggctccgattttgaaaggaaggattggaaagtggatattttccttaacggaatttgatcttcggtatgaatcaccgaaggcggtcaaagggcaagctatagccgattttattgttgatcatcgtgatgattcaatcggctcggttgagattgtgccatggactttgttctttgatggatcagtatgcactcatggttgtggtatcggcttagttattatttctcctcggggggcatgttttgtgtttgcctatactattaaaccttatgcaactaacaatcaagctgagtatgaggcagttttcaaagggttgcaattacttaaggaagttgaagccgatgctattgagattatgggggattctttgctagtgatcagtcagttggcatgggagtatgagtgcaaaaataatacattgatagtttacaatgagaagtgccaagagttgatgaaggaatttcggctggtgactttgaagcatgtatctcgagaacagaatattgaagctaatgatttggcccaaggggcgtcgggatataagccgatgatcaaagatgtcaaggtagaggttgccacattaacagctgatgattggagatatgatgtacatcattatttacagaatccatctcaatcggcttctcggaaattgcgctataaagctttgaagtataccttgttggatgatgagctgtattatcagacgattgatggggtgttgcttaagtgcttgagtaccgatcaggctaaggttgcaatcggtgaggtaaatgaaggaatttgtggcactcatcaatctgctcataagatgaagtggttgcttcgacgtgcaggatatttttggccgacaatgctggaggattgtttctgtcacgaccggaaataacccaacgggcgttccttacgtgcgtgcattaatccttgtcccaggaggcaaggtacaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccgtactcaacaagacacacccacaagt

SEQ ID NO: 46819 - DNA, 6563 bp, Oryza sativa
ggcgcgcgcgcgggggaaggccggatgggccgcgggggagaggagagagagggagggaggtgggccgagccggcccaagaaggggagggggggaaaaaagactttttagggtttttctttttataaaacctttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcacaattttgaggttgtattttagagtcgttttgggacgcgacaaacctaccccccttaaaaggaatctcgaccccgagattcagaagaactggcgaagagatcgggatgggctgccttcagctcgtcttcacgctcccaggtagcttcttcttcgacgtggttgctccactggaccttgcaaaaatggattacccggttcctggtcctgcgctccatggtgtccaggattttcactggcctctccacgtaggtcaagtcttcgcgaacttcaatttgctctgagtcggcttgctcggatggcactcgaaggcatttcttgagttgcgacacatggagcacatcgtgcacgttgcccaaggaggcgggcagctccaattggtaagcgacttctctgcgtcgggcaacgatacggaaaggacccacataccgaggtgcgagcttcccttttgtccgaaacctgtgtacaccccgcaatggcgtgacccgaaggtatacaaaatcgtccactgcgaattccaggtcacggcgacggttatctgcataacttttctgccgggactgtgccacctttagattatcccgaatggttctgactttagcttcagcttctctcaggatatcagtcccgaacacttggctttccccaacttgatcccacaagagcggtgtccggcatttgcgcccatacaacgcttcataaggtgccatttgtatgctggcttgatagctgttattgtaggagaactcggcataggggagactcttatcccaggtcttcccgaaatccaggacacacgcgcgaagcatatcttctaggatctgatttagacgctcggtctgcccatctgtctgcgggtggtatgcggtgctgaagtttaaccgggtacccagctcttcttgaagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtctttggaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgtagtatcagctgtttaagttctctgttatctggaacgcatactcgatttccgttccatagggttccgtgttcatcctctgtgaaaccagcggctttaccctgtttcatattcttgaggagtccatgcatgtccggatcgttcttctgagcctcgcggatttgatcgagcaaggtaggcttggcttccaacgcagccaagaatccgcgaccaactatgcttaggttcagggcttccatctgttgactaagttcgagtggaatgccacggacgttaagagtgttgcaatggctttttcgacttagagcgtcggcgaccacgttggccttaccaggatgatagtgaattcccacatcataatccttgatgagttctaaccatctcctttgccgaagattcaggtcggactgagtgaagatgtatttcaaactcttatgatcagtatatatttcacaacgattcccaatgagatagtgccgccagatttttagagcatgaaccaccgcagctaactccaaatcatgggtagggtagttgccttcatgaggccgtagctggcgtgaggcataggccaccacatgaccatcctgcatgagcacgcaccccaatccttggcgcgaagcatcacaatacaccatgaaatccttgcgagtatccggcaagattaacactggcgaggaaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctcggattgtgagtatatcagaatgtcatcaatgaaaaccacaacaaacttatccaagtattccatgaacactttgttcattaagttcatgaagaaggcaggtgcattggttaaaccaaatgacatcaccgtgaattcatacagtccgtatcgcgtggtgaatgcggtcttcggaatatcttcttcacgaatacgtaattggtgatatccggaacgaagatcaatcatggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttgacttcggccagttcatttgctgccatacggtagggtcgcttgtacagaggagtggttcctggagcaagatctatccggaactcaatctctcgtttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtctcgcacaatccactactccttggaattgagccaaccaattcatcccaaggatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggatgctccagagtcgaacagaatggtagcagggatggaatgaatgaggaacgtaccaacgatgacgtctggagttgtcagcacgtcctcggccgtcacgtggttcacccgaccccgaatgacatccttcccaccgtggttggagcggggaggcgcttggccttgctgacgcctcggctttgggcatttatccgcaaagtgcccgggctcgaagcagttgaagcacagacgctgcggaccttgagcgtccctacggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctattgattgcggaaattcgccaagcggcgcttgtgcgactccagttccttgtgcttggcttccaagcggatgctcttgtccactagacgttggaaatccggatagtccccggagactagacggacggacagctcagggtccattcctgccaagaacttctcttgcttctcctcatcttcccgcacatcctccggggcgtaacgggccaagttgttgaactcatgcaaatactccatcacggagcggttgccttgcttcaactctcggaattctcttttcttaagggccacgactccggcgggcacatgggttctccggaaagcggcggtgaaacgggcccaagtaataggttgcccttctggctgcgtagcctggaaatggtcccaccatagagatgcgggtccctgcagctggtgggcggcgaagatgactttctcctcatcgctgcactgcacagtgtctagctttttccccacggcatgcaaccaatccaacgcgtccacggggttgttggagctagagaaggtaggtgggcggatgcggaggaactcggcgagtttagagtgttgtgggggtggtggtggagcattatgttgtggcggattttggaggtggtggaggaaagcagtcatcatgttggcctgctgggcgaggatttgggtgagaatggcgttggtgtctggtggtggtggtggaggcggaggaggaggtggaggtgggctgccctggtggtggtggttgctgccttcaggttggttgccatcaccggtgttagcacttctcctggtcatcaccatctgaaaaccccacacagaaccagcaaacagagagagctgacaattaaagctaaccacccacgactaccataattcttgaatttattactgctattaaattggttcattaaagttcaagttgcttaagcaaataaaataaagacaggctccgacacagttacaccacacaccggcataaccgtgccccacacaacccaacaagaagacaaccgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgagggatctcgacgaagcaagtccacgccagggactgacgaacaagctcgggcctggaggtgctcttgcgggcggtgatcttctggctgcggcagacacggcggcgcttggggcggcagacctctccctgggcgatcttgagctgatgcagctgcgcctccaccgcgtctaggtccttcttgagctgcaggttctcttgacgcagctccaggatcttcatgttgttctcgaccatcccacggcgcaccatctgatggaagtcgatacgagccgcgtcgtacgcctccaccatgcgcgccaggtgcacgatggtagcgtcatcctctgagctagcatcccggaaggtggcgtagtcgcgggctcctccgcggcgagggtggtagcggtagggcgagtgctgcaactcgtccgggtagcgctggtgaagagtgccgatggcgaggagagcggcgctctggcaagcggcggggaaggaatctccacccgcggtgactgccagcgaagtccgctcgggagagccagagaggatcactgcagtgacctcccaaccagcgtggggctctgcatcgtcaccctcctgctccggaagcggcctggcctggtagtccactccatgtggataccccaggaccacgcacatgccccgcagctccaagacgaagccagtcatgtccaaaccacgacgggtgacgctgccggccatctacaaacaaaaaaacagaaagaaaaaccacattttaaaggtcagattttggcgataaatgaagcagcaagacagagagagactagacagttttcacaaataacaaaggatttttatttttgaaaatattgctaaggtttgggatctacggctcgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaataattaatttattacacgggcagcgaaggcccagcacacacaaagacaaacgagaaacagcggaagactagggcgacgaccacaggcacttgacggcaggcacgagctagacaccgaagccttcatcctccaggaactcctcttctgagtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgctaaca

SEQ ID NO: 46820 - DNA, 3838 bp, Oryza sativa
  unsure (1)..(3838): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagtaattaatcacatcatccaagtgagattgaagttctgcctcattatctcattatctgttcacctggtttttgttcctccgtgcctctttcgaacgtatccttcaaggttcacatgtgtggtcaattagaagcattctacaagtattaatagtatgtaagtttggtgttatttgtacttacaatgtgtagcactttaacaagccggtgtccactgctcgtagcttatagaggtaaaaaagatccgagaaggccactgcaaaataattttgttgccccaaggatggttcttggtcgtggtaacctactatggacgtgtccctcatcttgctcttggagtttgttttctccatgtagtatctatgcagcacttggcaagcagaacccattttggctaactcatggtctgcaaccaatggcacctgttgctgaaatgtacctggagcttgttttttggagtaacgttgacctccttatccagatctagttgtttgggaggtaactacggctcttgtgcctttctttttccttttgatctatctcttgcatgatgcgcccttctttgcaccatcggtggagatgaaatggccttggtgttttgcggaggagggtgaagtttggccatttcaccgaagtccgtaccatggctctcaaatggagcttcgatggccagaggaggtgaagggacttttgtggaagaatctgggcgaggtggagctggagctaaagttgtcctcaaagtgaccttgatgatgatgaggtcttttagccattggatgaagataccacgggattggaagttgccagttcatccaatcagcattcaccatgtcaacttgtactttgacatgtctagccaccaaatctgcaccgcgaactcttgtttatggagtaggtttgtatggttagccctcggcagcatgacaacagaatgtttgtgtaaccctaacttgtaggatgcattgggctacgccctgcatacaatccagaaaaaaatattagtttaagttgtacgaatcacatcagctacaacgagaactactattcgactgagacaggtggatgtcattctggaatcccagttgacaaacaactacttcgccgctgcaggggctcacttgcacttcttctggatgtccgttgtcctcgttcctttttggctagcatctcttcccttatcctagcctcaattccgtgtaatttttcattgaattcatggctaagttcactattgacggtccttaaatcataatatcagaccgtcaatacctgcatataatgaaataaacacatggtatccaacttagtggtaggtgttattactaatcatttccactagtgttggtgaaatatatgtatgcaggtaatttgaggagaaaacacatccgtcatgtgacaaaatgcacctccgcgcattcaggacgcgtttagacggattagaggcccaataagtcaataaaaaccatttagaattgggccaaaacatagcccaggttgtttggggcccattaaccaacctcccgaccgaaggagaggccgggaggagagtttttgggttcggccgaacctaccagttcgggcggaccaatcctggtgcttcctgtcatctgctttcacctggacggctcgaatttctctcctaaggcggttgcagcgtgttttggtcatttcccatacccctaaccgtcatttggagcctatataaggagctcttcatctcacttcaagcacacacaactttgagctgaattacaagaggctctattgtatcttttgtacattagaaataggtagaaagcgaggggaagctctgaaggagtgcccggaagtttggcgctcatccgacttctgcctcgacgagtgtagcttcctaggaggaattctgaaggagtactggagtatcggtgagtactggagtactggccgagtagcttcctagatggctacgaaatcagtcttggctttatagccatggttcgagagaaaaccttctctggtagtatcggtgaaaatccatacctccatcttcaggactttgagctagtgtgttcgtgcctatctatcgtcggcatgacacatgatactcttaagtggaaattgtttcctttttctcgtagagatgaagctaagcaatggtacactctatctgtcaagaaattccactgtgaatgggaggagcttaagtgcaatttctgccttactttctttccattaacccgtgtaatcaatctttgagtagacatcctttcttttcgacagaatgagaaggaatatctcggtgcagcctaggccagtttctcactgttaactcaatctggcccagacttgtcgttacccgaccacgtgttgttgcaacattttcggtacgggttagacaaggagtttgccgaaaatctcaatatttctgccggaggatcgttcgcacacaagacaaccgccgaaggaagagaactcttagatttgatcttagagaacgattctttcggccgaagcgaagccgtcccgaaggtcgagattattcatgaggaacctctgcacgtggagttggaacccgactcaactgtcgaatcctcatcccggtcgcaggagccggaggaagaagaaattcatcctccggaaatttcattccaattcgaggaggatcttttcgaagattattagaacaccttgaattattcctgagagaagagaccaccgaccaaggtcaattctaatgaacctcttgataaatctatgcttaaagagacggtgaagaggttgaccatcatcatgagtaacaaatggttaagagaaggagagctcttatctgaatcgattcagatccgatgcccctcctcaaccattatgtgtcacattggaggtaattcggtccgtgctctgtataatccctctgttggtgccaatattatgtccgcaacctttgcattcgattgcttaggggacagatcgttggaaccaaccgtcagaaccttccgaatttccacaaactctactaccgaaggtttagggattatctctggagtgcccacacggcacaacagtgttgaggtcatattagattttcatgtgtttgaaatatatgatttcgacatactcatagggcatcccatagaaaaactcttagatgtgcccgaaaccggtgtccttaacctgaaaataggaagaattgccacctccgtccctatgttgcaatcaaccaattctttgatggagtctcttcctgttcctgagccaattgagggagtgatggctatttctccattcgagaccctagagtctattttcgatgaatccatcgaagaattcaatgaaggggaggatgaaactggagaaacgatggatctgccaaaaacggatctgccgtcacgagccccaattgagctaaagcccttaccgtcaagcctaagttatgcctttctgaacagcgatgcggagtctctagtcattataagtgacaaactctctgagagggagatggcccgacttatcgccattttagaaaagcatagtgctgcttttggctattccctccaagacttaaaaggcatcagtccgaccctttgcactcatcgcattctcttagaaccgtctagcacaccatctagggaac

SEQ ID NO: 46821 - DNA, 1677 bp, Oryza sativa
acattcaatcattgtttggagaatttagataaggtcttacaaagatgtcaagaaaaggacttggtacttaattgggaaaagtaccacttcatggttcgtgaaggaatagtcctgggacatcaaatctccgaaaggggagttgaggtggacagagcaaaaattgaagtaattcgacaacttccacctcctgtcaatgacatgggtgtccgtagcttcttgggtcatgcggggttctacaggcgcttcataaaggatttctccaaaatcgctagacccctaactgccttgctagctaatgatgttccggttgactttgatgatgagtgtatgaaatcctttaaaatccttaaggaatcactcatctcagcaccaatcatccaaccctctgattggtcgctgctgtttgaaatcatgtgtgatgctagtgattttgctgtgggagctgttcttgggcaaactaaggatagaaaacaccatgctatcacatatgctagtaaaacgttgacgggagctcagcttaattatgccacaactgagaaagagctcctagccgtagtgtttgccattgagaaatttaggtcttatttagtgggggctaaggtagttgtttacactgatcatgctgcactaaaatacctgcttactaaaaaagatgcaaaacctcgggtaattaggtggattcttctactccaagaatttgacattgaaattatggataaaaagggagtagagaattatgttgcagatcatttgtcgcgtatgcaaatcactaacatgcagaagctactgataaatgactatctacgggacgacatgcggttgaaagtcatagactctgacccgtggtatgcaaccatcgtcaacttcatggccacgggtcatgtaccaccggtagaaaataagaagaggttgatctacgagagccgcaggcacttgtgggatgcaccttaccttttcagagtctgctcagatggtctactgcgaatatgcgtttcgacagacgaaggcatcatgatcattgagaagtgtcatgctgccccatatggaggtcactatggagcattcaggacacatgcaaagatctggcagagtggattcttttggccatcaatgtatgatgacacaaagtaattcgttcgaagatgcactagatgccagaagcatggagggatcactgctcgagatgcgatgccactgacacacaaccttcaagtcaagctatttgatgtatggggcatcgacttcatgggaactttcccaaagtcctatgactgcgtgtacatcctggtggccgttgactaggtgtcgaagtgggtagaggcagggccgcagacgccaagcacgcccgccggatgtttcatgagattatcttccatcgttttggaactccgcggatggtgataagtgacggagggtctcattttatcgataagaccttccaaaactgtttgcaagaacttggggctcagcaaaaaattgccactccgtatcatccccaaacaagtggacaagcagaaatgagcaacaaacaaatcaagaatattctgcaaaagactgtaaatgagatggggtaggcatggaagaacaagctacctgatgcacttttggcatataggactgcttataagatgcccatcggcatgtcaccatactaacttgtctatgggacgacttgtc

SEQ ID NO: 46822 - DNA, 25562 bp, Oryza sativa
  unsure (1)..(25562): unsure at all n locations
gtcacgctgcgtgacaacgaaggtaacatctttaaggtaaatggccattgtttaaaagttttccttgatccgttagaagttgatcatgacttggatgttgtgaatcttgtctcttttagcttctacccggagtctttaggtccccccttgatccgttagttttcaatgccatgagtccttaggcctccctctagttatcttaggtctagctttcatgataaaaataaaaaaataaaaaaaaataaagttggctccttggtcttccaaccatgtgagccctttttgcttcactcttgtctttctttttcttttttgtgtccaataaagcctctcatatacgaagacaagtgtgggggtgatcttgcacatcaacgccgtaacaaaagcaagatcaccccagacgagctatgacaaaccacacacgggaaattgatgcagttagacctagtgaggggtcagccaaatctccagttcggctaaactatctctaccaaggatcattttctattttatacagagcgcatgtttgcacaatttttcctttggacatccattctatcttgagtttaatttgactatcaattctaaaatatcgaagataattaaactcaaactagggatggtacaattagagttcatggtctccctgaaaatagcatgcatgcctattattctttgctcattacttgttgcttgtggtgacttatccaatagggaccccatgctatctaagtaattgatgaatgagatatagtctgatgatagaaattctgctcttcatgttgcacacttgggaattttataaaatgaaaaaaaacttgtataatgatgctaaactgctcattgatatttttattcccacttgagccataggttgatcattaataattagcttgctacatacgctgcttgtcattacattgagcgttgtcaagttttgtgaccctagtgaaatgcttttcatactttcatggtcaagatcacacacattccacatacacccacctattcttgacttctacactgcaagttagcattcctcatttgtcattcatttcatccatcaaataaatactcatacaagttctttcaaaaaaaagttgagagagaggcatggctatgcaaaaagaaagaaaaaaaatgctcatacaagtattgagcatgatgatgagaaaaaaaagaaaaagaaaaaaaagagatagccatgcactcttgaaattttcaaagagaaataaatggaagaggatgtatacaaaaggagttattgattcattttttttccacccacaaatttaccatacacatacacatacacatgcacattcttgaccagaaagtatgttttgtatttccgtggatccattatttgactttgcaatatatgtgatgcaagtaatgctctactcttttccataccctgagctccacaaaagccttattagatggtaggaaaagaaaaggcacaatcatatgccttgtgaggaatcatacactttgagcgatcgaaagaatcaatggaggagcaaagcatagttataattttgtgttacctcaaaaaccacaagttgttcttcatgaaaaattagggtgacttaatgtcaagattgttccatttctcaattgctcaagatcgcatggtagacactataaagatcgacaagtacaggtatggctttgaataatttgtttgcatgatgattagttaggaagtcataactctgttgtagagtccatagccttcactcgggatgagcaaaggttaagtgtgggggtgttgttgacggtccttaaatcataatatctgaccatcaatacctgcaaataatgaaataaaacacggtatccaacttagtggtaggtgttattactaatcatttccactagtgttggtgaaatatgtgtatgcaggtaatttgaggagaaaacacatccgtcatgtgacaaaatgcacctccgcacattcaggatgcgtttacacggattagaggcccaataagtcaataaaaactatttagaattggaccaaaacatcgcccaggttgttgggggcccattaaccaacctcccgaccaaaggagaggccaggaggagagtttttgggttcggccgaaccaatcctggtgcttcccgccaactactttcacctggacgtctcggatttctccccttaggcagttgcagggtgttttggtcatttcccatacccctaactgtcatttggagcctatataaggaggtcttcatctcacttcaagcacacacaactttgagctgaattacaagaggctctattgtatcttttgtacattagaaataggtagaaagtgaggggaagctctagaggagtgcccggaagtttggcgctcatccgacttctgcctcgacgagtgtagcttcgtagtaggaattctggaggagtactggagctgttggtacactttgctctaggttcagagaacttcttctattaagtaagcattcgtgttcctttcttatgttatttaattacttagtctgagtaagatatatttccatctttgcaggttcattatttagtatttatactaagtgctctagtactaggactccggatagagaaggaatttcctgcgcaagtattagagaagtaattaataacttaggcctggtgtctaggttagagattacctttgtttgttgtgtatcccacggatttgtcagaggtagacggcaggtggtgacagccctgaattccgtcctagtaatcctccatgttcgggtacatcatagagctatagccggaaccacactgacagaccagcaggggtcggtgcccgtagcaacagataggaaattacctttgcttagcttagataattaaaacacagagaaagtcctctctagcctgcctacctatagttgttgtccttggatcgtcttagccctaggtagattacacacattccctgagtttgatatccttttggggtcacccgaaggtgaagtgctacagcggtattccgtgcgcttgtggatttatctttggtcgtaagaaataccaacattcacccatgacctcccttacaatatgttctctaagatgatcttctgtctgttccttagtttgtttaacctcccttacaatctattctctaagacgaccctctctttgttccttagtttgtttgcgcttcctgtgttgtgcgttgtacttggccatcccaatgttccaaggaatgttgcatcctgtccctctagtccggccagcctgttgttggtatttcttaacgatattactagaaatatgaattcccagcaatggcgctagaaatggtcctggtatatatatggtttacagaaagaatccgcaagcgcacggatttaccattgtagcatttcacccgggagtattctaaggtatcgtatttatttaatcgcaagggaagattgtaagagagaactatgctaataatatatatacatgccacttacataatcaaagtctaagcatgggttaaaatatttatatgggtagagtgacacgaagcaaagcactcatatttcttctttaatcatttctgaactaagtggaagaagaaatagaaaaaacaatcaattcctataattctaatatacactcaactttagtctacatctactagtatacaaccatatagccaataccccctaacagtgccctcctggtgcttcgagagactaccccgggttgccgagtttcttacgacaacctaccatggccgtccaacctaggctaaatacggaggagtaccctccctaggaaagtttcttaggattagatactatcgtggaggaatacccgtactgagctgtcacaattagcagcccacctttactgactcgtagcatataaacccagataatgatacttagtaatctagacaccctgtctacattattaaatactactctacatccctcgagatgacatagagcaaccgagtaatcggacattaaacccacaccattgcacctctctggtaggctaactatatgactgtaccaatacaaacataaagtaaagacaatacttagatgaactaaagtatcgagagcatatgaagaagaattgatccagatctacctatcaatagtacattgttctttacttacagatcagaacaaaaggtgagctcatttctctctaagtctatgtgtgaaatatatgagaatttgatgctacataatatttcgcacttgagagattggaacccttggctggcataaacaacatgtgggtccagtcggaggtgaccgttgtagcggcgtacatgaggaagatcaattgctattctgttcatgaagttcatggagaattctgcattgatgagaaggctttcaacatgaatggcttatatactaggaaaggttatcaagtccactttccatcggatcaaacggcatgtcattccgagctttctaccaacggcaatctcaagttgaagacatcatgtgcgggtagaacgggcaacgcgcaagtaacaacaatggtgatgaacgtcggctttgaacggcatgtttggatggagttatactatcctatggcccatcttgggttgggaaggagtccatctataatttctccatggattgaagccttccaaagcaaggagtttctagacaaggaagaaaagattcagttcggactcggtttgggccagcctggatataccaggactaaaacgcccgtttctgtctcgtccggagtccgttttggacgtgtgagcacttgttgaaaagctaacttcatgacacacttggtggatagggcctaggacacaaattccttctggtttcacctcaagagccaaatcaaattgacggtgctgcagagaggtttctatattgtgttgtatttgattcgtagttagtttctaacacatgtaatggctatatatgcctttgtacacgacccctgagggcagaccaagtttaatcaaaagaaaatttgcagcaaatttagtcttgttcttcttctagagtatttattccgtggatgacaaatgtggtatatggtggaatggagtgtatgtgtcacgcctagagattagacaacccgaatcaccggctatctgtgcatttaacctctatccaggcatcaagcagagtacacagatgataatttgatacagttccacgtcttacaaaaatataaaaaaactcagaaaagcagcaaaaaaactaaagaccatctaaacttattcttctcagcaaagggaagcttccaccataatccacaggcaaaacctcgacgtctggcacaagcctaatcttcatagaactcaccatccgacaaattctctgcctctgggattgggaaaaataaagcaaggctgagtaccaccaccgtactcaacaactcataccaaggggaaggtatcatgcaaggatattcaaaggaatggctgataggatatttgaagtaagaagcagcatttataaatcataagttgaaagcagtaaaatagtagataattaagtagtattaacatcatcactatccaacgctaaaaccatgttatgataggtccaacccaaaccacctgaactacaccagttcattaggtcaaattattaaggtgagactagtcacggtgagctggttgaccgcccaataaccgcaggcacggctattcaaatagttttactctgattagagtgtacaactttactcacaagacacgattccacacatgttaccatgccccgaagtaccaccgagatactacaaagggggaaatcatgacaaaccctccatatagcctcccctaaccaacacacccacctccggtttcacccccatccctatacaggcaatgtgcagtccctgctcgtgccaaggtaaatccggaaggagcatagaccaaaatccaggtccatctgtactccatcactgtcgtaggctctccggaccttccattataattgagagatgaaatgaataactaaaatcatcaaacaagtacaatgaaatatccgacgcctcaagagaggaatattggagacattgctgggcctttagcctgccagtcaacttttgcctgagatgtgctcgtcaaaccactcgaaggcagcgaccagatgtgttacacattcaggagacttgacaaaaatggctaaagatctacaacatctcaaatattcttaactcatactcatgtgaatctagctcccaggatgtgcactagactcacactttcatctcaatcatagatatacatagcaaacacaattaagatgaaagtgattataaactacatctactttagttacattggccgaccggccaaataaataatagaacaacggaagcttgtctacccaatccacaagtgcaccgactagcggtttaccctagaagaagcagtcgattacctgcatcactcaaagactaagtctaaacctgcaaacaaaaggttaattcaacagcaagagtcagtacattatttctaggacttgcctaacactctacttgcaaggcatataatcaaagaaggcatgatatggttctttttagcataaagcaagttttatttgtataaaacatttccaaatcagttttgctttcaaataaatttcagcaagcaagtacttgacatattgggcatcaaagtagtcattaatcatgtataaatatacacctcattgccatccatggtagcaaggagatcattcacaaatctcatcacattttgaagttaaatttcagaatttagaagaataaacacaagtctatactcaatacatatccacacgccgctcatgaccgcgagcacggctaatcgattagttttaactctgcagagtttctacactttacccacatgatgcgaaataataatcatgcaagagcatggcacgcgataaataaatacccgatttattacccgcatcaaagcttttccaaaattcatgatttagccttacaccagcacgatacgtgttcctccatcctagtcatactggaaatatgacctagaaccgttaagtggcgggcccacgccttaaacttaatgccatggtggcggacacaacgggaaccctccacgtggcacaataccgttgtattggacacgcttagtcacctaaactaccacttcggggtaaatatgaagctcctctaaattattcaaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcacactctccccctatcggtacacatctaatcaccatatatgcaccgcttgaggcccaaacctaaaatccatgttttccaccattttatttatcgaaataataagtattaaagttctgtccagattatttaaaaatcaattttcatgtttgtaatgagcccataatgacaaggaagaccattctaagcatggctaagcattatagtaacctagtgtcaccaaaactcatatataaagtggtatagtcatattgctcctaaggttatgaatgagggatatagatatatgtggggttaaggtgataatgcaaataataggagtttgtctaacgagtttaacaaaattttaatttattagtgtacaatcgacatgaaagatttgcaaacattttcaataacctctaaaacataggttcaaagtgatcaaagagagggagctgggacttgccttgcaactgaaaaatgtcagcacctaattcacttcttcaccgtttaagcaatcatctatacaaagtacacattatgcaattaaacaccgaaatatgcgaaaattccaaaatgctctaaaatgcttgatttgtgcacaatggataggtactggtataatatgaatttaggtgaaagaatttctattttatctctttttatttgagagttatgaattttagaagtttgctcggtatagggtagtatttatttaggtactattgtgaaatgctgttgtaaggtgattcttattaagtttatgtttgctgaggtgaagatatgtgttttctaagactaacacatttggtttcataatttagagttaatatgaattctttatgtattttacaagttttagtgtgttctaggcatatagtctttatgtgcacatggctttggagatttagatccagaacttgctctaacttgctagtgttgtataaaatgagtattttagttaactaatctaatcttagttcataattttagagtttatattattttactacacattttataaatacggatgttttatgttagttacttaacttatcaaccaaaagattgttgcatgagctaagttcatctaagttttggtagatggggatggaactatggctccactggtcctaacaagttttattttgatttatttggagctaccatgcatatatatacttattcatatgtattgtttaaccactattatgcgtttagtacctattcttccaaattaaggtttagagttatggtctgtacaaccaaattaaggtttagagttatggtctgtacagagggtgccataattcactctactaggttgaagtatattacttgctggttctacagaaatttggttcacttcatttagactaaagatgaattttctacaaattttacaatttaaggtatgctccatgttgcttattccttacataaatgcttaggggttcttattatactgtaagtatgtctttttattttataacattgaagtgcacaactctgtaattctatagaacttgagtttactcaaaaaggatctaagatgaattttatataaacttctaaatttcagcttatgcaaaactagttattttaaagataatagttttagaggcatttgatgtaaagtatgtatatgttttattttactttgtttttagggaacatgttggtggatatgtagaaactaagttttctctaaaatgagttgaaatgaattttgtttgcattttataagtttgtatatgctttatgtatgatttatcttagaccaaatttagaggctacatttgtactgtgagtgcaagtttttatgaaataacactaatttcatgattcgatgagttaacagtaatttgtattactctaaaacgagttgttttcaatttgttaacgattttacaagtttacatgtttttctgatgaaaatataaagctttaggcatttcatttagatttttccagaatttaaatagattgggtccacaggtcagtctcaagccaatatgcagaaaggcccttagtgtttcaggaaatcaacccgcagtcctgtgactgttctgtgtgtgaggtaggttttacaaagtagtacctagagttttgattcttctcaatcgaggtccttagattgagctgacacagagctagccatggccgagctcattctcgagctcgctggcggcaaacggcggcagatctcggtgtgcaacctaaggagaaaatgtaaaggggttcaaggtgaggctataggtggtattcttgcaagcattggtcatcgaaattaatggcgacggcggtgcgagcggcggtggttctcgggtgacggtgcatgtggagctagggcattgatctaaatgtttatctacatgcatgtgcctctatgggatcctaggatgcttaccgagcgtccaaagaaacttggcgaggtccagatagcgatgaccacgagcagaacgactcggcggcggcaagaacctccaggttgaacggcgacggctcaatcggctccaagaacaatcatgcatgtatgtccatgaggttattgaggccagagagatggtgtgtgcacgagtaatcgaataatggctcactggaggaggcggaatcgacaatggcgacggcgaccggaggtgaagaagacggtgggccgatctccgcacttgttgcgccattgcctgggattttttgaggggttttgaggaggacttcaaggagaagatgttggcgcgacggctcggcttggcttggtctacagcggttggaatgacgacgagaacccgacggctggcactcggtgttcgctccggagcaacgatggcgaggtccacgttcccgacgatccgcggcaccaaatgggatgaaacttagaggaatgaaatcagcttggagaggtgataatggaacgcaagtggaaaggcgacgaccgcggcacaatgtcgacggcgacggccgtcgtcttcatggccgatggcaaggatgagggcagcggaggcgaggcgatccctctctctcgatttggtctacacagaagtggtaatggagaggaggcgatgcagctaggaagagttgaaagcgagctcggcgttttgaggatggcgacacgtcgtgtacacgtgtcagccacgcccagaacgcctctcctccctctctcacgcctgctggtcggttaaaggagttggacggggagagggcaagcccaagtggctgccaagcgggcccaggtcgtggtaaactaggtggaagagagaggtgtgggtagaaacatgggtgagtttggtttttggacgaatttccggaattattttcctcctctaactttgtagcttcgtaacttaatgtgtgataacttaatgtgtggaccacattaactagtgttgattttactggaggtagatgattatacctagattccattttatttggttgcacttaaaaattatggatagattactcacagaaattaggagaagaggggctctttggaaactagtttggatttttaggagacctaaaaatagaagataaattctggaaaaaaaatatatttatttattataattaacctagtatttgaataaattattttccctatacgcttccatgcagctaaatgctcttttagacaaagtatggttttagctgattaggaattataattagtctattatttgagtggtttgactgatttattcgaggtataaaatttagttatgaaattataccaaaattacagtgagttgtatatgttaagtagagcctacatgaattttcccacgattttatcttgcacgaattattttagataattcgcaagacttatgtcttatatgtgtttccctttcctaaatgcatgtaaatgtttacaaaagttatatttggactctcaaaaatggaaaagttagcttccaactattttgactggaaacttttaaggtctaaaatttggatatgttataatcacgcccacccttgccaacggtgtgttagctagaaaagatatacttaagatttagcctggagcgcatctggcatgtggttagtacgagtatatcttccagtgattcctgagaaccggtcgttaattgtcatgggcacaaccaccaatcaaatcatgcatgtgcccacgacccaccattatagcatattttaattaattaattatataccaaggtggtataacatcatcataaaaattaaggactaaaatatagtgaatcccattgtgagctagttgatcttagcatggctaagcattcctaaaccaatcatctagtcaaattaatatcccaggctaccgatgaatcagggtattcaaaagggctgagtatggtaaattccatcccacatgacattataaaacaatgcaattttaagagaaaagcagggattttgcaagtacgctcaatatgatcaatgatatccatatgacttgccttgctcttgagctgacggaacctcagcgaccactttaaaataaactggagcgacggaactgctggagtctaaacgacaaacaaggcacacaatgaatacaagttaaaagctactgaaacagcaaaagaaaccaattttaatggattcttgacgtttaacgaatttactgcaatttgaatgggttaaaatggagctcggatgaattagatatgaattttacaaggtgaactcttttattactaataaccgaaaaaccttaatcatttgacatagattattgcccaaaaggaaatatgatcaaaggatagattaacattggtgagcgaaccttacgagataccgactcaacgagtcaaatctacgtgacacgggaccatccaaatgatcaaccgaaaccggcgaacgaaaccggcggctctgaatggctctaaactaaggaacgactcaacatggatgaacgaacgaaacacggggcgacaccttgttcaaactaatgagcgagtgactcaacaatggctgcggctaaatcggtaggctagacacgatttagggtaaagcctcggtacggcaaacgataggccggtaggaatttgtggttgcacttaggtgttggtatttctgacgatcataaataaacccgcaagcgcacggaatataccaatatagcacttcacccgggagtattcttaggtatcgatttccacagggaacgtgtgtgctaactccggttcaggttcatccaaagacacgaagctatggataggcaaaggatagagaggtttcaccggtgaagaacaatgtctacggaaagcttaacttcaatcctaatgaggtacttcgggcactggccagctcactgctcccagatatcgctgtactgcacacccggacagggaggacttagtgatattgagggctatcaccacctctacacccacctcacacctactgtgggatggggagcaaacatcggaaatcaactacctagacaccgcatctacgcagttaataactactctagtgtttataactcactaaagcaatcactatagtttagttgattatagtgaacgatgatcccacactctgaataggaactaaccaataaataattcttaaagagcaaaactaaattattcaaaagatatttcaattataatcagagtaataaacagagcagaaagaataagaggaggattaccgacaactccggagctcctccgaaatcttctactcaactctctccctaatcttgtataaaataaagtacaatagatcctcttataattcagctcatgcttcaagtgtgtgtttacaagtgaggatgagaggggtatttataggtagagaagtgccttgggagtgtggagatgctccaagcattcaaagagcatcttctctcatgtgttgccaagtgtcccattctgatgacggtttctaccggtattaacgccataaccgtcaaatggaagtggagcactaccgaactgaacttgggcctaggccagcagcctctgtcagggttcggccgaaccctagccgactccattaacgccgattttcggcgtggacattcattttgggcccctcattctattggtatggatggaaggcccatttggaggtgtttaattgggtttctgggtccaaaactccatatgttcatatacgcttttgattctcctcctccttcaggtatatttcttctcaacttaggtagtttgtcacttgcatacgaatatacacgaacactcgtggaaattgttagaaataaaccctacaactatgttggatgtttatatttatggttttatgcagatattgatggcttaaattttgtatttaacagccgtcaacaaacccacacacttagctctttactcgtcccgagtaaaggttaaggattaatatggaataaaatttcccaaaatataatacaagtacacaaattattcttagccatatctgcacctgtgaactttgagtatctaacttaccatcttgggtaattgataaatggaacggtcatgactcaagtccttcatgttcctcctgtcaatctcttggggttttcatatattttcacaaagtagctatactcctcaatggactttctctcaaatcactcatgtggtttgatttgtggatcttcaccaaggcatgtttgtcaaaatgtctctattctaaaaggctagataggtggagcttggtagggatcaattggggcatacctgcatcacatattgcaaagccaaaagaccggacccaaggagatagcaagtcatactctctgatcaagaatgtgcatgtgtgtgatatgtgtacgtgtatggcaaattctgtggatggaaaaaggaaaataaaagacaacaactcctttcgtatacatcctcctccaattttctctctttggaaatttgagagagtgcatggctatcttttttcttcttttttttttcatcatgccacatactttgtatgagcaagttttttttctctttctttttgttttcactgctccatacttgtatgagcaaggctttatttctttttcttttgcatagccatgcctctctctatctttttttcttttgaaagaattttggaggaaaaggcataaatgacatggagtttttattttgtggataatagataaaataaataatggaagagagatgctagcttgcagtgtagaagtttagcataagtgtgtgtatgtggagtgtacgtgatcttgatcatgaaagtatgaaaagcatctcacacgggtcacaagaatttgacaaagctcaatgtaatgccatgtagcctaaacatatatcaggattttgtaatgagaatcatatatggccttggtaggtaataatatagtcactgaggagtattgctcgaaaagaatttttgattttcacaaaataaatcccaagtatcatgacagttggacatgaatttctattgtcataaccatatcacatatatcaattacttatattagcaaggttccctatgatagatggttgttcacaactaacaagtgttagcaaagaataaaaagtatacatgataaatcattggaaaattctatctgttgagtgttaatgcttcaattttcatttggagccaaactaaattgtgttcaattttctaccaaagtttaactcacaatcatgggaggtgtggagattatgggtaccccatacccacacgatatggttatccgactaattataggggataacttgtatctatggaatatgtaacggatcatgacatgggtattacggtattacgtttccttgtatattatggaatggcctaaagtcctggtttgctaattttgtaaagtagatttagcaaaccgatactgcattggttaaggtttctatcttgtaatcttgccccccatgctatataaggtggacaggaggtcctctaggggggcatattcacatatgatcatcagatcaatactacacctggcggattcaaattcccaaataggagtagggtattacctctcatcgagagggcctgaacctgtttaaatctttgtctccacatccatccacttttaggtctcgtgcgctaccccattttattgttgccgaattcttgtttcgacaggaggataaggaaggacacctacaaacctgactacacggtgaaggatgacagcaccgggctaggcaaggggcgagagaacacttggttcggccaacccagctaggacatggttctggctgctgagttttgtgcgtgtccgtgggacaatgttcatcatgttgtccaccggggtgaaataccggtgagccaaattttattcaagtaactcaaggcacatgaagtgcctaaattttttttttatttattttcatattttttcatggcaacaatggaggttatgggtaacttagcagggtggagatatgaggcgcggatgcacaaggtgtttcagatacttaccagacggatcttaccaaacttagaactgaattgaatgcaacgaagttttgcatttgttctacttggttccctgtgcaacaagcttcacagctttctatgataccaaggagcgtgggattggtgttggagttattgtacaccgctccttggttgtcactttattccctgcaaaaggttagtggacaacaaatactagagggactacaaagaattggaaagattttttcatagcctcaagattaattgttaacatctacgctaaaaaggaattggattcaaaacttaggaagcatggatcccacaaatttgccataattttattttgtcttcattttttttcttcgagagacatttcttttattctttaaaacattttttttaatgttttattgttcaccaaattttcattaagcaaaaactcatacaggacttacagataaaattgcacgatcataacaaaggagcaattgacagtatacttactttgcaccttgaaaggtgatgtgttactctctttgcatgtttgcaatttattgatttgtttcccgaaccctgacttacctctagtgtgaattgaacttgaggactcacccatgaatttgaaaactttcctgcagggggttagtccacaaaagatatgcatctgaaagttcattaagcaaatttgactccatgtctaatttgattaaagcagactatctaaacctatagatgtcttgcgcaaacacccaaaccagagcatatgcaaatagacacaagaaacataacccatgtatgctcaagcctcattcaaataaagataagtatgagtaaaagatgtggtgaatctttcgctaccttttgtatacctaagtgtacttaccgccagcacgatgtgtatgttgaattctctggagcggtgctatggtcgcatgtaattgtcgatctcccatcagtcttgatgcggattgtggcaagggaaggctgatgaggacacaactagctcgcatataaccatgactaccttatgtattagtcaaccaaaggtgcatatgttctacattagatttacttgttatatatttgaacaaacgttgctacacaatgagttttgtgtgttttcgtttgcagaggtagttgcttgggcgaaagaaaagagaccgagcataaggaatgcatggatgattgaagaagttgattggggaccaaaccaagaccttctcctagtcttctttcatctcaccacgtcacttttggtccatagaagacaagaaataaagttccacacgttttgggttcggattcaggcctcctgatagcaccaacttcaaatggacctagccactgatcaagaaggaattttggggcccatgagtacttgttggaaagcttatggagtctaatttcagatggttttggtcccacgtcaaaattcctaccgggctgccgggaatctgcaaaacaagccatgtacctcatccaatctgtatctgatttcggttttgggccttgtaattgtgtcgtgggctcccaagggggtgtgcgccctagggcaaccctaggacgtccctaatcataattaatcagtagccgtcgtcgtttagagttgggttttgcttagattattttgttaagaacagtttcgctgctagatcggtttgtggaaccccaaattcgagtgcttaataattcatatgcaattgtgttgcaatctatcttgttcttgcttttgttcttctattcgcatgcagggattagccttctcggcgaggtcaaccaggtttaggcacggttgataaccagaggagacgtggtgctgcgattgcggggcttagtagcgtattcgttcagaagccagatcgagttgtgtcgcgactccgcccaaatcgattgtttatcaatacctatcggaagattaggacctaactccctcatcagttggcactttgaccacaccaactcaggcgagtggttcggttatgcacacaactcgggtgcatgaaccttatgccttgaaggcgtgttccattggtagaatgctgtagagacgtagggtgcatctctttttgggcaaatatgcaagttccaactggagtggagtagcaaacacctagaaaagaagagggcgtctcctcttgcttgtgtgcgagtaggtgctgcgggagcgagaacttgtgcacaactaggagtggatgaaggctaaccaaggcggcacatgagctcaagagaggggctgggtgcagccaagaagaataatagctactggcgaggtgtatagccagaaaagactcgcacataatgcggtctttgatctagatcgtcagccctcttgctctcttcctcttctcccattcttttttttcttcttttcttttgtctctcttttctttcttttttttttcttccacacttttttcagcaaggtaagactaacaccagctttaaaccaagatggcctaggttgacgaaacccgccaggaagagcttgtcgacctccctgcctcacacttggacttttgtgtcatgagacgtcaaaaaccaagtatgtgagactgggatcttcataaagtgtgttccaacacatgaacagttgatgtagctcccatgttcttaggcatcgtacgtctctcgttcttaatcttcacctgaaatggttcttgcttttattggaaagaaaacttactaagataatccggggtgtctcccggtagtgttttgtttgtggtcacaagctcaaccattgagacatcatgctgcaagattagtgtgaatacaaatacgagatttgcagtatttatgatagttaaaagcatccacaaccacacttcaaaacatgttagaaatgagggtcgtaaggtggttgtggtccttgtacaatgaagtggtactaattggacagtactctggggattccttatgagagcatgtatcttggggaactttgaaagagaggctttcatgctcatttgtggagttcgcatcctctagagttgatgtctcaaacttgtccttggcctgaaagttctccattgaaagaacggggttgtttcttgacaactgtcgagaacaacatcttgagggccaaagggacaaggctttcgctcgattggaggttgtgatggtggttctatggagtgtaattcaaaagtctcgccagaatcttctttttcaatgaaacaaagatcatcctgttctagaatagattcaggggacacatgaatctatcagggggatgcctatcaaggttttgtcataatcgctatgaggatcatccctgaatttaggagtgcaacctggagcttgatttctttggaatccggagatggctccaaggaggactctttagtcagactttatgatattgcgggcttagattcaggttcggcaaaagaaggttccntccttcctgacacnnaaatgcctctggacggggctcaacacactacccggcaaaggaggtattttccgatatgcgatcgagaatttccttgccttcgcgggagttttgtgcatgaatgaccctccaacagttatgtcaaggtagaatgcagactccctatctaaacccatatggaaatgttgcaatagcacgtaatcaggtatagaaagggttgggccagactatactaaattagtgaatctggactaggctgcacaaatcgattctctatttatctgctgaaaactcagaatttctacacgaagagtagtaatacgggttacagggaaaaatgggaggcataacctgtctcgcaatttctcccagtcactgtttgcacacccgacggtaaatatgtaccattgtttcgctctcccatgaagtgagaatggaaataatttccaccgaacagtctcttgcttcatgcctcgaattcctgcagatgatgtagcggttttcctggcctaaaccatagaaagatttctccctaaccatacggatgaattcgagacgaatttcattgccaggtgttaaaataggctccgatgaaggaggtggctcgtaaaattcgccctgaggagcagataattggaaaatagattgcggctccatcggttgagaaggtttactggaatacttctcggggatagcaggggtaaaggtagaagtaagaaaaataaaaaggatacgaggatgaacaaggttcggagatagacaacaatcgttccccagcaacggcgccagaaatgcttgctggtatttcttacgatcacagataaatccgcaagcgcacggaatataccgatgtagcacttcaccgaggagtattctcaggtatcaatttccatagggaacgtgtgtgcttactccggttcaggttcatccaaggacacgaagctatggataggcaaaggatagagaggtttcactggtgaagaacagtgtctacggaaagcttaacttcagtcctaaggaggtacttcgggcactggccagctcgctgctcccagatatcgctctactgcgcacccggacagggaggacttcagtgatattgagggttatcaccacctctacacccacctcacacctaatgtgggatgtggagcaaacaccttaaatcaactacctagacaccgcgtttataactcactaaagcaatcactatagtttagttaattatggtgaacaatgatcccgcactctgaataggaactaaccaagaaaaaattctaaccgagcaaaactaaattactcaaaagatatttcaattaaaatcagagtaataatcagagcagaaagaataagaagaggattaccgacaactccggaactcctcccacttcttctactctactctctccctaatctaatacacaaggattagattggaaaggaggaatcttagtggaagtaggattgggagagggggagggagttggataggagggggagggagttagacaggagtgggtggggtgcagtggcgcgcgcgcgacaatggagggagggaggcggcggccgagctaggagagggggagatggggaggaaataaaagaaaggaagaatggattaggactttcccaaataggaaaaatcaattcggtgcggcagcttcgaattaaatatatgatgtggtctcgctcattttttaaggccgttttaggaagagaatggaaacgatcccgcaaacaaaaacagacacggttcgccatgcaaaacgaaactacgaacagagaggggagtgaattaggcacaattcacgaccaaaggcacaaggaagaattattattaaggtgatcttgacacttttaaacttagcaacactgcctgacaattctgattattaaatatattgttaattagggttttctcctggttaaccaaagcaatttctatagatcatttattagtgacttggaacctaagggaagggaaaactccaggtgtgacaaacctatcccccttaaacagaatcttgtcctcgagattcggaagaactggtgaagagatggggatgggtggctttcaactcatcttctctttcccaagttgcttcatcttacgaatgatggctccactatagtctgcaaaacctgatcactttatttctggttctcctctcactggtctccaaaatacatgtaggcttctccacataagtcaaatcctcctgaatctcaacattatctggacttgctggttcctcaagcacacttaggcatttcttcaactgagatacctggaatacatcgtgaatgctggccatgttaggtggaatttcaaactgatatgccacttcacctctacgttcaagaattcggtatgacccgatgtaacgttgcaccattttcccttggtctgaaaacggtgcactcctctgagcgacataactgtaaggtacacttgatcaacaacctcgaaactgagctctctccgatgattatcggcattgcttttctgacgggattgggcaatcgtcaatctctccctgattgctcttactttcacttcggcctaactcaacacttctgtaccaaacaactgacgttctctagtttgatcccaaaacagaggcatacgacactttcgaccttaaagtgcttcaaacggtgccatgtacaaactagcttgataactgttgttgtatgaaaactcagcatacagtagattcttatcccaagatccaccaaaatcaagggcgcaaactctcaacatatcctccaaaatctgatttacttgctctgtctgaccatcggtctgcagatgatatgctgtgctaaagttcaaacgggttccaagttcctcttgcagcttatgccaaaactttgacgtaaactgacttcctctatcagacacgatcttcttcggcacaccatgcaaacagacaatcctcgaaagatacaactctgctaacctctttcctatataagttgtatgaaccggaagaaaatgtgccactttcatgagacgatccactattacccaaatagaatcatgacctgatgatgtccttggcaatccggttataaatccataccaatttcttcccacttccattctggaatctgaatagactgcaaacctgctggtctctagtgttctgcttttactcgctgacatacgtcacggagtgctacgaattctgctatctctcttttcatactgaccgaccaaaacttctccttgaaatattggtacatctttgtgcttcccggatgaattgaatattggatctggtgagcttcactaagagtcaactccttcaactctttgttgtcaggcacacacaatctttcacccatccatatcgttccatgttcatcctcagtaaaatctcgggctttatccactcgcatatttttcttaagctctgctatctctggatattttgcatgcgcaacgagtgtcggctgtgcttccaaagcggcaacaaaaccatgttctacaattcccaaattcagacgttctaggtcttgtatcagttgagtacttacttcttctaagcatgttgcattgcaataatttttccggcttaacgcatcggcaacgacattagctttaccaggatgataatctatacacacatcataatctttgatcaactctaacaatcggcactgacggagattcaaatcgggctgggtgaagatatacttcatgctcttatgatcagtatatatatctcagaacgattaccaatcaagtagtgtcgccagatcttcaaagcatgaaccactactgctaactccaaatcatgagtcggataattgtcttcatgtgtacgcaactgacgcgaggcgtaagcaacaactctaccttcttgaataagcacccatcccaaaccttgacgagatgcatcacaatacacttcaaaatcctttctctgattgggcagaatcaaaattagagcggacactaatctcctcttgagttcctcaaaactctcctgacactgcgaagtacgaacaaacttttcctctttcttcaacaactgtgtcattggcttggcaattctcgagaaattctcaatgaaccgacagtaataccctgtaagtccaagaaaactcctcacttgcatcactgtcttcggtggaatccacttagtgactgcttccacatttcacgaatcgactgctactcttttagtggtaataacatgccgaacttgacttctttcaaccaaaaatcacacttgctgaacttgggatacaactaatgctccttcatcttctccaacactacgtgaagatgattcccatgttcttccttagactttgaataaaccaagatatcatcaatgaaaaccacaacaaactatccaggtattccatgaacacattattcatcaaattcatgaagaatgtgggtgcattggtaagtccaaacgacattactatgcactcgaacaattcatagcgagtcgtaaaagttgtcttaggaatatcctcctcgcgaattctgaactgatggtaacctgatcacagatatatcttcgaaagcacagttgctcccttcagctgatgaaacatatcatctatccttagcaaagggtacttattcttgatcgtaacatcattaagcgctctataatcagtagacatcctctttgtcttgtctttcttctcaacaaaaatcactagagcaccccaaggcgatgtgctgggtcgaatgtatcctttctgcaactgctcatccacttgcttcttaacttctgccatttcttcggctgccatcctgtacggtctcttgtagatgggagctgtacctaggaccaaattgatacggaactcaatgtctttctttggcagcatagctgtcgactcctccaaaaaaacttcagaatactcacaaaccacaggaatgtcttctaactttgggacatctttcatgacttcatcctgttgttcactttccacttaattcaagcttacttctttcttctgaataaatggagattgaattactaccacttctccatttcaattaaccaacgtaattgtgcggcttgcacaatcaataactcctttatgtcttgtcaaccaatccattcctagtatgacatctaggtctttgcactccagaaggataagattggctagaaaaggtgacccttggatttctatcatcaaagaggaacaaaaactaactaatgttaagctattacttggtgtattaactttcatgggagtactaagttacacttttcttaacccgtgtacccaaacaaatctcttggatataaatgaatgcgtagcaccagaatcgaataaaactgtagaaggaattgagttcacagggaacgtacccaaaaccacttctgacgctgcttgagcttcctttgtagacacatgataaacacgagcttgaacgaccttgggtccattgcgcattgttttagggcacttatttgcaaaatgtccggtatctccgtagttgaaacacataaggggcttttgttctgacttcttctttggctggtggggctgcaaagcttgagactgggcgggcgcggaactggattatggttgttctgatttccactgttgcctcggctgaaatttcctagctgatatggcctgtgctatcgaacaatcataatagtagaaccactgtgctgtccataaccacagcgatgcttctgctgtccaccttgctgaaacctgaactgcatagctttcctcttgcgatctatcttgttacgttgatcttcctaacgaatggtcctgtccacaagtctctcaaaatcagcatagtctttagaaatctcctggttagtcaatgttgacggtccttaaatcataatatttgaccatcaatacttacatataatgaaataaaatatggtatccaacttagtggtagggtttataactaatcatttctaccagtattgatgaaatatgtgtgtgcagatattttgaggagaaaacacatccgtcatgcgacataatgcacctctgaacattcaggacgcgtttacacgaattggaggcaaaataagtcaataaaaaccatctaggattgggccaaaacatagtgaaggatgttgggggcccattaagcaacctaccggccgaaggaggggccgggaggacgtttttctagttcttgaaccaatcctggcacctcccgccatctggcttcacgtggacggctcggatttctcccctatggcggttgcagggtgttttggtcatttcccatgcccctaaccgtcatttggaacctatataaggaggtctccttctcacttcaagaacacacaactttgagctgaattacaagaggctctattgtatcttttgtacattagaataaggtagagagtgaggagaagctctggaggagtgcccggaagtttggcactcatccgacttctacctcgacgagtgcagcttcctaggagaaattatggaggagtaccggagctatcggtacactctgctccaggttcggagaa

SEQ ID NO: 46823 - DNA, 1752 bp, Oryza sativa
agaaataccaacaagcatttctggcgccgttgccggataactgttgttaattttttggtcatcctcctatctttatttttatttttggcttcttttattcctttccttgatggagcaacccacaattcaaaatctttctgctcctcgggctgatctttgtattcgcagaacagagtgcgtatcggttgcggaggcatcggctgaagtctgcattggctgaaatggatcggacagaagatagccgatttcattgagatggttataaaaccgtttctggacggctgaaatggatcggacagaagacagccgatttcataaagatggttataaaaccgtttctggaatcgatcaacgtgctacacaaggattgccacgatggagataagctctcagatatgcaattgtatctattaattatgatattttaaatagttccttagagatatgtttgggtaagagtctgccgtaaagacttatgtgtatcttagagtttgctagagataagagtcgtgtccggcaaggacctatcatgtatctcgggtataaatataaccctaacccatgtaattaacaacaacagttcaataacatttttggtgcatcgccaccctttttacttgctttcaataacagttcaataacaacaacagttcttgctttcgggttgagctgcatcgatttcaatcttcaacaagaggtaaacttgtcatggcggcttgcattctcgtgattagtgcttccatctttatgacattctaatcttgtatatgtaaatcgtcgagttatcatatatgctctataatctttattagttgcgccatctaacctgcaatcggctggtttctactgctagagagtagccgatagatctagattttggtattaatctagattatatagcatattgttgatgtgaaaaggaataagttcaccggaggtccctcaattgacaccgagattttttaaggtccctaaactagaataccagaaatgtgtacccctaaaattactaaatccgtccgtagaaggtccctcggcagtattgactcagtttttgcccggttttgctgacatgtcgcgctgtgggacccactagtcagtccgccgttggggagttaatagacggggttaacggaggggagcgcagctagccagacctccattctctctcctttgctcgaactctagctgagctgcgaccaggaggcgacttgaaggcgacggcgggtttgtcggcggcggcgagctggccatggcgctggcgacgagcatcgttttcgtccaaacgcgtggcggattccaccccggttagtaccttgttggctcggcattgcgtgctattgtagctggtactgtgttgattttgggggaagatttaaaatgtggtagattcgttttttgtttgggattcggtgtagaggtcaagtagtatattgtcccatatgctttaggtgtagtaatgcttttgtatacccatgtgaatctgggtgggttagtgttggggtggtccttttttaatcggtgttaggtgttaactaggtattagggatctggatgtagtgtagttttaatagtagagtagtaaagtgcttctttttttaatttttcagagctggcagcatggatcccttcggcactctagcagttaggttccatttcaatggggaatttgttaatagagggagacagaagttgtattgtggggggagagaagcaatgtcatacatagacagggataaagtgtcattacct

SEQ ID NO: 46824 - DNA, 6996 bp, Oryza sativa
ttcctgcacccctatctcgtctttcatcggcttggtcggacagatctttcaccacaaccagaggatggttgtttttgtgaatggtggctaaagatcatttctccggttcaaagcactggaagtgtgatctgaattcgctcattactttgggagtgtggctgatttggaagcaccgaaattattgtgtttaacagagtctctccatatgtgcagttgtttcttaggcaggttttggaggatgggctttgtggtgtttagcaggacctaggggcttggcccagttggaggtagcaggtggctagaatttttttggtgtttttggtcacgtcctcttggttttggaggattttggtgttattttcctttccttttccatcaccacagcagtgggtgtcttaaatatttaaatctaatgcagtgatacacaattctcttgcgtatttgagaaaaataacggtactagctaaatgtacataggttcgttaaatgttcacatacatttttgaaaattcattcacacactacatatatacagatgaaattttaaacgttgttaaagacaaatagaattacaccgtagcgtttagtatgggcatattactagtatatacacaacaattcaatcatcttagacctttttgtattaaattatgatcttgaaggacaaataagaaaagaaaaacaacatatggaaagtccagtgtgtaatcataatgaatccagggagcaatttgcagaaaatgaaattgatgaggtaatggtggtgccagtgccttcattttaggaagtatagaatctatagatgcatacgcacaaacttttaatgttcaatccaatcattttcttgagaatataaaatacaagaaatacatactaatgtttttcggtgcactacaacagcgatgaattgggccacagaattagcatgtgtgcataacataaggacacgacagttgttcagtgcatcatgaaatagtcatgaaatcctcaaaaatatctggttgtgatatatcagcttttcctatgaacgtttgctgcttttgtattggcacacatgactgttagacaacaaatttgtttatgtgagccccaaaaaaacagagccccacaagagcagaacacctttgtacccatgaaatgatcctagtatcactctaaaagtagcaggacctatatactgttgccctctacatgaacttcatgatcactttccatgaacatatgggataacaagttatagctatagctttagtaaaaaatcttgtaaaggatatatcatcagaacatggtgaaaagcataaggatatgcggctggtggtccaaaattttaagctatagtcatagctataatgctgagacaataaagcatttgtcttgaatattcataagtgtaaaattccaaaggaatatgtgtagatgtgtccatacttcttaaattatgtcctatctactgtaaaatgacttaaaaaagaacaccagctacccagagtagaatagaattaccttagcaatcccatcaagcattctaatacaccaaccatgaatgccaataatatggctaattctgtgtacagctcactagatgaatcaacaataccaccgaggacattagaaactagaagagagacaagagccactggacccactgccaactgtctcgatgagccaaaaattgcatagacaaatagcgggacaaagcctgtgtctgttcagccatggaaatagcatactaacgattaagctcaaagacatacaaatataaaaaactacaaagacaggagttgcaaaagatataaatacttacataacccatatattgggtgaagcccagccaactttgcatatgacattgcctacaatacaatgctaattattaatattttcatttctggcattttttggttattattttcaggactttgaccattgcatatttgtatcggaagacttttaaaaagtttcgacagacttaagataaaattcagatgactggactatcaagtgtcaactgtcaaagatgttgacattctcatgcaccaaagttcatgaatagaaatgaaattgttgaacaaatgcgtcccaaaataaggctaatttatgttctccatttggcaaattcagcctatgtgaaggatatacaccagtttgcaacttattaagcagaaacaccagaaaagatgtccagaaaattcagtatttgtcagaaggcaaaccaacctaagtcctcaaactgcaatttgcaatggtgttaacagaaggggtagccgaatgatatgtaagcaagctacatgttcgatagagctttccatctatagctgaatgcattgctgaaaataactccatatatggaaattgggattatcttattccgggccagcatgaaaagatggttggatccactaaataatagcgccgtgtgcaatagaccatttttaggagacgaattgacactcatccattctatacttcaataatccagtcatactacagttgacataattagatcttagaactagcgaccaccaagcagtaaactgtaataacttcaaaaaacaattatgtaactgttcctggcgatatgatgacaaactaactagacaagcaagagaataacctggagattaacatgttcaatcagtagccaaaaaatcaggtaattacaaggacattctacatcatgtttcgaggcaatgagttttgaaattaacaaatataaccatatctttcccgtttgataaccaggattaggaacagttgaagccgtgcatagcaatacgaaatgttgcgaatcacgagggtaaagaatgtacttggggcacgagcatgacgccgacggtgatgccagcggcgaggtcggcctgcagatcctccttcaacctgtacgtccgcatccacgacaagcagggcagagccgcctccgcccaatcccgcggccccattccccgcgccttcaccatcaccacggaccaccacgacggcgaggacccagcgaccgcctcctgtggatgccgcagtggtataacccgcaccgacctgcccccaccacccgccacgacgccgagctcgccggagctcgccgacgcgtaggacttctccattaaatcggaggccgcctccttgcaaccaaacgattcgagttcagacgaacagtaaaccccaaataaaacaaaacgtttagtctcggtctcattgctcaccgggaccggcggccaccgcagcggcggaggtgcgagcaagacgactgtgggtagtcgaggaggcgggcggccgtggacgggatgcggcgacgcgcggcagcgggatgagtgcgtcggcgagccgcgcggcggaagtacgcaggaggggaatggacggaatggtctctctttctttctgcgctagcctactagtcgaatgctgaggggtaaactgatgatccgacggtcctggatgagcaatgattcccagcctgaggctgacgcatcacgttgatgtaactggacgggaattgcggatgagtgcacgctgaccggcaagatggcgatgtacatggatggaatgctggcaccggtccattggtttgcttgtggacagaagagaagtaaaggtctcatcttatgtgatgatgcagatcgtgtaaataaattattccctcgttttccaatagaattatatgcaccggtccgttgaattttctgtaatattataccctctccattcacttttgatcaacatatactactgtttacacctaaatttgatacctatgaacgaaatacggaaaaatactaaagttttgaaagcgtcgggtttccttcacgggctggtccgaccacaggtgtatgtccggtctgagccggtctgaccgcaggcatgtggccggtcagaccggtagagtccgcgtccgaggcgaatttcattggttctcgggttttcttgctcggtaagggatgtttcgggttttcattggtttctatactgagttgaacgtggaggaggacttgtaggaggcaagaccaacccctttataagggtcaaggctggttcaaccccaatccccaacaatctgtaaaatcaaatcgttcttttacttttacttttcaactatgtccatctttgtggtttgcgccataaaccgtccgtcgtcgctgcgagaatacgattacccctttgtaggtttgttccgtaaacctttcgtttgcccacgagacgggtagttatcctcgtatcgatctaaatcggcctattttgatctctaaatcgactctgctagccggtttagctttttctacggaacccatctcgatttggcctttggcgagatcgggatgattgacgactccatatcaccgcaaggcgtttaggtgttccaaatgtgtttatcttcttgccaaaaaaaaattgccaacaactacataatgaagcatctgtttcatttgctcttcctgaaacaacaacataccttcaccgatgcgcactaaatggaatattggatgctttttttcctcggtcttgattcacttctcttatatataagctgatcaaaagtgaatggagagagtataagtgtgttggtcgtctcattaaaaaatatgtaattactctttactctgttttattatgaagtataatttaagcatgatttatatttttcatatttaaaattttttggacaagtcaaacatactattaaaaaaatagaggggccatcttcgaaaaaacatagaaagtaatggggaatgcgtagcagaccacctgattcacatctaaaaactattccataatgaaagaaaaggttagtaggatcgttggaccatctcttcaaaaaaaaaaaaaggatcgttggaccagccatctatttttttcaatagttacttgtgcgagaaaattagaaatctctctcctataataagtggagtacgggtcgcaacctatccttctcattgtgccgatagtcgattaattattttcctttcaaccattaatgcctatcatataattagcttttcgctgataaagacaatattatcctttcgcataatccttttgctatgagtagttttcagtgacaactaccctcatgttggcacgtaataaggaaactatggtgcacagtagaggaaaatattattgtcttattccgttatcaccggttcccacttctgggtcgtcatttatatatactagttgataccccgcgcttttaccgtgggatatgtagatgaatgcatattatacattatagaatgatatatgtacatgtttaaataatgtgaaaatgatgtggagataatgatttgacattgattgtatgttgaattctaaaaatacaataaaattgtaaataatatgttatatttgtttgatattaaaaatgctctaggtaataattattagtgggtaatgatgtggtacacttgcaagtgatttaaatactctatgtaataattgctagtgggtgatgatgtatcacacttacattgagatttagaagttagtggacatcaattttatagtaagatatgattccctccattttatattataatgcactttgactttccttttaagtcaagcttctataaggcttgaccaagattatagaaaaatagagtaactcttataacaccgaatttgttccgttaaacctaatagtgaatatatttcaatagtatgtttgtttggcgttaaaaatgttgctacgattttatataaacttagtcaaacataaagatgttcgacttagaaaaatgtcatagtgtctcataatataaaatggagggagtattgtgtaaactgtaaccatcgtttgtctatgcaaaagaaaactgatggtgttatttgtacattataggatagaaaaggtttgtataatgtatgtgaagtgttacgcttaccaaggtaaatatacggtacaaatcccaacttgggtgaaaactcgtgtatgaaagtgaatctagccctaagttttgcatgaacgacattaatatccgcttgctcgttaaccatctcttcttcacactaaccatcatccttggtctcacttgcagatttccattcacccatctcattcacaagcatggttcttcgactagggcactcagcagcaatgtggccacgaccttagcatttgtgacacacaatatcgcggctacgggacgaggattttgctataggtgtaacaagccgacgagactcattgcgtgtagctggagaagatgccgaagatggttgtagcttggctatagcagctagtggagaggctcgtgtggaggctctctgagaacgagcgccaacaaaagtgatagtttgttgcgtgcgatgccataggactgcattggagcagccactagaggaccaattatgccgttcttattgaatgtacctttccatatgttgggcttgatcaagaagatcttgcaaaagtgttgaataaacatctccaaaaagtcagaaatttcatcattgagaccatgcaaaaatcttgtcattttcgactcatcttctttaatgtgagcacggatcaagagcaactccatttccttgtaatactcatccactgtacgagtcccttgacacaacaattgtagcctattgttgacgatccttaagtaccaattcgaccatcgattcccacataatagcaaatagaagaatataaaatggaataccaaacttagaggtagtgtttgctactaactatttccacaagtcttagtgaatatttgtatgcaggtgaaatatggatgaaaaccacccaccatgtgacaaaatacacctcgtacaatcggacgtgtttacacggaatggagaccccacatgtcaatcaaaaccacctaaaattgagcacaaccatggtacagcatattgagggcccaccagacagcctctcccagccgaaggagtggccgggaggtgggctagaagttcggccgaaccacaaggtcgcctgagccgacttcggcccctctcaccatctgcttccacgtgtaggctcctgagagatgtgtaacacat

SEQ ID NO: 46825 - DNA, 1309 bp, Oryza sativa
atgtgaccatggctactatggatacgaccattgctcacatcatgaatcaacaagaagacatcaagatcaagtccttcatgtgctgcaatctgattcggccacgtgttacactgctggtttcgaacggccgcctaatctgtatacgacctccgttttcagcccgtgagtacttgatggaaaactcttggagtcctctttccaatgaatccagcctcatctccgaattccatctcagtcggccgcaattgaagaaacaaggtgttgtgtcacctatattgggccaatgggcttgtaacttcgtttgggaccccggcccaagtggagcccatgtggggtgcaccccaacctggtggagcacgaccctagggcacccttggtcgccctcccacccctataaatagctaggtaccccttcagggtttctcgggttttgttagattaaagtttagccatgcttcatgcttgcagcgcgtgtgtcggctagaccatccgtatgcttgttcttcagaaccccaacttatcatttgtattcaactcttatttgcaatatcagattgcttttatattgttcttgcttgtttcttcgatttgcttgcaggaatagggttgatttgcaccggcaagatcaacaacctacaaagaggtgtatcgatcgctaaggcgcaatgcaacgtcttgtacagttgtagtatgatcgtcaaagttcgtcctaaatcgtagttatcatcaactcaccgaaagatcgggccaacaacagccttgagtgtcagtggaactcagggttcatcataactactctagtgtttataactcactaaagtagtcactatattttactgaattatagtgaacgatgatcccgtactctgattaggaactaaccaagaaataattctcaccgagcaaaactaaattactcaaatgatatttcaattataatccgagtaataaacagagcagaatgaaataggaagacgattgccgataactccgaaattccttcaacttcttctaccttactctctccctattctaatatacaataaagtacactagagcctcttttaattcagctcatgcttcaagtgtgtgtgagaatgagagaggagaggggtatttatagcttgcttgggaatgtggagatcctccatggaatccaaaggacatctcttttctcctcttggcacgtgtccatgacagtttctgcaggtacaaccatcattgggaagtcgttatccaccgaacgcaacttgggcatgggccagcggcctccgtaatggttcggcagaactcagggttcggccgaacc

SEQ ID NO: 46826 - DNA, 15332 bp, Oryza sativa
gatcgcatcatgccacgcgctgagttctcttccaatctccctctttccaaaggccaacgccgcttgttgtccttaaaagatgcgatgacacataggtgcagggccccgagggtggtgcagggacccaacaggtatggggatgggagacattttccacccgatcatcagttcggaagtgggggcaggtgaggaagtcaaggaccgagggcagagacgttccagcccaacccatccccaaccactattgaaggtcgttaagtacaaaatttaatagtcaactcctgcatagaagaagtaaaatattatatcaacttagtggtggtagtttattactaaccattttcactagctttggtaaagataggcatgcaggtcatttaaggagaaaatatacccgccatgcgaaaaaatgaacctccgaccaatcaagtgcgaatacaaggattggagggcccacctgatactaaaaaccggcctaaagtgaggccaaaccatcctcaaccgccataggggcccacctgttagagacaaagggaagttggttgccagagacggtggaggtggtttggccgaactagcctcggcgctactaaccgctagcttccacgtgtcaactccccattggtcctcaatgacgattaagaggggggtgttactgacatttccaactacccacaaccatcattagcacactatataagaagtaggctttcatatttgcaacacacaccacttgagctcaagtagagtacaactcacatgtagtttcatctttagtatgtttttatagtgagaaagtgagaggaagctccggaaggagtgccccaaaatatcggagttctctcccagaattttcagaggagtgccgagttaatcgacattcttccaacggagttttggagaagcgcttgggggttgtcggccttcttctcgattgtacctcggcggaagcttccttttataaagtaactgttcgagatacttttatactatttaattagtttccttaagtgagatatattctcatcagtgtgggttcgtcgcttagtttataattaagtgctctagtactaggactctggataaagaagaaattttttgcgcaaggctagagtagtaatcaataacttacgcgtggtgtctaacttagatgttaccttcgtttgttgtgtggtctaagaaaagtggggtaggcggcaggtggtgacagccctatttgtcatttgcatccctccacattcaggtacatcatagaagacaaggctggactcagctaattggcataccaggggagggccggtggccaaagcacttgatagagtttccaatcctatcattagttgttgtcctttgttgaatcatgttcttagatagtactacaacagcatcaatgtgtttgcagatttatgtgtgtgcgtagcaaataccaattcccacacctaccccgttgccacccctagccatagctagtggtgtacggggaagtggtgctggcatgcagttaattagaagtccgtcaacattgtctagaaaaagaaaatgagaaggattccctaaagaaaaaaaagagaatgagaagtacttttaggtaacaagcaagctacatcgatgatttaagagatatatgacactgttaggtgcttgttacatgtaataacattggagatgtaggatatatatttttaaagcctatagaaattaaaataaaaatcatattatcctaaaaattgtcatggtattttatatccgtccccaaccaccagccataagggattggtatcttctatgaagctacaacccactgaacacttaaaagttcaacatgaaagtataaatatatattactccccccgtttcaaaatgtttgacaccgttgactttttagcacatgtttgaccgttcatcttattcacatttttttgtgaaatatgtaaaactatatgtgtacatgaaagtatatttaaccatgaatcaaatgatacgaaaagaataaataattacttaaattttttaaataggatgaatggtcaaacacgtacttaaaaagtcaacggtatcaaatattttaaaacggaggaagtagttaacatataagtaagccacgtcaacccactaagcactgtcaacacgcatagtacatactaaaacttaaaacttaaatgtaactgcatacatcaactacaaattattacattataaaaatcaatatgtaagcatgctaaggcggtatttggtggcacgctaaaccaagcgatggattaacgtataatcaattaagcgtataaaacttaaaaattagactaatataattctttataagtaacttttcaatagaaaacttatgaaaaatgcattgtttagcagttttaaaagcatacgtgcgaaaaacgagaaattagaagttgaaagtggggaaaagaacccaacctaaatcatcattcatcatataattttcacacatttctatcaaattcatcatttatcatattaatttctacattattttaataaatattcagtcatatatatttgctacgagagcctgtgaaaggtcatctgattcaggtaaactttgcacttgtctagaagcggtcgttttatcagctgagcaatatgccaatagccctttatcctatgggacccaagcgagcacgaccgggcctaccaggaaccactcgagagtcgagaccactagatagggatgcaagcggggcggacaagcaggtttttttttttccgcttatttcacttctagttcattttttcttctaaattttatactaccatacgaaaaatagactaacaagcgggtttttatgcgaatagcgggactatccacttgcatccctaccactagataaggtacaagtgctctcaccggctagaaaaccgccacgttttcacctagctgattcgcctgcttcgtctccctgcgcatttgtgcctacttgtcccactcgcatccacgacctcaagaaaccaaaccaaatcaaagcacaacaccacacgccatgctctttgtgtggttcaggtttgcgcatgtccgatcgaaaaacaagtaaagaagccacgtactactattactggaaaaataagaattgaacaattaataggagttgctagctaagctttgccattgctggaaacacgtcttcgcacaggcacccagccatgctgaagttggagccggagttccccggcctgccgcagcggtgcgactcgtgccggtcggcgccgtgcgcgttctattgcctcgccgattcggcggcgctctgtgccacgtgcgacgctgacgtgcactccgtcaacccgctggcacgccgccaccgccgcgtaccaatgggcgtggtggctgcccccggcgccgggggagccttcgtcgtccgccctgcaggcggtgtcaactcctcctggccaatccgagagggcaggaggtgcgactacgacgatgacgacgccgacgccgctggggaggaagacgaagaggcgacgtcgtggcttctgttcgacccgctcaaggactcctcggatcaggggctgccgccgttcggcgacgcgctggtggccgacttcctcaacctcggcgggggcgccggggagaaggaggacgcgtcgtcgagcaaggactgcagcagcagccacgggaagagcagcgagggcagccacgagttcgccgtgcccggcgagcccgtaccggagcgccagggcttcggggcggtgagtatggacattaccgactacgacgcctccaatttcaggcgcgggtacagctttggcgcatcgctcggccacagcgtaagtcttaatgttttttcttacaatcttacacgaattttcatcaatgaattatctacactagtaacttacccgtgctaactatacgataacattaaaccaaagactatcatatgttaacacaatcaaaaatataattagataaatttaaaactcacgtaaagattgaacaatagagagttgttatattttaaagacaaccatgtgcgcaaaatagcatggtaacctttatatcttcactcaaaaccatctattttttgatgcactgagaaattcttataagtaaataaatactatttgctcatgatatgcaaaataactacaagcaactcttattgaaaatttttccatgataattcactgacatattggtcatggatccacatgtcaatgagagaatggaggtcaactttcggagtcaaataaagattttatcccacaatttttggataattaaattatcaaaattacattatcattcataaataaaatgagttgggtaaaaggaaacgagaataccgaacacccatccatccaggtgtgacttcaagagttcaagaccaagaccaacagaaaaatgcattctcaagctcaaaccaaaaagataaagagaaacatagcactactagaaaaataatttttcatagcgttaccctattatttttctggcggttatacgcgaaaaccgcccacaaaaacgtaacaaggggtggggggctacagaccgccagcgaaaatagatttttgtcggcggccgagttaaaatccaccgtccacctattagaatccgctgccgcgaaaaatccacctattccacgcgcttctccaactctctcccttctctctccgcctatctacccaccgttctccctcctttctctgcctctccatccagccgccagcgacgacgaagctcgtggcgcgcgcatcggtcgacgggcggagcactggcggcttggttgacgggcggagcaccggcgactcgcggggcggcggatccggcggaggcgactcgcggggcggcggatccggcggcgacgactcacggggcggtggatccggcggaggcgactcgcggggcggcagatccaacggcggcgactcgcgggggggcgtcgcccagcggcggcgactcgcggggcggcgcggtgcggcgagtccggcgacggtgacaaggagaaggggcgactcgtggggcggcgtcgcccgacgaatccaacggcggcgactagctttgcgaggcggcaggtctgattcgcaccggtggatggcagctcggcgacgaggtgcagtggctgggctctacggcagtgacccacctcctcgtcgaccttgggcctccctgtcgccggcgatggaggatgggcacgccggtgattttgattttttttttcaaaatctggattccaattttcttcttttttaatcaaaaaatattttcactggcgggtgttttatcttccgacagcgaaaaccgaaatttgtgctagcggttgtcttagccagccgccagtgaagacaattttcgctggcggttgtgttaagccggccgccagcaaaaatcgatcttctctaacggtttgtcgctgctagcgtagatgctacatcttaactagcctttactttgtggcggctccgatatccgccagcaaaaacctaaaatggccgccacgaaagattgttttcgtagtagggtagaatacaatctaatgatccatcgcctgctaggctataagttatctattcgcctcttcacttctctttcagcaagcatacttatatggtgaagaaatgagacggtggagttatagattcagcaggaaaaaaaggattcaagagacaaccatactcataatttccataataggaggctcttgttttagccacgacgtacatcatactctgcttcgtcttcactccactttcacgatcctcaccgggctatttgttcatccaccacagcagagcatacctttgatctttcagttttgaaaaataatgttattcatgcatataagtagtaagtggatgattatggatgcttacactggaaatttgaaggactgggtgcttgccgtggtatatctgactggatgtagatgttgccaatatgaccggaggtccacacttgattgcccatgatgatacctaagagagcacggcggactgatcaaatgatcattacctgacatgaaagaaattatctgcacttaagaggaggcacaattcacactgactgattaaagttgttaatcagaggagttgtgttccaaattagaatgattctggtactaacagacgttacaaaattttgcaactctctctgatatcatgttaggactctgtctcaggtcaaaaacaattatgctactcacagattttgtacaaaatttagccctgacttagagttaatactccaattgtgccaaattaaactctaaatcaaattatcattacctaaaaagaaagaaattatttgcataaagaggagacataattcaaacctaactgatcaaagtttccaaccagaggagagtgcttgaatttaaaacaatgccagtactaactcagtgatcatgctctaaaccagaggtctctgtttcaaatcagaacaattctgttactcacagattttgtacaaaaatttagccctaaccaggaagtcccatagcaaacaggagaggttcgctgctttccttggaagtgccatagcaaacctgttacatttatatattctgaattcctcaaaggaattttgaaagcaagctgccagcatgctcaatattaaaaaattcaggttactttaaatgcttatctttatacaattcaaacttttataaaacatagaaaactcccagtttccattgtacaattcaaaaactattaaccatttagtaataaattcacttaaccactcatataagaagcaaagtcaagggacaataacaatgtatatttcagtgttctaaatttcagacggcccaatgcatattaaaaacaactatgccatttttctatttccatttcagcacagaaatatatacttaatataggagtacatagtagaaatacatagatatacatagttagatatggcaggtaccaatcaacaatcatccgataaacatgtagaaatgcactcctaactgcattgtggatgctgctggggaagtcaaccaagcatcaactatggacctttgtaagttcttccgaacaaaagatgcttcgtctgtacgaccataaccgtcaaacacctgtaaaatacccctaaaaatttgaaaccattaaccatctgctgtgaaaactcgtactgaacaaaaaaaaatgatgaacttaacatctcacatatgaatgttacttcagaaatttactgctggtgatgttgggtcccggtttgagcaaagtaatttattcccaaatgttcagtgttataattttattgcctagtttcaagtgctctaaactcacagattgtttacatgcatcaacagaatttgagttggaaattgtcagtgttgaacaaaaaaaaaactaaccttttgattgactggaaatgaaactcttgtgagtctcaatttccctcaatttattgcttctgattaactggaaactgaactctagtgagtgttaaattcccttaattgattgtaccactcaggaagactatctgcctacgtgcagtttgattcccaaatatgttcagaaccatacaaagacctaacccatcaatcctgccaagtctttccaatttcccacaagccctgtattgcatctgcacgccatctcatctaatctcacatcctctcacaaaataacagcaaaatagtccgggcaacagctgctgctgcggctgcttttgttgtgggcactaaaaacaaattggttattttcaagtctaagccattgagggagttgttttggttggtttgctcggtatttcacatgcactattttcgcaaatttgcatttgaactgtaatggttgaaggaacgggatcgagcgatgcttaccttgtccccagcgtggtcgagaggattccggtggtggcttaacagagagcacatggcgcaggatccttggcggcgcgagggagtcggcggtggcgtcgcgacgcagtcggcaagaggggatgccggcggcgtcgatttggaggcgtgtgagggggtgccaacagcgtcaaactggaggcgggaattgatggcgacgcgatgccgggcgtcggcgtcgtcgcacgcgaaggaggggcgtcggaatctatggcgcccggcggctgctgtgatgcggttggtgttgggatacgcgtaggctacgatagcataaatcaaaattttctatcacgtaaaccaggaaccatgcaagtattagatcatagatcgttaccactcgacgcgctgcgcagcggaaggcgctaagaaatcgaaggaattctcgcgaagtagcgcgtgtcgttatagaggaagtagtcgatcgcaccggctcgaccttctcctcgccgtattcccacgccgatcagcatcacaaatcagaggcgcctctaccggtattcacacgtacagggacggaatgccacgcgtagatgtgctagcacccgcgcgcggctagggttttgctcggggaggggagtgacggctagggtttcttacgtgatgcaatacctccgccggttacacccctcacgaatatataggatccatcactcgggcctccaaggcccataggactcctattcggatccctatctgaattaagctcatattagatccccatccaatccctttattccggcccattaagcgtgcgaccctgtaggttcatgtacactcggctgtaacccgaaaactccttttcggtccacgcgtcaacagcggctcctagcagaacgtattgactcaccgggcatacataaagatcatatcggctgaacctctagtgtatacttgtatgaacccctttgcctcacgatatcgattaagctcaaagttagatatgtgctatcctctaatagctcaatcatttactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactacttttataactacccaattacggagtagcgtttagcagtccctaagtaagctactacacatgttgagaaccatgataattttaagtctaaggattcaacaccaacactaaatgagatcactgatgacacaacatatatggctcttgcagtgtctcatgttgggtctatccaacaacatgttcaccaacatgtgtccacattattaatttggtatctctataccatgatccatgagacatgatcatcaattaatacatgtgttgatcatctaaacatatttgttccacatatgatatttgatcagggatcctttagaaatagcaacacacaacataaagagtctcatgaaagaatcacatattcattaactaataatgagttatctatttcaaggaacaaagtcggataaatatgtaaacatagtatatgatacaatcatctctatgattgcctttagggcatatcactaatagttggagcggcgacgactgttagggttaggcggcggctggcgttgcgtgagagatgtcggatgtcggtggcgccgcgcgcgaatgcggggtgtccgaattgacagtgggcagatatccggcttcagcggcggagaccacgacatagattctgtgtgagattggtggctcgacatcggcagcgaccgcaggcctggactggtctgccgcaaagaccgtctttgagccgctttctcgcccccaccgccggcaccgcctgtgtcagccgccacaatgccaggccagcccagactgtcgaagaaccatcgccgccgttgttgttgtcttcaccagctctcgcccttcattgaatcaaacacatttagccacaccacacacatgacgttcgtttcggcgggtggcggagccggtcagcggcggccgcggaggagatcgtcgctggctcagtggtctttggcttcgacgattggagtaaggggtgagacagcatcacgggtgccgcggcggggagcggggcgacgcttgcggtggcaggggatggaggaggtcacggtggtgaggggagggggatcgatctgggcgggaggagaggatttggggaaggagagcacgtgagggagtggcgagcggtgtgatttttgcgcaaggggagtggggtgatatgcgtgcgggctaaggaggggataggggaaacgtgggatgatctgaggcattggattgaatgattctgggccgttagatttgatgaatgagtaatgagtaatgtaggtgtaagagtgagttggtgaattattagagggtatataggtataggtatatatatagtagggacgatctgaggtattggattgaatgatcctgggtcgttagatttgatgaatgaggatttgatgaatgagtaatgtaggtgtaagagtgagttgatgaattatatggtagatgatatactttactagttttttttatttttttagagaagggtaaaaaataaaaagaaaacatatactctactagtgactttaaagtttcatattccaacgaatctttcaacacttgattaaaattatggaattagtggtgttctggcagcagaaggtgtttgcttttcttacgatttgtttatacacaaatcctactcagtaaaggggaacccaatgctttgctaatgaaagcgtttatcaaagcggtcctgagcacaatcttagtctactttctaatcaccatagatcctccaaaatgggtcttaattgccaaaggtctatgtgctcattggagtgtactggcttaggcatcgacaatctagagcttatgggtgttgcgcttaggtcctgatggatctcggcccaacgcacatctcaatttaagccctagcaaggtctccatatgccgtactctaggcaggaacgcgagtttgctgttgtttccatgacgtgcgtgctaggcgatggcaaatcaattctcttctgggaagatggttggttgcaaggtgcgagcatccatttctaggcgcctgcgctctatgagtgtgttctggagcgcatccactggagcctctcgatcgcagacgtattaagaaacaacagatgtatcaacgatcttcgcggttctctaggagtatggccaatcttctagtaccttttgatctggttgatggtacgtgccacaacactatctgtggaccaagtcggactccttcctctataagtgagaaagctcaggttcctactccgcttgctaaccctaccacgcactattcatgggcaggatcccattccatcactcgctgatctggaatccatggcctctcctcgctatagctactttttgtgattggtcgctcactggcattgctagactgttgatcgtctggagaaaagaggcctcccacaccccgcttgcagcatctatcatgaccaatgggaagaaacgactgattgcttgtggattgagggccctaattcattacagctttgatggatcatcctttcaggcctcgggttacactagtgcttcctcgccggagtctcctcattccatgattggttgtgtgctctagccaccacaagtccaaaaggaccagtgttgtggctttgacatgattgcaccccttggggcttggtccattcgaaaggagaggaacaatctggtgcttaatcaatttaatcgaacatggcttgaagtggtcgcggcaatggcgcgggaagccaccctctggaagctttcccggccttcgtcgcaggcgttgctaccttagttctttaggtcgctaggttgtttcctctgttatcatgagaataaacttaagcttcccctgtttttccttttcccctttttatttccctacctctgttctgtcttttggtttgttatttcttttgttttgctctttgtaagttttactcctcttgatgcaaaggtgcacaattcttttgcgtattcctcaaaaaatgctttgctaatgaagaggtcaaaaaatgcacatttttagtaaggagggaacaatgaagaggaaaacgaacaactttccttgagaaatcaaaatcaacatgtacagaatcactacaacaaaaccccccttcagtgctggctaggaaccctaattggtgccagattccgagatgaccccaaataaggggcataaatgaggcaggctcatcggtgcatgatttaaaacaaaaacccttattgatgaggtgcatgatttaaaacaaaaagtctgatcggctcgattcaagccaattgagcccatgcattgagtccaaaaatttcccaattggttcttcatctatcccaaattgtatttcaatatcaccattgaaaaagtgaatcacaaattttggctcaaatgcattacgtactactcgaattggaaaggtaaaagtacaaattgccggatctgacctcgagctcatggcgaccaatggcccatggcgaggtggaggtcgagagagcgagggaggcacaatgatcggtagggacgttgagaagggaagtagacctcgagctcgtgacggtggatctagctgccctcgagatcatggtggccggatctagccgtccccgagcttgtggcggcgtatccactggcctggaggaggaggcgctacatgtggcggcggtggagatgacaaggggcgtgcggcatctgtggcagataggaggggcatcagctgcagcagagaggaggtggtggtggcggcgagagatcaatggagtgggatcaactctgagagaaaagtgcgagagagaatgaggtggactctgagagagaagagaggtggaaagattaacttcaaggaataaataaaactagggctggctcggtttgtctgctagactctcttagaggtgttgtttttttaaaatgcctcatatgtgggcatccgctcatattggcttgactaccgatttttaattttagattagaccacatgtggagttggaatgaccagaaaatacttatgtgtgctggttttagggcatcccggccctatctggaccttttttaatacctaaaagatagaaacttatttaagaatattcgaataaaaaactgctataatagtcaatggaacagtcacttctctccttggctttaattttcctgtacctagttttaatatgaggtttgaattggtcctgtcatccctatcctagatatatacctataccgacatacagtatatttcctatactcgctttagtaaaataaaagtgttgttttggacttttctaattcaatgagttacaagttcaactacttataatttgtacaaataaaaaaaaggtaacacacgtatgagaaataatttggtacgacaattttatccacataattctagggctgtctgtgatatcatgctcagcggcggagccagaatgtgctcaagagtagggttgaactagtataatagaatgtgccctagctgccctactcctatatccgccccattcatgctgaaaaattgtgtgaaatcagttgaatttttagccatgcgataaaacatgtgtcaaaatcaccacccacccacccacccccgagcgcgccccgccgagcgcgagcgcccttctcacgattgcttctccattaaaacaatactcattgttgggtcaggactgagaaaacatattttatcttttgttatttattgggcttgttttcatattgaacaaccttaacattgttgctttgggctattcaaaagaagctcaaaatctgtctgacatcaacacacaaattctttccattaagtcataacaaacccaacatgagaaggtccatttgtagccaggaaacaacaccagagcgagattgaatccattttgttatcacacaacttttgcgtgacaaagctcagctagcaagattcattagcaaaatccttacaaacaaagaaatcttgacatatcctgtatgcataaatagattaattccaaatgatattaccatctctaatcaattttagcaacaaacttaaatgtatgcatcgcaattaatttgtgacataaatatctgacattatagtgaaggatctgtgttccctctttttcctagacagcaattacgtactgattcatcatactaacatttgtctcatgttaacaaaactaattgtgtccgattttctccatgataagcatggactgttaaatctcactgacatggaaaacccattaaggctcagttttcccaactcatctctctcgttttccacgcgcacgattttcaaactaccaaatggtgtatttttttcaaaaaaattatatacaaaagttgtttaaaaaaatcatattgatctatttttgaaaaaaaaaatctaatacttaattaatcacgcgctaatggattgctccgttttccgtgccggaggggagtgttcccaaccaggaggagcgaacactccctaagactgcagagactaatagagcaaatgggaataaatgcatgaaacatggaccagaagttttgtatgataaggcgggaggaaggacagagattacaggtattcgttgagataaagtgcaaagtcaccaccacctcccattgccaaatatcagtggagcaaaatgtgaaatctatgcaaatcctatgaaagaaattgtataaatgacctgttggatgatataaagcagttgttggtctcctgaaagattaataaatataaagtacgatcagtgtaaagatcgaaatagatatccaaaaaaattgctagaagataatcaagcctagtagtcactaaataaattactctcgaaattttttatgcttcagtgcaaacaatcaagctcagtgcactagcactactaagtagatgcttgatgccttgattgtctaaatttaagctcagtgtactgattttgtaattactaagatatagatagcacacaaggttgacaaaattaggttacgatagttcatattaaaattacattgataaagaaaagtagcataaaccctttttacatagcagtagatctatggaaaacaatcatggagtactaaaatatgcaaatgtcatgataattttttagcatactcagacaaactactgtatatatgaagtcaacatctacagtgcatgcatggcaaatgcaacccatatgatacatgtactacctatactaactcagccctaaacaaaaaaaaaatatcaccaaaaatatatgggttaattgatcaacaattccaaactggtgattttctagccaggggataaatgaggtcgagtcaccaaattcttacattaccaacttgtcatttattaatagcatcttttaggataccttccatttgtcaaggtatagaaaagaaattatccactaatctaataaggcatggagaatgacgcgatgcatgccgctttcatattt

SEQ ID NO: 46827 - DNA, 10764 bp, Oryza sativa
tttccagatatttggtctagaaaacaaaactaacttttgcagaaatatcaaatggctgacaaaacacaaaactagaaatgttagtagttgagaaaactagacatgagaacttgttttgtacttattattgatgaggtattcagatgcacatagtcatgcataaaattctaatgagtaaagtccatcaccggtccctaaacttgtaccgctgtgtcatcccggtccctaaactcacaaatcaaccgttcaggtactcaaacttgttcgactgtatcatcccagtccctaaacatgcggatcactcgtttaggtcctccaacttgttcagttgtgtcacctcggtccctaaacaggacggtctaaaaactttatatcaaaaaataattcataactttttcatgttaactctaatgaagacaaactttatatcaaaattgtagccctcaacgcgacctacaactttgtagttgaaaagtttttaaattaaaactgtttagggtcccaaaatattgttgcatatttatagattttgtaattttaattttaaaattacattttgggacaaaaatgacttaaaataaaaaaaaattcaactacaaagttgtagatcgcgtcgcgggctacaagtttgatatatagagtttatcttcattagagttcacatgaaaaagttatgaattatttttaaatataaagtatttagaccatcctatttgacccatatgatattcaaatccaagtttagggaccggggtgacacagctgaacaagttggaggatctaaacgagtgatctgcaagtttagggatcgggatgacacagtcgaacaagtttgaggacctgaacggttgatttgcgagtttagggactgggatgacacaacgatataagtttagggaccggtgatagactttactcaattctaattaaagactacctttggagctcttgacactagtctagaactagcacaactactcagtacacctaaaaatgtactagaaaaattacaaatgggacacaaaaaacaatttattttggcaaaatttagaaggttaacaaaaacacagaaaagacaaaaccaaaaccaaaaacataaacagaaacagaaacacagagcaaacaagaatacaatattttgctaatgattggtctttgtgtaggtactgaaaatgacattgagatagtatgcccgatttcttttcagaatccacaacaaacaaaactgatactaatcttttaaaatttacccaatattaatagcccccaagttcagatttttgaacacaaatatcagtgaatttgcaggacaaaacctgctaattttcagtaaataatagacaaatcaatacctgaacataggaaattagcccatggacgatatgttgcttaatttcttcagaatccacatccaccttcatggataagaactgacatcctccatgcatagctaaaactctccttgaaaagaattagagtaaacaaatcaagctaatcaaattcttttaccacaaacttgaaccatatagaagttctaatacttttgaacatgtaaagaaatcaaaacttctgcacacagtgacagaaatgctgaccaaaatcaaagaagtatccaaacatatgaacacattgcatgtcccacacacaatattctgactaacaaccacacacacaaatgaactctgtgtgaaggacccgagaagaacatgcaacaccatcaccaaagaagaatagcaagttactaactactatctcctgcagagaagactgtgacaaacaacaacaaatcagtttgtagcatggcctatagtactattctgtgaattgtacaaaagtactacaagttgtggtaaaaatcttaaaaataaaaatgtataggtacatatgtatgtatgtgctcgcgagaacttttacggtgtttgcattccaaaaaaggtaaaaatccaacgctcctcaataataggtaccatgtgaaaagtatttaagtattagtataggtacttagatatcaagggtaaaaacataaatatacttgttgagagaaatggtagaattgtccctaaatttatcggtaccgcataggtaccggttaagtgatttgcttggtactagctgttctcatttgcatgattttctatagatttatgttgtgttctttgagattctcatctgcatgattttctttatatttacatacgttttgttccgaagaaaacgttattggtgtaaaagttttcatttgtgttcccttgtctagatttacgttatgttctcaagaacatgtcaaaatccctccgtttaattcttttgagatttatatcttttttactagaagagatttgtattgtgtttcaaaaacatgaccggttaaaatatcaccgaagatttgcgtcgatttaaattatataatattttatcaatttatccctataaaacatgaaacttcttccttgactacataaacaactaattaactgcgtaaataagtcatggatatctctaaaggtagctagagaagaaaggaaatgtgatctttgattttttttctctctctccgatacagattgaatcaatcgctaaattaacagggtagccatgatttacgttttcatttactcatctcctatcatgttacaataattttattccgtacctgacccctccgttgatccacctttaagtacctctaagtacctcgcaaacaccgtaaaagatctctaggaattattgtgtagagtattttaaatcacatacaagtgtgtcacatcatcacgtactaggaattattttatagagtatcttaaatttcatgtaaacatgatatatcatttataattttgttgtatttttagaatttaatatgcgagcaatgtgaaattatcatctccatatcattatcacattatttaaacatatatatctatcttttatattatataaaatatgcattcatccacatatcctcagcaaaacgcggaatatcaaaactagtatagtatgcatttcaaccttgttcgacgatcgctcaggtttcgatgtcatcgctggagaacatgagcacggtcccagactgcggtgtgccagacatcaccacctcctacttgaggtcatccaagagcaccatcgacctcttcacggcagcagctggctcccctgtggcggcgcacagcataatgtcgccaccgcagttcatgggcgccattgacagggaggccagggtgcaccggtacagggagaagaggaagacgaggcggttcgagaagaccatcaggtacgcgtcgcggaaggcgtatgccgagacccggccgaggatcaagggacgcttcgccaagcgcagcgacaccgaccttgaggtcgaccagtacttctccaccaccgccgactccagctgcggcgtcgtgcccacgttctagcgagcagcttggccgcacgcctggaagacaatcaaagaagctcaggaatgaatatattctcccactgtatagtacatcttggttgcttagctatatatatatatatatatatatatatatatgtataattcgccgaatcgcctctaaatttgtgggaggtatgaggcttcagctgtaggtatatatagatgctagaaagatgctccttgtaaaattgtgcaggagtaaatgtaatcatgtagtcatccctccttctccaatcctttacaatacatttctgtttttttattcagcttaaaaactacgttttgttttttctcccgataacgctattgatctgatggtaaattttgatcaataataattctcgttcagaaaacaagacagttttgagtcccttttcgcacactatagttactgcgtgtgcattgcttggaaattccatgaataatgtttgaagaattgcgttgatgcttcaactttgggccactttggttctcaaccctaccaattctttagtactgagagttgacttgattacatttggttcgttacttatagagagccagtggtggatgtaggtttaaaatatagatgggacgacggagctagccctaattagatgatggcacaatacatacaatccatagtcaccggctgatggcggcagagctaactctaattaggtgatggtacaatgcacacaaaccatagtcgccggctcatgacactggcgcagcagtgcacgacacggatatcgagaaagttaacaacgaaaattggtagtcgaacaaatatatatgatttatatgtagagagagaaaaagagaaatgttgttagataataataaggggaaccactttcaattggggttataaaacaagatgaaaaattatttaggggtttaagtgcttcgccaaaatagttcaagtgagtaaaatatatttttttatatatttaccaatttaactatttactgtgaattgtatagaaatagaaaaaaattatatatagtcaaaatcaggaacagtcaaaatggtactacttacacagaaataatacttataagtcacgaattttcataaatatttttgtctctacttaaaatatttgatttatctgattattcaatagtagacggatgaataatgtgttaaaaataggtctacaaataaggtttaggggcgtagctgcgtggggcgacacggatcatagctggaccggccgaccctccctgcctaatgggtgcgtccaccactgtagagagctaatgttgccaaactaacctttgtgttcaatctaaaccacaaaatagagcctaccaaaaggttggtagggcacaaattgcacatcaatatttaaaatgtccctttctcttcttaaatagaggtacggtgtgtgcaatggcgtcaggagtgcacctagcacaatacgcacgtgtccccacgcctccaccactaagcactaagcataatttgttataataaaataataaataaatagatgcgttgaaagttttaatatataagttcaaagtttcaaaagttaaattgaaggtttcagttttgagttgaaaagtttcaaaaattcgagtagtgttttctaaaatttcgagttgaaagttcaaattgttagcagaaacttccaaatttgggttgaaattttgaagttgtcagggttacgaataaggcataccctctatcctatgacttatggaacatcccgataaggtataccttcacatgtacgggttgtttccgtatacatgtaacaccctgaaaattcgacgacaacaatctaaactctaaaaatatgggccttcaaaaactttttaaataaattgcatcatgccaattttctccgcctatttcattggaatttggtttcgaagtttatcaataacgaataaggaataattaattaggaataaaacctaaaattaaattggcaaaagaaataattaagatataatttaaaataaagatgaggtgaggatagaaatgaataaaatattattgcgaccatatttgtatcaattaaatttaaatgcgattgaataggaatttactctaattaaattcaagtaaaattttataaaaataaaatatcggtaaaataaatctagagtggatccattggttggaataacacaaatattgaataaaccatatttatgcaaaatttaggatttatagaatcaaatttaaataataaataggctaaaatcgggttaaataagaaaagacactgttcattgcactctaggtgctcgacgtggtcccttaacccagcccctcctctttcccctctctctgtcgccaccgtcaccacgcgccgccgcccgtcgcgcctggccgcctcgcgcctcaagccgccgcgcgctgtcgccatcgtcgcctgccgccgtgccgccgtcgccatcgccgcctatcgccgtcgccatcccatcgccgctgccgcgccgcgcgccgtcgccccgcgcctcgagccgtgccgttgccgcgccgcgcgccgtctcgtcgcctcgcgccgcgcgcccgccgcctcgctccccgcgccactgccacgtgcctggccgcctcgcgccccgagccgcgccacgccgtcgccatcgccgcccgcgtgccgcgcgccgtcacatcgccgcccgtcgtgtcgccgcgcgtcaccaacgccccgagccccgcgccgcgccgcccgccgtcgtgtcgccgcgccgccgttgcgtcatccccctttctctccctctttcccctcttccctataaacacccccacccctctccattgttccccactccattttcctcttcctcccctctttccctccaccgcgccgccgtcctcgcaccgccgcgccgccgccctcggtgtgccgccgcgccgcaccgtgtgccgcgccgggtgtcgccgtcggcttgcgctgccgtcgccgttgtcgccgccgaccgccgctgtcggtaagccgccgccttttcccccccttgcgtccaccgctttcgccgccgggagggcaaagagccgagagagagaggaagggagaaaggagctgggagagaagaaagaaaagaagagagaaagaggagagaaaagaaaagaaaaaaataaatagaaattaggggagatcagggaagtttagaaaatttaaaataattagaatttaattatagattaattatagttgtagaattacaaaatttaatataaattatggattattcttggcaatttctataagaaatcaattcgcggtaataatttagatgtagttaatgactaaacaaatagatgaattcttatagattattatagattatttttgggtaatccctataagtaatcgattcacggtagaaattcggatttaattactagggattttagccatgtattatatttaatcatttagtcatagactaaattaaatcgtataatatttctaggatttcgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaatagtaaagttaatataaaggaatcgactttcatttggatttatttggatttttatttgaattctgaattcaaatcaattttcgcacgtaactatagagcccgagggagttgcggatccaagcgatggtcaagacccgcaagactttgagcaaggcaagtcatcactattctttgaacatgttgatcccaattacgaaattatttttatttacaaataaaaattgcatgcaatgatgaacattctacttgtgattatgccatgccttgattattgtttacccttaaatccttgtaaccatgatttacgtataagtccctagtcaactatgacaaatgcttagaaatgctactctagatttatgcatactcatatttatcaaatgctatatgcttgggcaattacctttgggaaggtaattgagatgcggcatgtggagacatgagcgccacattgccatgatgttgatgatatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaatcgtacttctcgtatgggtatagacctagcggattagatagccgagcggaggcagtatccctgcatagatggttcacccctgagtgaggcaggtgcgctacggtgggacagccgttgaggtagggccgagaggcgtgccctacatcggtgtcgctataggtaggactgccataagtgtgtgagagagagaacttaacttgaaccataattcaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtcccatgtgttgggacgaggcttatgtgttgggcagtcacggagtgcgggtaaagtgtacatccactgcagtgtaagtaaatcaaatctattcgaatagccgtgctcgcggttattgagcatcgggacatgtattacacttggctagactctaaattcttaacttgtgtggaatgggatattgcatgatgatttctatgctaatggagccacttcctaagaggcgggaaggtgaacgtcctcagaaaaccatgacgactcaatggcgggaagctatccttgggatcacaatggatggtggacagaatcgtcattgtttaatatgaacactggtaataaaatttgatcagtctgtgctaggtcttaggtttgtgaaaggaattacaaaacttgctttgcgcaaaagaaccatagtcatcctttgaatacccctgtcatatgcattgttgctgtggtggcttgttgagtacggttggtactcacccttgcaatatacaaacttaatcagaggccggagatgaagcttcggaggatccctatgcctattaccaggagggtgacgaagacgatggtgctcagtaggtcttagttacggtcgttgcctgtggcaatggcgtgccgctgccttaactccgctgccttaccttcttctgtttttggaatgtattccagaccgctcggtccgatgatttaagactatgcctgcgggcttatgatgtaataattcgtactagacactcgtgtatgtgcacttggtatttcagctatgaattcgtgtgtaccagactactcgatccagggaaatggtactgtttacacgattgattcctgttataaaaaaaacgggggtccacaatacgccattaggaatctatcttaaattatgaaaaatatctctatgagttaagaaattgccggagtcctactcggaaagggtaaaatctctggttatatcgtgccagtttacatatccctaagtcttacttgggagtcaaggtattccacggtataaaagggacccctagggggaggcgaagggcatcgaatctcatcgccaacacacccaccaaagtttacgaagcaggagtacgtggagccgacttgccgggaggtcttgtcgaatccctcgactacgatctcgtcggtatcgcctgtttcagttactctctttgtaatctgttttcatcatcatcaatcccatataaactggattagggctattacttgacaaggggcctgaaccagtataatccttgtcttttgtctgctttgatgttgtactacgtagacccctgctccaacgtaccccaatactctattcatccggtccatgagtatcactcgtcgacagtggcgcgccaggtaggcagacttggtgctcaaggatctaccagtatgacttcaagactttccgacaacaatgtcaccgccagcatcgatcaaggagcttctacctcgacaccgctggtgtggactcaagtcggatccattgtctttccggtctataccattacaccaatgtcgactggcccaatcatcatcgggaacgagagaggtacaacaacgactgagagaaacgacaacccgccgacaattcctcccacttaggtggagaacggaacatcgatggccccaatacctgggaggaaccctcaggcagctgaatttcacctccatgtgaaagataaaagccgacaaggatgaccaccctaaaaccgagaacttggtgtcctgtgcataagacaaccaagcatactctcgagggctgcccggtgatactccacgtgcaagctaaactctacacctgttgggaacgagggatttagtgtacttcaccgacgggagccacctactgtccgatccacacatctagatctcatgatcttacaagctgcagaatcttcctcaaaaccctcaaaccaccgcatcatcgcgtccaacaaccacgagttccaaccccatgtgttgccaaggaaccagatgcggcgccaatcccagatcggtttgtggggttcgttggcactgttgacggtcgttatcgatcagtttcgaccgtcaatattatcagaatagaggagaactagtgatgcttgcaatgcataaatatgttagaataataatattcccctagtagtaggtatactaacctttctgtagagaatgacaataaagtggaggagaatcgacatcaactcagacgataaatcaatcggacgatgtcgagaactagacttatgtatgaatgggccaagaactcagaattgacacgatgaattgggtcaaaattcacaagtctacaaagtgaagcaatagaggaggccgccagccgaagatgggccaggaaggcccagcccatggttcggtcgaacccatcctggcaccgttggatgcagggttcggcgtggacgtccaagattgcatcccaatgatggttggagggcacttcggacaattccccttccacaaccgtcataaccacctctatataaggacttcactctcttcacttcaacacacacctcaagcaatagctctctcatttctctcaagtttagtttagtaatatctagctagtggaataggaatagagtagaaatcatgagtccggaagccttcggaagagttcggatatagctctagtaggttttctcttctcttttgtaagctttgtacttttattagaatactcttctaaatacatttatggtattgaaatactttccaagtatatgagtacctactttacattatgttcatgttatactgaatatatggctagcttat

SEQ ID NO: 46828 - DNA, 6279 bp, Oryza sativa
aactagaatgtatggatactatgtatattagaagtataggaatagatttttttttctctttcctttccacttagctcagataatatattatgagaatgagtagtaatgcttgtgtgtcactctacccttggattatcttaacccatgcttagaatttgattatcacaagtaatatataaattattagttgagttctctctacatgatcttcccacgggataaaataaatacgatacacttggaataccctcgggtaaaattctacaatggtatatccatgcgcttgtggatgaactctgtaaccataatataccaggagtttttctgcgccattgctgggaattatatttctagtaatgttgttaagaaatgccaacaagcatttctggcgccgttgccggggaagattcataatagagattacttgaactaatactttatatttacctctgtataatcattttactttttgcaggctaaccttggttgttttcactgtttgctgtggaaacagggtagtgcatgactggtttcatcctgccggaaaacttcaaagaaaatccagaagctttcttccggatcgtcatgccgcgagtcgttgctccgcagaaaactctaccgacagagaaaccagccgtaccagcgccaccgaccttcaagactatggccagcaagactcttcgcgagttcactgctccctctgctgacaatgtggccataaggcaacaggtcaacataggggacgtggattttgacttgaagtccagcctcatcatgatggcgcaggctagcccgttctgtggcaggcctaataaggatgccaatgctcatctgcaacagttcctgaagatctgtagcacatacaccatcaagggcgtcagtcccaacgccgtcaggttgtgactgtttccgttctcccttcttgggagagcgaagcagtggttttatgccaaccgtgctgccgttaacaccagggacaagtgctctacggcattcctctcaaaattcttcccgatgggcaaaacgaatgcccttcgtggacgaatttccagtttccaacagacaagggacgagtccattccagaagcatgggaacgactgcaggagtacgtggccgcctgtcctcatcatgggatggacgactggctgatcctgcagaacttttacaatgggctcaccccaatgtcccgcgatcacctggacgcgtttgttggaggagccttcttctctaaaacggttcaaggagccgttgaactcatagggaagatggtctccaatgtgggttggagtgaggaacgactccagacccgttagcgaggcatgcacaccgtcgaggagacggagttacttgctaccaagctggacctcctcatgaaacgcttggacgaccacgagaaacaaccacaaggcaccgtcaaggccttagactaacacgtcacgtgtgaagtctgcagcggcacgggtcattctaggaacgactgcccggaaacccgtgaggaggcgatgtacatgggcaacaacaacgggtatcgtccacaaggaggtcaggggtgtaaccaaccacgcccatattatctaggaggtaataataacggtaacttctctaaccaaccctccttgaaggatcttgtttttgcgcaagctaaaaccactgatgtgctaagcaaaaagcttgctgctaatgataagatcttagagaacataaatgtcaagctagatggctttgcttccgcatttcaaaaccagctgagctttaataagatgatagtaacccagtttgcttagttggcatctttagtccctgcaaatgaatccgggaggatttcggggcaacccgacgcctccactgaaaatgtcaaggcgatcacgacaaggggaggtaagtccactcgtggtccgccatatcctaaccctgcagaaactaatgagatatcaaaaggagcgccatctagtgactcggttgacatggaggttctgccagaaaagactatgccgcaggagtattgagacacacggttgctgccgtttcctcaatggggtaggaaaccatcagtggacgagcaattcgctcgttttattaaagtaatccagaagatccacatcaacgtgccgttgttggacgctatgcaagtgccaacatacgcccgttatcttaaagacatactcaagaacaagagaccgctcccaacaacagaggtggtcaagctgacgaaacaatgtagcaatgtggtactccacaagctcccggagaaggaatcacctgctcgatcggggcacaacaattcgactaggccttgtgcgaccttggagccaatgttagcgtcatgccaaaagacgtgttcgacaaactcaacttcacggtattggcaccaacaccgatgcgccttcaactggctgattcatcagtccgttacccggtagggatagcagaggatgtgcctgtcaagatacgggatttcttcatcccggttgattttgtggtgctaaacatggacacggggaaggagacgccactcatccttgggcgcccgttccttagcaccacaggagccaacattgacgtgggaacggagagtatccgtttccacatcaacgggaaggaagagaagtttgagttccaaccaaggatggacaatgctccatggtcagggtaaagtacgggccgaacccacagaatatttaagtggtcgaagtggagccacccaagacggacagcctggtgaagtttatgcagaatttcctggagaaggaaacaacgatgcccaggaaccgttattggaggatgccggccaagaagttagagcagccgactcagaagaagccgtcttccgcaccaaaaccaagaaaggcatggaaggaaaagccaaagaggcccgctccatcacctccggagacaggtggaaaatccgtgaactaaatcagaaggaggtacggtcttgcacgtcggactttaaacgacgcgacctttgccaacaggtaaattggtttgtatccgcatatttgctttcaacaatttgaatttttgcatcatcacatgtttgaatttcaaatttgcatttaggatttttgaattttgaggaaattcttcaaatgaattttttaagagcaaacaaaaaaaaatttcaacgaaaattaactgtgccacgaccacactgaccgtttgaatccaacggccgaaagtggggccggttgggcccaccaggggttcggccgaacaccctggtttggccgaaccggccaggcaactgctaccagccgcttttggcagggtaacagctagtgggtcccacatgtcatttctgtccgttatgggtaccctataagagccagccggccgagagagggaattccaccccatttcaacacattttcattccctctccaaagtttgctctcaagttcattcaagctttgatagtttccctcaaattgaattatttagttgcatatatacaagttgctttggtgaaactaactggcgggtgaaattcttgtcattcctaacccccgccgagttagtccgttcttgctctattgtgcagtatgaggaggcaactgtcttgtctgttcaaggggtttggctcttcatcaagtcatcatggcgaatctagcactcattcattagctgatgtctcgatggaagacgccgaagctccgcgatgactcctgaacgacaccgacctcgaccttgtcagtgatcgggagagacaagcctactacatgctgagcgaccgggaatatgctcacactcaagaatactctctggagctgctgaaaaagataggtttggatgttgaatttcgttctatttggaaagctgttggttggcagagatttgttgtggtagatgagcctggttctcgtttgcttactttgcaatttctatgcactttgaaagaaatagaagataatatttcttttcgctttttctgtaaggagttcacactcacatggaaagggttaagtacacttcttggttttcacgattcctgtaaaatcgatctccagaaaggaatttttgggtacgagaaaaataggttttgggaagacatttctggtgctccaatttgcaagaaacctagaacgaatgatatccataatcctacacttaggctcatgcacaaatggattgctatgactttgtttcctagaggtgatctgagacccattaggggagatgaattaattatcatgtttgccatggttagaaagatcaaaattgctcaggtgaaatgtatgataaggcaatggttagaaagtataaagttctatgctcctgttgagtgtacttctatgattactcggatagcaaaagggctaagtgtcgttagcgaccaaattgcttttatctcagccgctcgtccgcgtattgatgaggcttattaagtgcaagggcatattatggaacatggagtagatggatctttgatttactttttcctcggttgtacaaatgaaatcccgttgccaaatgcgggatatcatttgtacaactgccatgaactaaccattcccctgcaaaccatagaagaatctcgtgcaggtggaacatatagggagacgcgcaacatgacaaggaacgaacgagaaagttcatcatcctcaacacccgtacagatgtatgaggcaggatgggcaccaactggggatgcactcggatggtcctaagctccatgccatagcatcggactctcaacttgggcaagcgccagtgaggaccggtggcatgcgcctcatgacatccaatggggggacaatcaacctccccgatcgagtggtgtgcctcaatctccaagtgaatggttctcgagttcctctcgttgggacttgggtgaaatcactaggagaatggacacccttgatccagtacaacctcacgaaacacatagctcaaacgctagaatggtaacaatctgctgatcctcaattcaccaacatcaacaacatgatgcagcaacagcacgatgaccttcaggcgtactttcgttttcaggggttcaatccttatcaaggaccctgagcgaaagccaagcttgggggggggagacatcgctccccctactgaggtaacttgtatcacatttcatatttccctttccaattgcatatttgttttccaattgaatcctataaaagttgaaaaaacaacataaaagtttgcaaaatagaaaataccaaaaagataggataggtttgagtcatgctaggtaagacaagctagttctctttgttgaaatgatgaatagttgctctgttttatatctctgatatatgggttcttggtaagtgctctctcaaaggttaaatataagtagccaacaattatccgggaacctgaggtaaataggctgcacttgctgatctaagtctaagttgttgcgagatatgagatagtaatatgagttactatgatcctgatactagtttcacttgaattccagatgttttgtttttcaaaatgataaaattggaagttcctcatttgatataaattcctaccagaaaaaaatgctataatggttaaaccatatacattttggttacttgtcattccattgaactttgtcaaactcttgtgacttctgtagatacttctcatgctctatgatcaagatcatatacccacatttatgcacatgctaaactcctacactgggagctatacaaaattccattccatttccatattaccaccaaaataaattctccatgctttcatgtgctttcttctcctaaaaagaaaagaaaaaaaatccttttgaaaaaaaaaagaagggagggaaaggcatggttatgaaaaataaagttatgctccatcaagcataagcatgatgtagaaaaaaaaattgtagccatgccctcttctaatcaataaaaaaaaatgatttttaggagaagaaagtaagcacaaaggagaaccatttttcttttattttttttcctcatataccatttccaccagataccacacacaaattttgcatgaacttgatcttgagtatgtttagttatctgctctaatcgaagtttttgactcagtaataaatgtgaatgcaagtatgccatgtttgatccctaccgagctccacatatcaaaccttagagtaggaatcaaaaaaggcaatatttggtgaggaattcatattgatacacttacagagattgagtgaatcaattgaggaacttggctttcttttgcaaaatcgtttgaaaacttccggaataagaattgaagaaagattgggttattggtactctaaattgatgttctgtctttca

SEQ ID NO: 46829 - DNA, 1050 bp, Oryza sativa
tttcttttattttttgcacctttctgcctttttttttctcactttttttcttattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcgaaaccgacaccaaacaaaaatttgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaataaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacaatgcaacacaaaattcaacaaagcaaaaactgaaaagaacaatgcaatggcacaatatggctaggtaaatgatacgaattttttttgtatggctattttctggttataggaagataaaaactcaccgagcaacgaaagctctgataccacctgatgaaccctgagttcctctcgacactcaaggctattgttggcccgatctttcggtgagttgtgataactacgatttgggagaaacgttgacgatccgactacaaccgtacgagacgttgtgttgcgccttagcgatcgatacacctctccatgggttgttgatcttgccgg

SEQ ID NO: 46830 - DNA, 8001 bp, Oryza sativa
cccctctgcaacatggatttggatagacttgctatttctaactgttatgttcaagaattttaacttttaggtatcaggttctgatatattattgcagggcaaaaaggtaattctagtcctagtaagtaggaccatgaaaggagttctacgatgattcataaatatagcttcataggatgaggattcctgctctgtcttaagaggacttgcaagagggactcatccaaaggaagtaactagaagtaattaggtcacagtagatgattggaggctgtgattctttgtgccgtagatttttgtgtgggataggaatctgatagtctaaataagtcaagacaaccatattgagagttcaataatcccttgtactgtttggaggttgtgcttgaagaaatttgtagtccgctttgacatatcttttctctcgccatggattgttttgtcgccgttatttttgttctctataggataacagaaatatccagagctgctgcatagtattagagtataacagttgatttaactagattttatggtctgtgtgcagccgtattgggccgcttacctggcaccacagtgtaccgaaatagattgcaataccctgaggcttatacctacaacgggatagttgttgttcgaattgatgcacctatctactttgccaacataagttacataaaagacaggtggatattttttttatctgtatgaacagtttgtgttatcaattttttttcttaccctgatgtcctgatggatgttttgttgattgtgtcccttatcaggttgcgtgaatatgagcttaatctcccaaattcaaaccgtggacctgatgtcggaagagtgtactttgtgatcctcgagatgtcccgtaagatctttttcttatgttacatgatatgaggcacattaatttttttgtcatatcatgtttgcataaaaatgtttctttcaattaagaaactcatgagcatcaagtagatttactagactagttaagataaacaaatactgaacatgcagctgttacatacatcgattcaagtgctgttcaggctctcaaggacttgtatcaagaatacagggatcgccatatccaggttggcacttcttctaattaattgaacgagtgaaaagtagaaacaaatgtgtacaggtatggcattaaatcattgagtactactgattggttgcagattgcaatagcgaacccaaaccggcaggtacacctgctgctttcgagatcgggcatcatagacatgattggtactgggtggtgcttcgtgcgagtgcacgacgctgtgcaagtatgcctccagaaggtgcagagctcatcatcaagttccataaagctgtcgccacaggcatcaggggacctagctgactccgttaccactccaaaggttcaacagcggtatagttttctaaagaacctctggaaatcacaggttggggacgggtgtacaggtagtgaggttcaaccgttgctacgccaaaaccttgtttaacattatggccgactacctttctattagtatctgtctgcctgtttatatttgatgtacatgtatgcatacagtgtaaaggaaaaaaaaggaatatgttattactctcttgcaattttatatagaggaattgagatggggttgtaagtggacagtatatgtgctgccaacacattggttatctacacataaggacgtagaatatgctgtgtactgtacggtgccgcggcttgcctatcgtgaggagttgaaatgttcgcaaaattcttgtttaacttgtaagtttatgtatatacattttcctaggcatgtaataacagccgctttccatctgtatgagtcgtttttaccctattaaggcttctttggttaatccctaaaagaaaaggattataagggtaagaggattaatttcacacctcaatatacgtggaataatttttctccaattccctttcaatcctttatgaatgggcctgagcttggtttgataaaaggaataaggcgtttgacgggtatgcatgcttgtgaccgtaagctgaattataccagtctcctcaattagactttgcatcatagacgattcttaataactggtaacttataaaagtgaattaggataaaaattattttggatgtttttgtcctcatgatgttatatagaaacggtgcttcgagaccataggtaatactgtgggaacatctctgaagaagattttcaatagtataatattgtagacctgtatgaacatctctaaaggagattaatattgatgttgtgtactgatttgtagttggacaatagtaaaatgaggaccacaaaatttgttaggagtgcatttagatcaaaacaatacttgtgcaatgctattcagttgaacattcattggctctaaatcaaactgttcttttatcatgttgactaactcaagtagaatcaaaccaatggccctgggtaagatcttgtcaggcaaaggaaaaaaatagatacaataaattccctaagtaagacattttaggacaatattgttaacgatgaagatgaatggattatgtggcctattatgcatccattgtgggagcagaatagcttgggcacctctgatatctttttttcatataacctagatcattaatttttacagtgttgataggaataaaactatgtaatgtacattggataaaaagaactgaagagagatatttaaagcatagaagatcacctctgggaacaaacttgacaatgcatcatatatatatatatatatatatatatatatatatatatatatatatatatatatatatatatatatattatatcaggttcttctaattgtgcagaactgtttcctagaggaagcagtagcatagcctgcaaattgacgcaaaaaaaaaagaagaggtaaatacctgtaggtaaacatatatacattgccagctggaaaaagagaatatttgtctacctaaatacatcaacacacagtttagaatatgacaataaataataaggacaaaatgcatcaggaaacatcatacgatgttactcttgctcaatgccaaagcagtactggaactggattcatctataaagttcttagaagcaagagcggtaataagatgccttgtactttactttgggtgatttgcatagatgaaatcatggtgctactgctcctggacactaccataggagagagtaagcgttacataattaattagtaaatagaagatgcagagtgaaatgttttgtggtaaacaatgtacataccttcatccacatacatagaatttgcctatcaatcagtaaccacatggttttgctctgaaccctggttgtaatcttggaaaacaaaaatcatgtccagtcgaagatagaggaaagaagaaggaaactcatagtcactactcaccagtggaaccggatcctctgacgtactttattctacttcaaagggacgttcgaccatggatcgccgttccttgcgcatccgacgacaacaaccgtttcagtcccgtcctttgtctcaggccccacagcgcaatgtctctgcctgctctccgggagaaaattgtgattttgcttatcgcaaaagaatggtttcgctggaatactatccctccaaagtgattcattaaaatgctattctaaacaaaggggtgttcactgaaatgctattttagatctttttggttgctagaaatgattttactctattttaagttttgttctgaccaaaatacccttgtgtccttgtctctattatgttgtgaaccgttgtgaaccatggtacatgtgaaccactgttatattgtgaaccattgttatgtgaggtattttgtgaaccacatgctattcaatattatgtctacatgctgtccaaatttgttctattttgtttttacaattttttcatgcccaaaatttatgggttaagctagcttcaccattatatctttataacttggagtgagaaaaatcttgatctttatgcgcgcttgtggctaaactggactacacaccatttttattgtacaaatgtgaaagcaaaatatattgctctagcaaagcatgtgtcaaaattaactagagaggtgctgtttgactttcaaaccagtgcactagagcttttgtattagtgttaatgatcaattagtatatacatatcatgcagcggagcgtgagccgtgcataggtttcacaaatatatagcaatatattttgctctagcaaagcatgtgtcaacctgccattatcctggcgaaaggaggacatagaggcgagggcattttggtccggagaaaatctaaaagagagtaaaaacattagtactaacaaaaagatccaaaataacatttcagtgaacacctcttagtttaggatagcattttaatgaatcactttgaagggatagtattccaacgaaaccattcttttgcgatagcaaaatcacaattttctcgttctctggcccattcattgatagggacagcagtgccgcgccggccgccggagagctcaggccgccgcacactgctgccggtggggaggtcggactaggacgcggtgctaccgccgtccgccggcgaggtcgagggcgacggctacgcccgcctcggtgtttgctgttggtcccatcgcccaacgactgctgttctcggaaccgtcgccggcgaggttggattggaatcgatctgtagccgatcgaacttccatcatcaggttgccttttctcatggaagaggcagctggttgaaaatcttgctaaggcattcgtgctgtcattaacttttctcagaaactacaagtaacctgaagaataaaaatcagagctaaccagaagaaaagaaaccaaaactttgccaacagattcacagttgaatgcgacatagcaagtctacaattgcaataagaaaataccaaagaagatagtttttttccttgaagaagagatcaacgagtgcagatgttaaccaatgaaagaaatctcatggcatgaagtgaagagaagatgagtaacttttctgttctatttgttccccgtatagctctccgacgacagttccgacaacagcagccgctgggcggagccatcgccgtcgacctcgccggcggacagcggtagcaccgcgttccagtccgacctccccgccggcttcagcgcgcggtggcctaagctccccggcggctggcgcggcaccgctgcccctattaacgaatgggccggagagcaggcagggacatcgcgcttgcggggcctgagacaagagatgggattgaaacagttgttgccatcggatgcgcaagcaacgacgatctgttatcgaacgtccctctgacgtagaatagattacgttagaggatccggttccctcaccagtatcaccattcaccagtcaccaatagcaattaaggcctactttctagagcggaagtgaaagaacccaaagcagcaagtaaagaaaagtaggtataagaaagaggccctacgaaagggcgtcagcaaggctgctataacacggccacacgagccattcatcagagatgcaacagcgtggatccgccttcatcttgaccagcggtagcgatggaggacgaaacaatctccattgatgagatgctagttcgtggtgaggaagaggaggggaatttatttgcatctgaactctatctggacggagaagaggaatgggaatggttgcaagaaaatggatcagtaaaagacaggagggcagggcagtgaggcagttagcggtgagtggaagcagcacgggagcggcggccttgcttcctgttggtgtggcgaggcataggacagacggccagatggggggtcgcagcctcgcagggttggatggacaggtgcgtcgatggggcggggaaggtgaagtggccggcgctagaagggggaggcgaagtggaaccggcgcgcagagtggcgccaggaggaggacgcgaagcggggcacagtgtggatgcggtgcgggggcggcggcgcgagatgcaggaggggagttgatgcgcgtggggccgccaaagcagagtgatgcgggagaggagagaaggggagcgtggagccggcgaagcagcgagatgtgggagaggagaggagagaagcgacgcggaaggaagggctcgatgcggatccaacggtggggacaaaaaaggtgacgtggaagcaccaggaagcagagagttctagtagtggggatgatttgtataggtataggattccagtctcctgaaacatgcaggttttctaaaaagaacataaatctacatcgagaggcctatcgatttgtgccatcgcgcaatgctgggaaagccatccatcccgcgaacaagcgacatggtgtccatcccgtgcgtcgtagcgttctgaccgtgagaagggtgcttcttcctttccatctactcaggttatgcttttacgtggattgactatgtctgatgaagaatttgatactttgatggaggatacttctctagtggagggagttcaatcccaggacaatttagttgaaaagcttgctgctgttccagaagtgatattgtctccatctaagaagagtaagaggagaggtagtgacatcattcaacacgctctagaaagggcagagaagataaaggctgacagaaatctagaaaatcaaaaggctaaaggtaacttgcataataatgtttcctttttacatttttctaatgatgatatttctgcctctttacaaaatcttggtatttttgctgcaaataaggatgttagcttagatgacgctattaatgatataagaagtgtagaacatgaaagacttagggatcatgttagtttaaatgataataatgactcgagtttaatctttgataatgatttcgtagaggatcaattagaggatatctttttactacatcagttatgtagtgaaattatggatgaggtaatggattcgttttcaaactacttcagattctaagataccttccatggacaaaaaaaaaaggcaaaagagtgaggcgaaacaaagtttataaaaataagttataagtttataaaaataagttataatgaaaggagtcttttggaattgtgatgggtttaaagacccaaaaaaaacataagtttatttctgattttactaaggaacatcaacttaattttattgcgttatcagagtttgttaggagggattttacttcttctgatcttaaaaatctttgtgctagtaaagattttttgtggcattcctagggatagatctggagggatgttattaggaattaatttatgaacttttgatattggtttaattgatgagggtgatttttatattaaatttcatttatgtaataaattggataagtttaaatgggctttggtgttggtttatggtctgacgcaaaatgaatttaaagaacaatttcttcttgaattagtgaatatgtgcagatatgaagctttaccaattctcattggtggtgattttaatattttgcgcagtcatgatgaaaaaaataatgataactgtgatgatatgtgcccttttctctttaaagcaactatggatggttgagtcttagacaacttgttttgtctggaagaaattttacttacgcaaataatttagcaaaccctacttatgagaaattagatagagtattaatgtcgacggagtgggaacataacttcccgctatcctcggttgttgctcttaatagagatatttcttatcatactcctttacttttaattacaaactcctcttcaccatgtaatggacaacacattttcaagtttgaattagattggctactatgggatggttttgtagacatggttaaggaaatatggtcctccacagatgaaggtaatactcctaagcgttgacagggtaaacttcatagattaagaaaacattcgaggggatgggataaacatacaagtggtgtttataaaaaagagaaaaaatagttattaaataatcttgatttgcttgataa

SEQ ID NO: 46831 - DNA, 2255 bp, Oryza sativa
ttagtcctactcaaactgcttttattcctggaagaaatattatggaaagagttggtattttatatgaaattatacatgaaattcatcgcaaaaacaagagtggggtaattcttaagattgactgtgagaaagcttatgataaggtaaaatggtcttgtgttcaacaaaccttaaggacgaagggtttctcgctaaaatggtgtcagtggattgcctcttttatccaggggggacatgttggtataaaagtaaacagtcaagttggttctaattttcaaagttataagggtcttaggcaagggaatccattatctccaattcttttaaatatagtcgttgatatgcttactatattaattataattaagagggtcaaggatgatggtcaaattagcgggatcattccacacttggtggatgatggtctttctattttgcaatatgcagatggcactcttattttcttttttttttagaacatgatctactacaagccaaaaatctaaaattgttattattgacttttgaaaaaaatatctggccttaaaattaatttttataaaagtgaatcattttgttttggttagtcaatggaatgtcaagagctttattctaatattttttgttgtaagcttgggaatttttccgtgagatatcttggtattcctatgcattttagaatacttagtaacaaggataggaaaacaatcgagggaagaattgaaaagaaacttagtagttggaaaggtaagcatatgtcaattgggggaaaattggtgttgattaattctgtgctttctagtttagccatgtttatgatttttttttgagattccaaaatgagttcttcaaaaaattaattatagatcacgtttcttttggcaaggagatgagcacaagaataagtataggcttaacccaaagatcaaaggtactcttggagttcataatcttaaaattcaaaatcaatgtcttttgagtaaatggttgtttaggcttataaatgagtagggcgtgtggtaggatctatgaaaatgaaatatctttataatcaatccttaagtcaagttgagaagaaacaaggggattcccatttttggtcgggtcttatgaaagttcagagcaagtttctaaatatgggtcctgaattgtgaataatggtgtacaagtgagattttgggagaataaataggcagggactattctcttaaggatgggtacccgtcgttatatgctatagttcgtaggaggaattcttcaattgcaaatgttatgtcttgtgttctactaaatgtttcttttaggagagctttagtaggacataatttaaacaattgcataatttatgtgcttcaattgtgcatatttatttgactgaggagaatgatatttttatatgcaattttcatcaaaatggtgtattctcggttcggtctatatacttagctttaattaataatggctacattgagaggaataatattatctggaaacttaagatgcctctcaaggttgttctaacaaagaacaatttagctaggagaaattagcatggtagtttgaaatgttgtttttgcatgagaaatgagactattcaacatttatttgtggagtgtcactatgcaaaatttctttggagagctctatagtttactactggtttatatactcctcatagtatatctcatattttgagaattggcttgtggggggtgataaagaatataccaaacttatccttgctggagcatccgctatatgttgggctatatggttgtatagaaatgatatggtttttaacaaatcaccatcgatgtcgtatacgcaggttcttttcagggcaatatattggctctggtcttagcctcaactactaaagtgtgacgaagaaatcaagtcagtgaaagctgcatgtcgtaatctggagtcaatggttatacagttgttcactaactttggatggagattcataaatagaattcaataatttttgtgatcttgttatgccgtgggagtttttattagtttgtgtgtgcttttgtttattcatgtgtgagtttttgttgaattggtgtaataattggctgtagaaatttgagtaaaggccgggattatattccattattaaaacaagttatgtgttttttggatgaatctcaaaacacagtttatgaacttgatatgtagttacatgtgataattctatgatttttggatatgttcttccggcttcctctcctccaagttgctgtttt

SEQ ID NO: 46832 - DNA, 13484 bp, Oryza sativa
aaccatcaattgcaaatttgccactgaaattagtgcatgtatatggcgtatgccatacgccattgccgtttgatttggtgcagttaagaggaaaaaatatttatagaactaacgtaaaaaaaaagcaacacaataagactattttgtccttctaagattcaatcccctgtttgctctcgaccgactcagatatgtgcacaataaaagccagaatagattgaagtaaaaatattactcaccaataagattgggaaaaaaaagacttatagtagagtaaaaagattagggagtagctatatttatggcgttatatttttcaataaaaaatagtcggcatgtatttatacattgtaagtcactaaattacatatataattttagtgtatttacgatgtaagtcccaaaattacatactaattacatatataagtagtgtgtaactactgtgtaaatttcatttgacgtatttttacctaaaaagttgtcaccatatttttatagctgctaacatcttgcatcattgtttggtttatatcctgtaatttgccacagcatgaatcttagagaagatcaaatcatctagagatctactgtaaacaagccaaaaatatggtgacagtattttaacaaaaccgaaaaattacttcctgcttcaccggttctctctctaatcccccgtggcctttttttcaccactagtaatttctttactcattggtttattctctctctaatgtctcgatagctttgtcagaaaaggttataagattttttagtattgtccacattaatatagatgttaataaatctagatacatatatatctattaacatatatataaaacgaaggaagtaatttattcctatatgccaactaaaaatcgcagtaaaaagatattctaccatcaccatacgtagttacatctcaaacatcaaaatctatccatgaaaaaaaaattgcacacaaataaaatcatctgactccgcgagaaagattacagactatatgagcactaggacatcggcaaatgagcatttgacaccttcactagacctcgtcactatgaataattgttgtttgttgtagcacgaccccataaacgccgacggcatcgccacttgccgattctctagtctcgtgtgaagctcggggcgggctcagttagcaggacatctcagaagtatcggggacacagcttcataaatccataatgctatatgcttgcagtagtagaattccaattatgacgcagtacactttcgctgccttaatgataatcgtatatatgcattttggacactgaacagaagtgcctgccgacatcctgaaacaagcatccataacaaactaagggagagtttagatctaggggagtaaagttttggcgtcacatcggatattgtgtagggtgttgcatggggtgttcagacactaatagtagcaccacattgtcaaatcatagagcaattaggcttaaaagattcgtctcgcaaattagtccccatctgtgtaattagttttttttctaaaattatatttaatacttcatatatgtattcaaacgttcgatgtgacagggtgaaaaattttagggtgtgatctaaaccgggtctaaagttcatactcaggtaagggagaatagtaccaacaacaaagttaagtcttagttaatctgtttttggcagcctgcaattaagtgataaactaaaaattcaatctcaccaagcatactgcaaaggatcgaagccccaatgttcaatcaaatatcaaaggaactcctcctgtctcctgtcctagtgccttccgggcagctggctaaaaatgacgacaacaaaacagtcatggcgtccaccggcggagcaggaagagggaggacggctttacggtgccagagtaggaaacccggcgccggcggcagcgttaacgcacagggaaggcatctgcattgtgccaagcttctacagcacactcttgctttgcctcggagctcttgtttctgctacataaacaagatgcagactaaagcaaaatgcaaacttaccacgctgagacgtgccggccattaacaacaccgccaccagccgtagcaggctgctactcttctacaacacaaccacggaacacacgaggaagatcggcagtgtcgtgcctgatctgacggctacatcttcggcctcctccgaccggtgaagatggtgatcaacggcgctaaagctcagtccataggggaggcctatcagcaggtccagttccaccacctcatagagcaagggacgatgtcccatcctccgatctgcacgggtggtgcgacggaggtgctctatgggccacgacgggctcacctctttctcccgatctagcgtggggcgcacctcctcgatcgctgccttctcgtcaggggcatcgcgatggtacagaggatgatggcatgttaaatctgcgcggagcgtgtaggtgaagttcgccgccgtcgaccccagcttacccgagcttaccgccgccaagagccaagacctcagatccggaaaaaaagggaaggcggtgggctaataaaaaatagagtgggtcttgggtaacagaaaatctactccacggctttcagttgcaacgggagaacttaacttgcgattaccgatagcgattaaccgtgattaattagtgtataaaccgtttttctgaacagaagcgtccagtgcctgtttcattttcccccacccacccgtgactctcggaaaaacagtggcgttctatcgacttcatcggcgtcgttgccgctcacggcggtgaatctccgccggcttccgccgtcctcgtcgtcgcttacgcgtggcggtgcttcgctggcgtcttgctctccctcctccaccggcgatggggaagacggcgccgcgcggagttgctcccgccggctcaggaacgtgcggagcggcggcgaagcagcatgcgagctcttgcgtcgtcgcacccctgccgacgaggaccgcgagctccttcgtccctctaccctcacgcagcagtgtttcacccaccactgcttccctccgtccatccgcctcctcacgccaccagcgctgcgccgctactttgcatcccttccttcgatacctgcaggtacccctcacactccattctactccgactgatttctccgccccccatgtcggcagtgcttcacagccgctttgcatcccttactcatgtgtgtttttctctttttttcttgatgatttccttgctgattttttcttcggcttatatggatagtatcaattcccctgtcctatcctcttgaatcccataattttacaggtaccaggtaccacaggtaccatacactggtatcaggtatcaggtatcaggtatcaggtatcaggtaccaggtaccagatactaggtatcaggtactaggtgtaccaggtatcaggtattaggtgccccccatgtcggcagtgcttcacagccgctttgcatcccttactcatgtgtgtttttcttttttttcttgatgatttccttgctgattttttctccggcttatatggatagtatcaattcccctgtcctatcctcttgaatcccataattttacaggtaccaggtaccacaggtaccatacactggtatcaggtatcaggtatcaggtaccaggtaccagatactaggtatcaggtactaggtgtaccaggtatcaggtattaggtaccagcctgtgctatactggtccggctgcagaggagcgacaccggcgacgaggtatcgcgcgcgtgataccgagttggaaccggataggtatcgtgcctctggtacgtatcagggggagcacacatggaatctcacctatacagatgaaaggaaaggggaggagtcatttaaagtatcccgtagcaacgggatcccgttgtgtagctgctctccttgagtaaaaacggatcagaaaaactagcacactggataccgttcgagctacgggataaacttaagggtgtgttcgctattcctggatccaaaccggatccttccgcacggaaaacggaacggtccattagcgcgtgattaattaagtattagctatttttctttttaaaaatggattaatttgatttttttaaacaactttcgtatagaaactttttacaaaaaatgcgccgtttagcagtttgaaaagcgtgtgcgtggaaaacgagggagaggggttgggaaaaaggaggaaggcagtgggagaataaaaaatagagtgggtcttgggtaaaaacggatcagaaaaactagcacactggataccgttcgaggtaaaggataaggatgtcagttaattaataaagtcttatctcatgttgccactcctccctcaaccactcatctcctgacgccatctgctagagatgaggacgagctcaggtggtacagactgaattgatagcggcgtagccgataaggcctccatcggagctgatgctgatgatacttccctcctctccctcgcctccaaccaacaccactgtcgcactcccctttctctcgttcgccaagagtattgttcttgtggaggtgtggcgtcagcgcaacaagctgatttgtgggcagtcatggtggtggctgagcaaagctgccaatgctggatctagaggcctaggtcatcctatcgctagatccggtctgagcgcacattggggacgagggcagtgagcggcaacgctcttgtgtcctcttttgtcccaagctcgcagcaaggtgacgcccatcaagtccaggtactaaggcagcaagggaaacaaacaagaaagaagaccatcgaagaagactcccataaggtatcagttgtgagccatggtatcacaggtatcaagcatccggtctgataccacaggtagcaggtctggtaccataggtctcataaggtatcagttgtgagccatggtatcacaagtatcaagtatttggtctgataccataggtatcaggtctggtaccataggtatcataaggtatcagttgtgagccatggtatcacaggtatcaagtatctggtctgataccacaggtatcatgtctggtaccataggtatcaagtatgatacctacctaataagtaccaggtatcatagtaccaagagatcagatttggtacctatggatatcatgtatgataccccacgtacggacgtacctagtatcaagacaccgaaaaggaacatgtgccactgcttagtcggctggcgagggtctatcgccaacacctcttgttctcttattcctttcttttctttcctcgattccactatctcttccttgttgttgttgccgtcctgctgtagctacgtccgtgcgccctcttggcgtctagccgctggtgctagcaccgttgcttcctgctagcatcatcaccatgcgtgcacgagggtgggtaggtgtcctcctgctttactcgttttctcacgcatgggatttctcgtaactggagaaaagaaaggggtagggggttcattaaaatatctcgtccttgtgacgggatcccgtactctagtcgctctcaaaacggatatataaatcgcaagaacttattagataataaaaatatcactactgtaaatacgaggcacctacaaatcggacgctcgatattattattattattatttgcaaaaatcgggcattgttacatcaagtagatcgaaattgtttcaatcatttaaaaagctgaaacacaaccaaatcacctcatggaacattttgctacaacgtatgaaacaaaaggtttccaaaaaatcaggtgatgtttcactatatataaaaacaatgtttcagcaaatagcgaaaggatatttcaattcactgcaacatttgatctatacatagttgtcggtgaaatgggcccgggggtacgcacagcaaagggaagtatccttctcatctaagtcgcgtggccacgcggcctcatctccccccgcccctcgggtagcgctgaggtggcaagggcgacctcggggtgccacgtcacacccctcaggccttcggggcgtgctaccctgaggccttcgcccggccaccacatggcggggagagcgggcggggcgagaaacgctgctccatgccttcaatgcgcggtgccacaaccgtcccgcgccgcatttaatgtggtgtgggaggacgtgcggcgccgctcggtctgtgatcggtcacaagcgatgggacgggtggcagtgcccccacgttccgccctatgtcaggcggagtgagggcaggtatgccccatcccatcggcacactgccaggggcaccccccgggcgtggtgagccgccgaagtccccatacaattaatggggaatgacggggatgtcccccgtgtcaggcgggggacggcgctgggcccctcctgaagccgggcaaccgtgttgcttccggttgaagcaaaggatagcgatctgattagggccatgtgggccccctcctgtggaggagtaggtgcaaacggtgcatgtggtatccccttgaactataaaaggagtacctcgcccaccaagaaaggggacgactctcagacaacttgagctcggagaaagaacagctaggtttcccttagagctaaaaacctcttgtcaaaattcaccataatcccacacacaggagtagggtattacgctcgatagcggcccaaacctgtataatccttggtctcccacacagccacgagagcgttttagtagttaagcgccaagcggaagtagggtcttgatcatcgcgccatctcccccgaccgaactcacaaaggggggggtctcacgaccacccgctagaggggatctctcctcgacagctggcgcgctaggtaggaggaaatccgcgcgcttgagaaggaagtcgttttcttccgccctaagtttctctccatcctcagtgaccatggttgaggtggtggaacatgaggtggtggtacgcacacccattcttccgggagtgaggatgcaagtgggagtagcgatcctcgacaccatcaccagaattctccaactcctccgcgccatagcccccgacggcaggaggaccccaatcggtctgggggctcggccctctccccgccacctggtggggggaggccacaccgcgccagggtgcggcgccgcctaacctacggcgacgaaggttcgccccagggcgcacttcaggcggtgggggctcttctgcggcaccccccctgtcaacctagagccggagactcctattcagcgatggttggatgacgtggccaacctggtcaccgccgctcagcgacagctggccaccgatggcgggcccgtgactactggtacctcgcgtacccccactaccctctccttgtccgcaagaaggagggcccgtcgatcggccttgacatcgaagcggtcgacagcccaacgtcgtcgtggccctcggaaagccggaggcatcatgatgacctctacggggagtaggacgctcgaatcaaaatcgagcgccgcagggacgagtgccatgctgcccgcataggggaaggcgcctcctcatctggagtgtcgcgcccctccgcgcgaggtggctcgccccccacgtccattcccggtggggccgggtgcaaggccgtcgtggcgagtctccggaatgtccggtggcccccgaagttccgtcccaacctcaccgagaagtatgacggcagcatcaacccctttgagttcctccagatctacaccacaatcatcgtggtggcgggaggtgatgaccgagtcatggcgaattattttcccatggcccctaagggtcaggtgcgcggctggctcatgacccagccccctgactctatccactcctgggaggactgtgctagcggttcatcacgaacttccagggcacatatccctgcccaggagtggaggcggacctgcacgctgtgcagcgaaaggacgacgagtcccttcgctcgtacatacagcgtttctgctaggtccacaacaccatcccctgcataccggcccatacggccgtttatgcattccgcagcgacgtgcggcacaatcgcatgctcgagaagatcacctccaaggagcccaagaccaccgcctagctcttcgagctggcggacaaggtggctcggaaggaagaggcgtgggcttggaactcctctggctatggtgcggcggcagtggctacccccgagccctcttcccactccaagcggtgggataagaggagaaagaggaagccggcccgctccaacgacgagggccatgtccttgccgcagacggtccttctcggaccccatgcaaggagaaggtcactagcgacaagccaagcatcaccactccccccggcgaaagccggtcagcggataagtggtgctcggtgcacaacacttatcggcacagccttgctgactgccgcacggtcaagaacttggccgagcggtacaggaagaccaatgaggagaggcagcagagtcgccgggagggcaaggccccgcgacctccgctggcgaccagcgagaggaggccaagaaaaaggcccccgccgatgacgatgacaacagcgagaacttggagttccaggtacctcaggggactgtcgccacactcgaccgggggggggcttgtgctcatgcctcccgtcgaagtttcaaggccatgaggcgtgagcttctggccgccatcccaacccacgaggcgggtcggaggtgaagctcactttcgaccagagcgaccacccgacggtgctcacccgtggagggaagctggtcctcatggtctccccgaccatccacaacgtcaagatgaagcgcgtctcggtcgacgggggggctagcctcagcatcatctccccggtggccttccatgccctcaaggcctcggggatgaggcttcagccgtcgctgccaatcattgcggtgacaccagggcacacgtggcctttgggccacatcgagctcccagtcaccttcggcgactccaacaacttccgcattgagcggattgactttgatgtggcgaatctgaatttgccctataatgtggtcctgggaaggcccgcggttgtgaagttcatggccgccacccactacgcctaccttcagatgaagatgccgggccccaatggcccaatcaccatctctggcgatgtcaagatcgccttggcttgtgcggagcagtgtgctgacagcttggcggcggccaccgagccagtggaggccggcggattcccgaaggcctccgcatcccacgcctccaagaagcgcatcacctcgggcgataaggtgcccgtcaaggagccccttggcgatgatctgtccaagaccgccaagattggcggcaacttggacgccaaataggaaagcgtgctcgtctccttcctgcgggcgaactccgacgtcttcgcttggaagccgtcggaaatgcccagggtcctcagggaggtgatcgagcaccgcctcgccgtgcggccggaaacccgacccatccggtagaaggtacggcgccaggccccggagcggcaaggcttcatctgtgaggaggtgacgcggctcctggagaccggcttcatccgagaggtcatccacccagagtggctagcaaacccggtggtcgttccaaaggccaacggcaagctccggatgtgcattgactacacggacctcaataaggcatgccctaaggatcccttccctttaccacgcatagatcagatagttaactccgctgcggggtacgaccttttgtgtttcctagatgcttattcaggatgccatcatatttgcatggctaggggaagatgaggaaaaaattgctttcattactcctgtagacaccttttgttatacaattatgccttttggtttaaaggatgcaggccctacttttcaacgcatgactcgcattactttgagtaatcaaatagggtgtaatgttgaggcttatgtcgatgacttggtggtaaagacgcgccaccaccaagaaacattgttgacggacttagctgagactttcgatagccttaggtccacgcgcatgaaactgaaccccgaaaagtgtgtgttcgatgtgccggcgggcaagcttctcggttttctagtctcgtcatgaggcatagaagctaatcccgagaagatacgcgcgataaagaggatgcgccctcagtaagcttagggatgtgcagtgtgtcacgggacgtatggccgccctaagtagatttatatcgaggctaggagagagggcgctacccctattcaagctcctcaagcactcagggccatttgtgtggacggaggaggcttagcaagccctcaaccagttgaaggcctacctcacctccccttcgaccctggtggccccagttccagaggagccgctgctactctacttggttgcgaccccccatgtggtgagcgccgccctcgtagtggaacgcgatgaacatgacccgcggatgccaagtcacaagcccggacatgggagggaaccaggggcccacttaaccagcgacagcccctcgttccctagcggcccaacgcccaaagccaccaatcccaagtaaggccccgaggccaccgcgggagagcgagaggctatggcggacgacccgagagagcgagaggtctcgaacgtgctcccgggccgtcgcctcaatccccggggggaaatcttcgagtgcgcgccagggaaggatgtcggggtcacgggcctggtggctcgcgaggataagctccaccgcagcccgcgccaaggaagccgatgacgacttcacggcctcgacgacctccttctccagcttctccaggtccaccaccatctcgtccaaccatcatgcgagcgccggcctcgtggaggggagcttcttgtcccggcgcatggagatgcccacccggcgccccgcacgttccagccgttcgatggcgtcgtggagctggccgggcccgatgtcgttggcaagatggagggccgcgatctctccagcctggtcctgcaccaagcgccccagatcggcgagggtgtcttgggccgtggcaagctggctggcctaatcgccaggctgcccgcgcgacgccagttccttctccctagcctccagctcggacgcccgtgccgccatcgccgcgtgtttggcccgggcgccttctaggtggtgggccttgtgcccggcgacggcctcctcacgcttggtgagctggtcgcctagccggcgtgccgccacctcgtggcggttgacctcggccctgcgttcgtgagcgcggcgtcccgctcctgccacgcctcctctcgaagccacagttcctccgcgcgatgggccactacggcctcggcggccgtggtggttcgggtgcgctcggcggcgacctcttcacggaggcgaagggcggattcggcctcggctgccgtcgcctcgtgggcggccaaagtggtctcgcgctggtccaacgcgcgtgcccgctcctcgagcactagggcccactcctccagatcctaggcccgctgcgcttgtgcccaatcgcgcccctcctgcttgcgtttgttgtagtcgaggacctcgatccgccggcgaatcatggcctcgaactcctgtgcggagcgggtgcgctcgtctaaggctttacgctcggcctcacagcgaggcgtcgacctccgatgcccaccgctcctaggccgcggccgcatcaaggaccccgctggcgtcctcaaccctctgcaccaggtcgtccgcatgggcctcatactgcaggcggatgttgcctagcgcctcgtctaggacgctcgaggcgatgagcgccgcctgccgctcctcctccgtctcccgcatgatggagtccagcgtctcctcgcgtgcctggatctccgtcagctgggcctggtgcattttgcgccctgtctccaccaggtcgtccacggtgcagcgcccctcatccacccgcgcgcggtccgccgcgacctacgtccactctgcctctagggccgctcgctcgtccgccagggcttggacttgggagttgagctcctcccggacagtggagtcggcggcgacgagcacccgtaggagcggctccatgcttgcgggagtcggggaagagaagggcgtggtccgtccccgggacgatggagtacggctggaccccccgcgagagtgggggctgcactcgggccccctttcacgtggttggacccaagggcgccccaggtgcagaggggtacgattgctgtcatcgcccttcgcctcgggcccccgggccgattcagcctcggcctcgggctcgggcttgcgccccacctcggcctctaggctgtgactcgcctcggcccccgggccgcgccccacctcggcttctaggccgcgttctacctcggcctccgcctctgggccgtgttccccttcggcggtgccctcgggaacgccgccgagggggatctcggtgccgccaccaccgacggtggatggcaccctctcctccctcgagggggcggtctcggccgtggtagattcggagccggacccggcgtacgggccacggcccccgctggggggctgtgaaggattcacggccccggttcggccggctcccagccgccccggccactcggacttagacccccgggggattcggctgtcgaggcccctcgggagggaatctcacaacaggagaaccccagttgcagtatttttttaaaaaaaaggaaaaaaagagaaaaataaaaaaaagatggcgccgtccgtggggaaaacggcgttgctggcgtcctgggccatggcagctgggcggatgcgagcaagaggatgggtgcacggagtacggtggagaaagagaagagcactaggggttggcaagtgtgtgcatgagtatgaaaatggcgagaggaaggagacgaactctccgcattcctccctttttatcctcgcctcaccagtgcccgactcctcgtttctcgccatttcggttgcctcctcgttttttgcacccactcgtcccattcgtcccgctaatcgcacgccccgcgcttagcacgcctgtcaacggcgtggccggtgcgggacgcatgatgattacggttgcggccaggcgggcccaccgataatcccgcgttcccacgcgcctggtggtcaggcggttgacgagacggccagtaatggcaccgggcacagtctaacaggacccctcacttttcctgccttgcgcgcctcgcgtgtggcgcgtttatcggcggtcgaataatcatcacggtggacgcttggatcgagctcgccaacaatgactcctcaaacccccccgtgcaacccattatcatgagacggaagttatgaggcaccacaccagaccaccccaagggggtcgcactcggatacagtgccggaggctactgtcggtgaaatgggcttgggagtacacacaatagagggaagtatcattctcatctaagtcgcgtggccacgtggcctcgtctcccctcgcccctcgggtagcgctgaggtggccggggggcctcggggtgccacgt

SEQ ID NO: 46833 - DNA, 4439 bp, Oryza sativa
ctgctcgattgatgtcaatcgagcttgactggtctatgaccggtcacaggtgataggacaggtggcagtgcccccacgttccgccctgtgtcaagcggaatgggggcaggtacgccccgtcgcatcggcacactgccaggggcgccccccgcgcgtggtgagccgccgaagtccccatacaattaatggggaatgacggggatgtcccccatgtcaggcgggggacggcgctgggccccacctgaagttgggcgaccgtgttgcttccggttgaaacaaaggatagcgatctgatcagggccatgtgggccccccacctgtggaggggtaggtgcaaacggtgcatgtggtatccccttgaactataaaaggaggacctcgcccaccgagaaagaggacgactctcagacaacttgagctcagaggaagaacagctaggtttcccttagagctcaaaacctcctgtcaaaattcaccataatcccacacagaggagtagggtattacacttgatagcggcccaaacctgtataatccatggtctctgacacagccacaagagcgatttagtagttaagcaccaagtggaagtaggctcttgatcatcgcaccatctcccccggccgaactcacaaaggggggggtctcacgaccacccgctagagaggatctctcctcgacaatagtgaaaaattacgagtacacttgctgaaacaatgttggtggaacaaaaattgaaacggattcctttaatagagcatttccataatatgtgggtaatttgttacaacgacgcatgtggtggggcgagtggtggggacggcatggaggtccggaagtggcgggcgcctgatttttctggcgctgatcgggttcccgatccctagcattttcgccgtaaatatattggtgggtgccatggataagggtgaggggtgagagtaaaaaaatcactattgatagacagagtgatgggtagatcggtggtgtagtggttgaataaaaaattactacgatagaggtaatgatgtgtggctggatgggagtggctatgagaagtgctatgccgttaggtagcaccatttcggaagatagcgatcgcgaggataagagttcggaagatattttgaagaagtaagtcccacatcccagttgagcattttgagcctactttatacaatgttttaccgtttgcaaataattaaattgcatgtttttctaattacatgggattagggactaccgatctgctcgcttgtgccatgtttacttaatatccatcctttgtcaaattggatgataatttgactagcttgtcacttatgttgacctaggtagaattatatatgcttagccatgcttaattaccacattatctacctttagtatcttgatgagttgtgagttcgagacacctagccatgttttattgctcgaaattatacaactaaaatatggcttaatggtgagctgtgtgtgtatggttttgctagtcgtatccatagcaattaacgaccggttcgcgggaaacctaggtgtatggttttgctagttgtatccatggtaattaaggatcggttcgcgtgaaaccctagaagacttacagtgcttaccacaagcaagaatgggcaactgctggacttgtagtgtaacttttccctttctgacgtactgaggcaagagtgagcgtgatggagtttggatgggccctgcgacggcctttatggcttccggattcacctaggcacaaaaggggttgcctaccttggttttaaagataggggcgaaacttacagtatgatgcaattggtcagtgggagttatgcgaagggtcttgtcacaatcactcaacatggtgacgtgtctggtcgggcacggtgatatgccggtagattgtgtcttgtgggtacagttgtgcatctctagctaaagtaaaactattcgaatagtcatgcccgtgatgatgggcgattaactagtttcaccgtgattagccccactctattaatttgatttaataaattggtgtagttcaggtggtttggttgggtctgttcaacgtggtgtagaattgttcagcggagatttaatattgccttaatcaatcaacaattttgctttttttaacttcaaatgtttacaactgcctttttgcaaatagccataaacctcccttgtattctcttacatgtctgtatcgttggtgtggtttccgagtacggtggttgtactcagcctttgtattattcccccttttcagaagtttgtgctttccgagctgaatacgaagttagaggcccaaggcttataccccagttgattttttgtctgtggagtgtaaatttttgtctcttatataagtatttacgtttggatctataaattaatttgttgttttgtgtatcctggcttggttcctcgacaaggatttatatataaaatagtctgaaaatttgagctaaatttcaaggcgtgacatgctctagatccatccacgtgggtgggttggagagggaaagggtgagagagaggaatgaatcccttctttccgcactggcccgtccaacatggccatcttgccgcggcaagccgccaccacaacaagactaacgcttagaaaagagatcgttgtagccttcaacacccacctcatggtgctaccgtcatcgccgcctcgactaacgcttagaaaagagatcgttgtagccttcaacacccacctcatggcgctaccgtcatcgccgcctcgactagactattcgtgtccaacgaccagcttggtcgcattgccgttgcctccatcctcccacagcggtagcctctgcgccgcgctcgccagctacgagcctccgtgttgtgctctctgcacgccttctcggttggcctcagccgccgccggattcactgcaatagcctccctgtcatcgccaacgcccgctccagcctttcggcaacggagcctcctccacgccacgtcagcctcttcggtgacgacctccttgcctccaccgctgccaaacgcgccggcctcgtcgtccgaccgtcacttgcattgtcctcgtcctccgccatcgaccatgaccgtgcttcgtcatgtcgccctgtgccgccccgctcctccaccgggccgccgtcaccgcgagcgccattgctgttgagggattcggcaccgccggagttgcccgctcccaatcttgctgcaggagggctagatgcgcatccggcgtggccaaattggccgcgccgagtactctacccaccggtgcatgccactccacctcccgtgccgagaagaagcgtcattaacttgttttgcctgccaccgccttcttggttggccgctcggtttccgacggtggcgatgcagcaagaaagagtgaggaaggtggcggtgttttgccgccagccgcccgcgcaagagcaatgctgggacaaggaaaaaaaaatccaaaagtatataacgtgctggactttgactaaaaagcacaattttttttattgtgatggttagcaatgatatttcagctaagaaatgcgatagttaaacatatattccttttgagtttatttttgaaaatatccctaccttacctccgccactgcggccgtgaaattcggtgtatttttcccgcggtactccaccaaaagcttcccgccaaacgtcctttcccgcgcggggggacgcgccaaaacccaccaaaatgtctgcaaccaaaaccccaccccgcgtatcgtcaatctctggaaacccctaacaaattcctgaacacccgccgccaccatagcttcagcctcgtgggtgaagaatctctcgtcgtcgtcgtcggtgtcaccatgaaagggcgcgcggtgaagctccgagaggcgcacaaggccggctcgccagtcttctgctccgttgcgtggggccaaggcgggcagcatgtcgtcaccgcatccgccgccgacgtggccatcctcatccatgacgccgctgcggtcgccgccgccggtggccggagctcgggctccgcggctgcggcggcgctttccacgatccggcttcacaaggatggcgtcacggcgctcgccgtcgcgccgggctccggcgcgtcgctggcgtccggctccatcgatcactccgtcaagttctgttctttcccaggttcttagatctgactgccccggatgcaatttctcctaatctccgtcatttccacggctatatttgtgaaattttgcttcggatttccttccagagggggtgttccagagcaatatcgcccggttcaccctgccgatccggtcactggccttcaacaagaaggggactctgctggcggcggccggagacgacgacggcatcaagttgattgccaccatcgacaacaccatctccaaagtgctcaagggccacaagggatcggtaaccgggttgtctttcgatcccagaaacgatt

SEQ ID NO: 46834 - DNA, 3277 bp, Oryza sativa
tcttctgggatctctgcacggggactgaagcccgtagtctgaagcggattgcgccgacatttggttcagaccactcaatcaacaatgccctgtgctggagccctgatgggcagttccttgctgttccgggattgaggaataatgtggtcatgtatgatagggacaccggtgaggaggtgttcactctgaaaggggagcatgagcaaccagtgtgtagtctctgctggtctccaaatgggaggtacctagtcactgctggattggataagcaggttctgatctgggatgtgaagtcaaagcaggatgttgagaggcagaagttcgatgaaaggatatgtagcttggcttggaaacctgaaagtaatgctgtagcagtgatcgacgtaactggcagatttggcatttgggaatcggtcatcccgtcgactttgaaatcgcccacagagggtgcacctgacctgaactctactaaggttcctttgtttgatgacgaggatgatgaggagaggccgagtacctctggtggactggatgatgatgatgatgatgaaagtcttggtgaattaggtccattcaaccacaagagattgaggaggaagtcaacctatcatgatcactcaaatggagatagtgaagatgaggatctgatacttcagatggagtcacgcaagagaatgaaagatacacatagagataacaaggaggttgctgataaggcaataggtgattcagcaacttcagtaagactggttacagcaagaatgcaaactgcatttcagcctgggtccacaccacctcaacctggcaagcgaaatttccttgcctacaatatgcttggaagtatcactactatcgaaaatgaggggcattcacatgtagaggtaaaatcttctcaccctctatcttataagccattgtatcctctacttgtttgcagcttggatgtgaataaaccatccgaagttactttgtttttcaggtagacttccatgacaccggaagaggtcctagagttccttcgatgactgattattttggtttcacaatggctgcactgaatgaatcaggaagtgtctttgcaaatccatgcaagggtgacaagaatatgagcactcttatgtaccgccctttcagtagttgggcaggcaacagtgaggtaagttaactaaatgaaattgttgtttgccagcttctgagatagggttgaagtttaccactttggtgcttactggactaatttgaaaattacttagtggtcaatgaggtttgagggagaagaagtgaaggctgtggctgttggtgttggatgggtcgctgcagttacaactttaaattttctgcgcattttcacagagggagggttgcaggttttgtaacttcctcaagctttgtatttaagtccttttttcctgatgaatatacttgttagtcagtttgtgaagttcatttttttcctgaaagaaagctgactccttattagttccgaaatacccaaaaaaccaggttgtgcctggtaatcagtttgtgaagttcatttttttcctgaaagaaaactgcctccttattagttccgtaatacccaaaaaaccaggttgctttagtttttttcagtgctatctactagagctttcataaggccaaaatagctgtgaagtattaacaaaagaatttatagtattttaaaaacaattaatgttatagaagaaaattagattcatgcgactctcgacatgtttccaattaaatttattggtcaaggaaacattctatactaccaacatttaaatgctgaaaccattttttatttctacatccaatgtacagccgaaattgtcccgccctaaccatcagaagcacagaaattgttgtactatgtaaccactcatgaattataacttgtggggcacgaattataactttgactttttgcactcaagaaaataattcagggaatgcactttccatgtagatactagtaacttttatcaccatttctcaccaagaagtggtctacggaacacatttacatttttagatcattaaaaatgctgttcatgacattggtcgtgacttacatagcaaagccaaactacatattactaatcttggatggtttttcttgatacatgcgagctgggggttacataagcattcatgaatctgatttacatcattccctgtttgttacttgaagtgggaaaaattcaatttaatttactcattttatattgtacttttacctagcatgtcttgattttcagatgcatatcctcggtccgtggcccaattaaaaactctttaagttttgtcaaacacatctcttgattttcagatgcatatcctctcagtcggtggcccagtggttactgcggcaggccatggagatcagctagcgattgtgtctcatgcttcagattgtctttcatcaggagaccaggtattcagtatatgttcgtttgacttttggagctttgtgtagtgatgatatatgttgtagctagctatcacttatcagattgtcagcacctcctagtgtaccatgattccaatcgtgtgaaccaattcacagtacatatgaactgatggttgaaatggtactacaagattctgaattgaaacatggatttgttcatgattaaccctttcaggtgctggatgttaaagtactgaagatatctgaatgtgctcaatcattgtccagccgacttgttttaactcctgcctctaaattatcttggtttggtttcagtgagaatggtgaacttagttcctttgattccaaggtatgaccaatgaacactgtcaacaattcaacatatctttagttatatcatgggagttttaaactgaatattgttatttctagggaatactgagggtcttttctggtcaattcggtggaagctggattccaatatttaggtatagtatctgcctgacaggttatgcattttactactaccaaagcacacttaataattatatccaactgcagttcaatcaaggcaagaaaatccgaagatgaaagccactgggtggtgggcttagatgctaataatatattctgcattctatgcaagtccccggagtcctatccacaggtatgcctaaatgcaacttctcatgtgtacaacttttgagtgttgatgttccaacaaaaatagtacttcttatgcaattctcaaatattgaaatttgtttgtcgtttgacgtctttgactgatcttatcaggtgatgcccaaacctgttttgacaatacttgagctgtcatttcct

SEQ ID NO: 46835 - DNA, 6621 bp, Oryza sativa
ctgcacccctgctgtgtatctcagattcaaaagaaaatagaagaaatggctgctttgggtctggacacgattgcattagatgatgaagcattcaacatggaggctgcacttgaccggtgcatcttgaggctcatctccagctgctgcaatggtacaagacttgaactatgctttttacccataaatagtgctttgcattaaattatttcttgttttatttcttgatttcaaaaggtgataagcttgtacgagctaccgagcttgcaaaattactaacactggagaagtcaatgaagggagcattgatgcttgttacacgcttaaaacttcccatattgcaagaaaggttcagtgccatactcgaggtgaaattcacaacccttatactgaacctgcgtacttttagcactctaaaaatggcacattcaatatttaagaatttatcatatgttcaactgaaggttatgcaatggcttcttgtaggagatgatgctaaacaatgcaaaaattgccaatacatctggtgttttctccaatagtaatacaaactactcaccatcaccagcgttgagcactcaagcagtcccaccagctaaggttgtgcaaaatggaaacagcttgaagttacctacattgcctaaactgaatcctgccgcccaacgaagcaatccaactgaatcaaacaaggcagaggtagaacaagcagacaatttgaaagaaatcagtacaaaggtttcacctgcacaaactccgttagttaaaattccaaaaaacagtgaaatgggtgtaaaaacgaagaaagataatgatggagcatcacatgcaactacagttgatcagaacccaaagggaggcagtggtcaggttggccttaaaaacaagagcgtcgatagctgcaatggtgtacagcctcagcggccagttaaccccttcgcgaaatcctcatcaagcaaagaacagccatcatccctttttgattccatcaagaagatgaaggtcgaaaatgagaaggttgacaaagctaacagcaagaaggtgaaagtgtaactgcttgtcattatctcatgatcttcgggagcaaaccagcagttaggtatcctccacctttactgacatatctgtgcttatatttttcatttcagttgtgataatgtaggtgaaaatcactatttacttcttgagctacgtttttgtgtatggcttcagagcttaatttctagttatgaggtggtacacaatgtatgatagtaaacctgtttagatagtttgcttgttccttttgttgattgctttgatatacaattacattttcgtctgattatatttaggatttatgtatctcctacagatatataatggagtgcgcaggttggctgtaaatcccttgattaaaaatttaaaatatgttgcaacttgctactgggtcctctaggatcaaaggtgatacacatgaacaatgagatccttaaattaaacaccaatggaacatttgtcttttatggaaaattcatagcagttaagtgttgtacggggttatttggtcatgtttcatgttcataaacctttagagacaacgtgcaacagtacagcaccatctccaaacatcaaggatggtcactctattaaacctgaatcaaggatggtcttcagatcttcacgtttcaataaactctatgctttttgattaaagtgcatataactttaggtattatgacttgtgacaaataaccttaggtattatagatctaaagtttcacaaaaccccactcatatataagccgtgcacacatctacttaaaattacaattttaaaatagtctatatgaaatatataattattggtttattgattaagcttgtaagtttaactcttcactactttaaaaaacaatgtttcaatatgtggttatgtaccacaagtcataatacatgtgatttgttttttaaaaaaaatactctataaataaatataatgtgaatatttagaaggaaaatgctaaataaatggcacacctttcagatacaaaatggcaagaagcccagaaggttgtgggaggaaatttcaaaactcaaacactaaactttgaaattagtcaccatggcctatttgaatgtgtggatggatgatggatgatagatgaaacgtggtttattaggccattgatatttgatagtgcggtgcgctgtcgtttggcctcagtggtcgtgcgctgtcgtttggcctcagtggtccacgtacatctagttgatgccctgtgtgttgctgcgtgaaaataggggatacacaattgttacaaacaattaagcttgaagaaagagtatccaatgtgcatggaattttgcttccaccagttgaagcatatggtaatgaagtgtggagtcttgcacgatactctgaatctatagaatgtagcagaaatactatgtactatgggagtgaaccatggctactggggattacttaagacagtattctatagcccatgacgaaaacaggcctttgaaagatcagaaaagggtctcttgttgacgcaaattgtctgaatgctttgctattctttatttctttccaactgggtgcatattggagacaatctgtttagtttttctgaaacccacatttgttgtggcattgttacgagacattgtttcatttcttttcctgaaagacctacatttgttggcattgtattacgagacattctgagcaaatgaaagttaaacatcacaggtagatgaattagctgcatagacatatttgatcaggcatttcaagatcgtagtgcacttcacctcgaaacaacaagctgaaaattcacgctatatccatgctggtgaagttaaacctggttcaacaaatcacccacagggcttatgtgagactgtgatactagagtagccggcctgtctatttagctgccaatccctaccaccgccgctaacttcttctccgccacgccaccgcacgagcggcgcacccttggcagccgcagggacggcggcagcggagctctcctccatctctctccccctctctcctgttcccctggcctcgttgtcctatgcggggctgggcagcgcgacgttggaggcgggcggcggcgagccagtgaccccagctgacggcgcggctcggcagagatggaggagagcggtggcggggcttccttctctccctctccgctcccacccgttcccccacctcgtcgtccgggtcgagctggcgccgcgttggtggcagacggcagcagcatccccagctgcagggcggggcgcgcaaatggaggcgggcggctgctgggtgacaacgtaggggtcttcctgcccttttccctacccacccccttgtcgacgtggaaaacacgtgctggcctgagagatttgctttactctagtgcagatctaaagagatcgctttcgagtctaggacgtgtcagttggtttgatcctgcaaccaacaagaaacaaagaaccaaagttaaatctataaacgatagccgatcggctggtttgtcgatgacgtatcgtttataccgggccgatgcaatatagatcagatcggccaagtagtgtatggcgaagggataattgaatgtgctctgtcggctatagatatcagtaatatataatctatgctttgaaatactcttaaaccaagtgattaggatagatcggtcagcgcaccgagacagtataaactacttgaatccaagaacgctttaaggcagggattatatatactcacagcatagccgacatgcaaacccaacgtgtaccagctagtactctgataccactttatactaagttttcgatatagatcaaatacgctaaacagagatcaatccagtgtcagggtaacctaacagactgatagcaggcttaatatatttggcccaaatgagatcttaatgtaaatggcagatttagcatatcaagtaagcatatgaggaacgagataactaaatcaggtaagatcggctgaaaccccgatgctatctctatcgataaccataagacaagctagatattatggttctgaatgttacttaacagatcaaacataaccgatgcaacatcaagtacatagagaaacataagatctaaacaagtttatgaaagccttttcgagatggtagatatactatataatctagttcgtcgcagctatttaaccttatcggctgttttcgatgatagaggctagccgatgagattatatagctagatcgaactagattatatagcatatatgataactcggcggtttacataggcgggactagagtgttataaagatgtaagcactagcccctagaactcaagccgctataacaagctttacctctttgtcagagattgaaatcgatgcagcccaactcgaaagcaagaactcgtcgaaaacaaagaaaagtaaaaagggcggcgatgcaccgagagtgtattgaacttgatgttgtttgtttacatggtctcgggtcatatttatacacaaaaaacatgatatgtccttgctggacacaactctatctctattacaactcaaaaatacgaacaagtcccttaggcggactcttaccgaaaatatctataaggaaactatcaaaatatcctaattaatagatacaattaccttctccagactcaatccacacttgccaatacttgtgtagcacttgaaccatctcgataatggtctcatgattgccttgccgggatcggctgtatcggcttctccctatctggtttggtatcagccaatgcagacggtagctgatgcaactcgtagccgatgcgggttctgtttccgtgattatggagttcctccaaatccgctttggttctgacttcggatccaattatgatttaccaattttggtcgttaacacatgcctcccaagtctgtgatatttgcgatgttgcggatttgctcgattctgtttccattcgcatctagggtttcttttccgtttcggccgttaccgcgcccttttaaatagtgatcaccgtcttgggatcctacttacgccgccctgcttcccttttttaccgctttcggtcattattccccgtgaagcccccactgtagcaatccctaatctcttggtgatcgttcctcaatcggcgaattcctccaccccgccaactttgttcggacctatggcgatggcatacgtggcggagatccccgaggcaagctccatgttactttgagcaattccctcaatcttctttggatcttcggtgatccgattccttctttccttctgccagcattccagggatcatcttttgattcccaccttctggaattccacatactttttccttgggccgatgggtgatccggatcccaccgagtttatcaacgctgaaacggagaggatccccttcaagcagaccaaaccagacttagctcaatggaaatcgacctttaggtcttggccgtccaagttgaaagggtacaagtcatggtacaagaggatggtggctgctaagcgatctaattgggagaaagtaggaatagcgcaatgcctggctttatctatagcagacataaaaaaggatgagcccctactttccgctgtcggctgcttttggtctgatacattgaatgcttttatcttgaggcagggacctatgactcccactttgcttgatgtgaagatgctaacaggcctggacatcctttcgtccactaatccttttgacttggacattaaatgctcttatcaactgaacacaaagaagaagaacaattgttggtcaggcttcatcgtcgaccatcggaagactggtctagtttcggatgaggaacatgctgcctttctttccctatggcttgagaggtttgttttctatgggtctacttgtgcaccgactgcgaacttccttcacttcgctgaagccctggtgagaaaggaaaaaattcctcttggccgatacctcctaggggcaacttatcagatgttacatgtttcctcagccggtatacttctaaataaaccggtcagttatgggggcccttggtggttcattcagctgtggttgacaattcacaccaacaccgtggccaacagaccttccctgcttgaatcggccttccccaaatatgactctaatgaagatcaatcagaatcccggtcgtgcaagtcttatagggaagcagcttcagtttaccatggtgtcaagccatccgttgaaggtttcaagacatggttcgacatattttacaacaacaatgctactgatgttctctttgcctatgatgcctacaccgagttcaatctcccaatggatctagatctgagccagaaatgctaatcagagattgctcgcctagcgatgggggtagcgatcaattcgcaccccctccccctccctccctccacctggtttcttttttttggcaccgcattacttccctattttagtaaatttatgcacctaaagtttatacaccacaagtttacacatctaaagtttagagacccaatgtttataagtcaaaagtttatatatccgattcaaatttgaatttgatattttttatatatagtatttctatacatctaaagtttatacacctaaagtttatagacctaaagtttagaagtcaaa

SEQ ID NO: 46836 - DNA, 1473 bp, Oryza sativa
aaatgagctgctcattgctgctacatgtaacttgcgttagcatggtgctgctacatttttccgtaatcgctaaattataaatcagaaaaaataagagtactaattaattatggtgggattgaatactggtataactactagctctgctatcctactgtgttttatacatttaggatgtgttcttatccatactttcctaacttttattctctcttttttcgcatgcacgcttcccaaactactaaacaataagccattttttaaaaaaaaaacatatataggagtttttaaaaatatcatattaattcatttttatttttatagctgatactacctccgtcccagaatatagcaacctaggagcagaatatagcaacctaggatgggatgagacccatcctaggacaacgaatctggacattctgggacggagggagtatttaattattgtgcgctaataaaccatcatataaattttgatgctatttaaaataccaataatttgataggataaaatttggcttcgaacaaaaaaggcccttcgcacttgcatgtataacaagctagatcaattcgacttgctaattttaacgagctaaaagtttggctcagatcgtgaaataactaactaatctcatcaacaagttttaacttatttatatcagcttaaaaatattaatatttaccaatttatcacatgttaacacgatattacacactaactcacttaaatacaagtggtggaaatgtagcaacttttagctttaaaaaagagtaattgcctaggtggtcaccgggagaagacagtacgcataaaaagatatactacctccattttttatcaagctaatgagctaaaagcccatatcagcttgggagtaagtttttgcaatattgctgtacacataatagccaaaggaaagcgacaagcagaatatataaaagcagctaatatgactgtatgggccaattgaacaaaagcagtgccaaggaaatgtagcagagggcacaagcagctcacgaagtcacgcaacagcaataagcaaggaacaacatgtggtacaggtacagtgaagcagcagccaagccgttcacgaagcttaagcatgcgccactccatcggcaagcttgtcacgccagagaaaatggcatggcagaacacaattgcaacaccaattacagtggcgtggtaacactgatgacgtgttatgtataacacaatgtggcagtactgccacgccaatatacatgtggcgtggcaaagttaataggcaacgccagctagcttggtgtggccaaaaggttcacatttgaaaataaaattttagatggtttagtattaaaatattatattaaaaaggtataaaatataaaaaaattcctcagggtcacagacacactgacttttacataacatcttttggcgttctccctccttttcatattataagatgttttgacttttttttccta

SEQ ID NO: 46837 - DNA, 1741 bp, Oryza sativa
ctcttttctcttccttttctccttttttccttttttttctcttccaaatttctctcataaatattttccttttgaaattatcattaaggtgtgcatgcggcaagtttgttactttgcaaatgctttccatctacaggtaaaaaactttcactaattgaacaatcaaaatttcaatctttggtcgatgacgtttagcaaaatacacgtgtcaacttatggaatagccacccgatcgatttgtgagactatggaaagatgtacataaaggattcttcgtgtgatgacacatgaagcgagtgtaaccgggttcaatactacatatgatttttgactttgttttgccattgttttgtttgacttgtttcggtttgtcgtttaaattgacagagtttatcaattgtgaaaaatgtcttcacctgttaaaacacacaagcatttttgctagtatagaaaaacatagcaacattttcaacaccaaacaaacatgtcatcaaaatatattcaatattaaatttagtgaaactaatttagcgttataaatgttactaaaattttgtataaagttaatcaaactgaaagaagtttggctaataaaaaagtcaaagcgtcttataatataaaacatagggagtaacttgtttgttgttcttaaatttcaaatgctctaaaaagatttaaatataaactataagatgataaaaaaggatttggtgcacaattactaccatagttattagaaccggaccggaccggctgtccgactagaaaaaaccgaaaccagggcgccggccggtccggttcacctaaaagatcgctgtgcaatcaaatcggcaagaactcggttgaaccgggcggttttccaaagaaccggacaaaaaccggagctggttgaactgctggaacggcgtcacgtggaggaaacagaagcgcgcaggttgcagccttgcaggtgcgtcacgtggagttagaaaatagggaaaaatgatgtagtacttgtgaatcgaacccaaaacctccatgtcaccgcataaagcatcaaccaccaggctatgagccaagatgtgataatagtataatacaaatctatttgaaccgcaataaaccgccggttggaccggtccaaccaataaaccagtgaaccgagtgtattaccggttcgagcaccggtccggtcttaataactatgattactactccatttctcggtgcactaactattcatataattaatatgcaatttacatactaaccgttagtctactaataactatccttagtctgcaaattgtcactctctaagataatgtgcatgaaaaatcattgtgtaattttataacatgatcaatatgtaaagaatatttaataaatttggttatgcatgtagaagaggtctactaattatgacctcctctaagatattgtgcatggaacctattatttataccacataacatgaatatataaagagattgtttttgtgacaataaatggggagcagcttgccccaacatgaattcaatgcattagttaatgatttacaactaacctccttattggggtccaactcatagccattcttcgcagccaaagctttagcaataccaacagattcctaaaattgtatgatacaaatggtgaataacactaaagcaagtaaaaaggactaatacatactagatttattgtttaccaaaatggcgacgccagtgataagtactgcagttggcattagggacatcag

SEQ ID NO: 46838 - DNA, 982 bp, Oryza sativa
taatagtatctacttttttataatgaagaataataatacctattgcgtagttattcccaagacatatcgttagtttcgttgattggtatgagttcgattaattaggaacatatccgtttggttagcaactaaagaaatggtttgttaaggatgtagagattgtattattagggggtaagctgctcacggattcacgtgaatagtacccatgctactgtagctcagaaaccctccttataaaaaggtcccatgtaacccactaccaattaagcaataaataatcataaagctaggtctagcttgataagagtctatggacaactgggacaagctcggtgctgacaagagagatcccgcctttatcccgatcttcggacaataccttatccatgaatgaatgtctataacaattcaatttacgaacaaagtaaagctctaaactagagaaccatagctaagagactattgtaccacaattaataagatttacttatacttgttcattcaataacaacgaatcaagtaattccattggaaaaagcaaccacaactttttagtgtaaataatattctaagggataagggagaaaagattggtaagtgtagtataataacccacttcatagacataaattcatagaagtagataatgttgtgatcagagtaaatttcttattataaagtacttccattgctcatattttgtaacatctaagagtaagaaatataaagaataatgtaggtgtttcttaccactgatatggaagatggatggaaaattttcacaaaaattgttccaaacacaactgctgtaaggggaccagaagctcttaggaaacgcagtcttttattcgattttccctgaaaaaagtttcgcttctcaaggtaaaaaaaaaatagaagtctccccttgattgtaatgtttccagaaaaaaaaaataacagaagaaccatactgataaagaaagaaattaaaaactca

SEQ ID NO: 46839 - DNA, 864 bp, Oryza sativa
ctcatgaagactcttactggggtcccggctgccgatctcccaaattttggcaaacgcaaggatccttcttcgagaattgccgggttatcacccaagagggctaaggccgatgattctgctgggacaagtgcctaagcgttagctgacaatatcctgccctctctctcgtcatccccaccaaccagaattcgtcacgccattcgcaaggttgatattcagctttgccaaaaatgtttgtcttcttcatggcctctttgtaacccgtccttttccctattgtaggtgaaagcgtcatcgttgatagacccatcggccccatcggcacaagaaccgtccccatcggctcaagctgctccgtctgtccaagccgttaccgaagaaattacatccacctcttctaaggctaaggtacttcccccacttctaagcttgatcgtcggctaatatttatccatgcctaacccatctcttcctacaggatctgtccaacatgttctcctttgacgttaaagaatttttaaatgagggtgagggaaatagccccgagggagctcagataaccgatgaagttagggccctattggtggaaatcgccgatcggctcaatgcctctttggacacccttgtaacaaactgtgggccgatctgacaacgcttccaggagatccaggatcgaattccagatgatttatccaacaagatagcctcggccgccttcctggagcaatatgagaagcaatgtcatcgggccacaaagaggatagccgatcctcacgaagcccaggctttggatgccacgatcgacacttgccagaagcaaataattgaagacaaagcaatcttagatcaactcgctattgccct

SEQ ID NO: 46840 - DNA, 3115 bp, Oryza sativa
ctgcacccccgatggagcacgaacttgccactttgcaggtgaaagaggcagcactggtcgaagagctgcagcaatgccgagccgatatattgtctgtagaaggaaagatcaagaacttgccacatgccaccgaggagcaaaggtctaaactgaaagcctccctcaaacacttggctaatctagtcaagtcctccaaagagatcccagggaccacagagcaagatcaggaggatttagacgagatagaccaaattcgcctgcgtgtgattaacgcaattgttgacggttgttgaatacaaaatttaagcatagtggtagggtttatttctaacaatttccacgagtgttggtgtatattcgtatgcagttgacaactgacaaactacctcagttgagaagaaatatacctggaggaggagaaacaaacacgtatccgaacatatggagttttggacccagaaacccaattaaacacctccaaataggccttccatccataccaacagaatgaggggcccaaaatgagtgtccaggacgaaaatcggagccgacggagtcgtcccgggttcagccgaactcttacggaggccgctggcccaggcccaggttgcgttcggtggataacgacttcccaatgacggttgtacctacagaaaccgtcatggacacgtgtgaagaggagaaaagagatgccctttggattccatggaggatctccacattcccatgaaagcttacactataaatacccctctcctctctcattctcacacacttgaagcatgagctgaattacaagaggctctattgtactttattgcatactagattagggatagagtagagtagaagaagtcggaggagttccggagttgtcggtaatccacttcttatttctttctgctctattaattactctaattataatataaatatattttgagtaatttagttttgcttggtgagaattatctcttggttagttcctaattagcgtgtaggatcattgttcactatagttcattataatatagtgattgctttagtgagttataaacacgaaagtagttattaactgcgtagatgctgtgtctaggtagttgatttccagtgtttgctacgcatctcacagtaggtgtgaggtgggtgtagaggtggtaacaaccctcaatatcattaaagtcctccctgtccgggtgcgcagtagagcgatatctgggagcagcgagctggctagtgccctaagtatcgcgttaggattgaagttaagctttctgtagacattgtttctcaccggtgattcctctatatcctttgcctatccgtaacttcgtgtccttggatgaacctgatttagagttgacacacacgttccctgtggaaaatcgatacctaagaatactcccaggtgaagtgctgcatcggtattttcgtgcgcttgcggattctatctgtgaggttaagaaataccaacagcaatccaaaatttcttgggtctgtaaatatcatggtcttagggcagtttagcctcggtgatagggaacttcagtttcggtgatggtaccctgactgtggagccaacgatgcccgctttgacaatattttgctaataatacttttggttggccctatcttgtccgtaatggttgtcctagaaagttttgcaaatccgtacttcaaattctctcaaggatctcaatcctatccgtgtacatatgctcctttaattttgtagtgttgaaaaagattgacaaaattatattggtctaagggcgatatatataacatatatcggccatctgaagacgatgtaaacaaatcggctatcttgtatcggcttaaatcaaccgatccatagtactgaaatcttctaagggcgatcatacacgtatctgccatctagaggcgatgctttgcacatcggctattatgtatcggcacaaaccagtcgatcatgcattgacccaaatacttaggaaatacttcttcaaatattttccgttgagtgctcttccataaacttctccatcgagcccttgtaacatgtaagctcccttataaactgacttgtagattcagaaaggtccttcccaatttggtgaccatttgtcgaatttattatcacgggtccctatcggcaaaatcaacttccaaactaactcaccatctgtaaaagacttgggcacaactttcttgtaataatgacgggcaactctttctttatccttcatcactttttccaatgtgcgtagcctggattgaaccaattcttccgattcgtctaccatgaggttacggtattcatcggctgttaactcatcttgcaaagcaatccttcttgagccgatgttgatctcccttggtaggaccgcttcatgcctgtaaaccaacttgtaaggaggaactgttgtatcgacccatggcaagccatccgataggaccacaatgcttctgctaacctggtatgacattgcttagggtaatccaaaatcttccttttgatcaatttaattaggcttttgttagatgcctcagcttgcccattagcctgcgcatagtatgatgaggaattcaatacttgattcccatgttctctgcaaactgaacaaattcatccaatacgaagatagatccttgatcggtcgtaatggtctgcggcacaccgatctatacatcatatgttccttaacaaattcgattgcgtccccagaatcaacatttttcaatggaactacctcaacccatttagtgaaatagtcggtggcaactaacataaacttatgccctttgcttgatagtgggttgatctggccaatcatatcgattccccaacctctgaacggccatggcttgattataggattcatagctgatgtcggtgctctttgaatagctccaaacttctgacagtcttgacagcccttgtaatatctgaagcaatcttccaacattgtcggccaaaaatacccagcacgtcgcaataaccacttcatcttatgggccgattgatgggtgccacatatgccctcgtgtacttctcccatcatgaccttggtttgatgtgcactcaaacacttgagcagtaccccatcaatcatcccataatatagctcat

SEQ ID NO: 46841 - DNA, 6020 bp, Oryza sativa
accagagattgcagttgtgtcttattctttgggggtgggatctccttgatcgcgttattgctactgtgagttacctctatccccctttcatgaacaaggaaacccaaaaactgcccagccgatacatcgaaggcacatttcgtacgattcatcttcaaaccatatctccttgttctttcgaaaacatttcttaaatcggctttatggtctttgaccactttggatttaactattacatcatcaatatagacctccaccaataagctgattagatcgtgaaatatatagttcatcactttttgatatgtagccccagcactcttcgacccaaaggtcatcacaacccactcatataagccgattgcaccaggacatctaaaagcagtcttatgaaggtcttcctcacccataaatatttgattataactagcattgccatccataaaactaccatcgaacacttatcaaagctgaataaaacaaacccttttctagccaaatcaacaattgggtgaatgagactttgtaaaaatagaacaagaggcttttaaattcatcggaacgttattgacatagattaaaatataaaaaaattgggccccctaattttttgggacccaaatcggtcgctcacttagcacaccctcatcgacagccctggttctatggcacatactctaagagctgaagatcgtggacataactgtagatgcacacctaaaacgatgagctctagcagggcttacgcgacggcggatgctgtggtataggtgtgggagatactgttttaggaagcccatgacgccaagcgatgtcggcaaagctcaacctcctcatcgtgccaaatcagaaagctgagaagcactccgttccagctccaccggggttatgacaggcagcgaatcgtgtcgacgacctcgacaccatccctatatgccttcccccttatctccatgtggcgtgtccctactaccagccaccacctcaccgtcgtgctccaacatgtggactccagtactcgagtcgatgacctcgacacgacctccctcctcatcttcgtggagcacatctctactcttgacctcctccttaccatcggagcatccgatgtgcagaggttccagtagtcatgccgacgggtggaaaatcatgctagtgacctcaacaccatccccgtattcttccctcctcatctcggtgtaccatgtccatgctgctagccttttcaccattgtactcctcctccatggctcgcatcccaaagctctagtctcgccgtgtcgtcagagctgcagtctgacgtggaggtacaggctatgacacaaccctcatcgacctctcctccgcccatgaccaccttcaactctaacgacattgtgacagtccgagcatgggagctcggcttcatcctccagtgaaggcttgccttcatggggatgagggaggggatgccgtgtggggcacatgtcaatgaggtggagagaacaagtatagtaggggcattttgggcaatacgaaaatataatggcctgcatgtgggtccaatcacatccaatttctataaaataccacatctaattgtaatgcatggtttctaaaaggtgaatagtaatggtgggtctctaaattgtagaatttgcaatggcattaatccaattaacccaaattcatttctaacgtttttatacgtgaagtttttatgtataaggttgtttctatgtataaattttatttggaaaaagtttctatatagaatgttttccatgtacaaaatttatatgtaaaaagtcatttatttataaagtttctatgtggctcgtgctagagatatatttgtaatattatctccttggtcggtttccctatttctcttgtaattatgtttctttaagtcggttgtaaagataaggatgcatcttgtctatatgtactcatgtccggcatcaatataatttatcacgttgactctcgtatacttttagctcaaaatcacatgtaggtttcgctcacacctaactcctcagcctcacacacggaatctacaccatgtcggctcatatattaggcctaccgatcaaatggcgagtctgaaattctaaccgtctatgttatgacggtgcccaactcaaccgatttctgcgtgtttcccaaaatgtttttggatgaagagatgtgtacatacattcaaaatatgagcagaaatcaatatagaagtattttggaatgtggagtagtttaaataaaaaaattggcatgccaaattatttgacattccttccaatgcaatacttatcaaagcttaattagtctccaaacaataacctagcaaaaattttgctactatcgaatcttgccactaccaaaaacaccccggaatcatgccattaccgaaaacatatatggcggcagaaatggctgggaaagtttttggcgggaatccaaagtgtatttcgcgccgaaatggcaactgtataaaatgcgtactcctccacggtgcgacttctactaagagagaacgagatggaaccgtgtgtgagaagcgagagcggcggcgtcaagaagccgatgacctcgccgccgatcgacgccgtcggcgtggacctcctccggaagatactccttcgcctccccaacatggcgtcactcgtcaatgccgccctctcctgcaagcgctggcggcgcgcggcctccgaccccgccattctccagcgcttcctcccgctccgccgtcctccgctcgtcggtttcatcctcaccgaccgcggcgacaagcccgtcccccgccactgccccaacatctacttcgtccgcaccaccgcccgtaagcccaatctggcatccgccgccgccgattgcgatatcttcttcgaagacctccccgatatcgattcggacgaggacgacgacgacggccgcggtttctactccgacgagtggcgcctccgcggctgcgacggcggccgccttctcctctcccgcggccgctacgggctcgacctcgccgtctacgatcccatctcgcggactgccatcttcttccgcccgccccaagccttccgctgctcgttccacatggtcaggtacgccattgtcgtcgacgacgccgacgcctcgttccgggtcatcggcatctgtgacgacacatccgccgccatgttctcctcccgcaccaacaaatggaccctgttcgacttcgacgcggaggcggatttgtgttaccgcttcaccgaccgcgacggcatgtccgccggccggttcgtgtactggcggtcgaacaccaagaacaacaagaacgtggagaggatcttgctgctcgatgtgggcaccatgaattggacagtcatcgtggcgccgtttcaggtaggggagtcgtactgcgtcgctgacatggcggagcacggtgggctctgcctcgtgtccagccaggagcaaaaccttcagctctgggtccgcagcagcggcagcggcaccatcaatggtggatggctgcttaagaaggagatctcattgttgcatcagtttgggtacttgaagaagctgcggagtgaggagtggatgaagagggtgcgtgtgctggcagcaaaggctggctatgtctacatggagttctggtccatcaggaaatctaattcctatcttctcgtcctcaatctcagcaccatgaagctggagatgtttcgcaacggttcggatgaacctttcaggggtcctgcatttccattcttgttgcgtttggcacctctgacgacacctagctgggatgatgcaaatgatcttcaggttccatctggatgatggaatcagtttactagctaatattatattaagtttgtttgccagattgcaattcctctgttttagtaggtaatactctgtttaatttgtttgatagattgcaattcttctattttctgttagagtaagtataagcctaatcactagattctggacattattttttaaacaaaagcactagattctggacgatttcctttttagcaggagcactagattgtggactgatgtataggtggtagtcgatttacaaagttatttgatctttgttctgaaccaaatacctctgtgtttggttgctgtgaggatggacaatggtacatcccttttagggcacttttgggattcgtggagctgcaaatgctagaacggaatgagttaatggctttgctggcaaatgttctgcttgcagacggggaggatagaattcgatgggtgtttgaaaattttggtgtgattttctgtcagatgtctataaagtttcatgtttcatggcgcatagatgggttataaaccaaaggatgagaagactttggatatgtagacttccaatgaaaatcaaagttttttatggcagttattcaatgatgaaccccctacttctcaacaactcttgagaggagaattatgcagacaataacaaactgttgattatatctttttttttcttttctttttgcaacttttgtatgtatttgctgcactgagtctatttggtggttaagaaataagatgtcaattgaacataagttcccttcaaatactagtttggcgctttacaaattcattttcttgtaacagtccaggagcattctgtttgagtggtggacagagataaagtggtagctggcttttgttctgcagttgaaagactggatgctgtcgtcaggaatttagttagcgaatgttcagtgatcttttggtttcattctgtgttggatagggtagtgttggctcaatgttgtctaagcttttggctatggtttgagacctcttcgctgcgctgttaagctgctaagcaaccttttatgttaccttaaaactcttattcagctttcaatagaagctggggtaatatcactttatccaaaaaaaaaaaagagaagggcttaacattcttagctgtgaccatttctctttgatgattgggcaacactactttggcagctcgcttcatcttctctccgggaatatctatagttatcagtcactacagcaattgattgacgttatttattttgaaaggaaacagttttttttttttgctagctcctgcagagaacattattgtccccttttttttcatctctgttagagcaggtacaataaactgactcagcaggctacaaaactgtgccacatcatcctattcctacgtggagggaagagaagtgaagagagagagaagagaacgaccgactaatttgtagcccggcgatagcgatttttttactccgcatcgctcgcctgcagccgcactcagcgattaaaaaaacacaatgcgggtcccacacaaccacaggggatcacgctttccatccgtatcgccctccccgtccgcatcgccctcctctccagatccccttcctctctctcgatcgccgccgcctcctcgattctcagcgcgcgacgcaatctatccccccggctcccgcgcttctcccctccctcccgcgcggttcccgcgcttctcctctccctctcccgctcgcgaaattgcctacctatatgacagagaaatccagttgctccaaaattccccatcgccatattccgccgcttccgatctccctcttccgccggccaccgaatcgacagccacctcgaccacagacccgctcctcttccaccttgtataatctctcccgcccccgcaagaaattcctgcctaaaaccctagttccccaccaccaacaccatgtctcgtcggaggaagagggaggtagcgccgcctcctcaggccgtcgtgagctctactgctccattcgctgttcctacgtcgcaggcagcgccatatccatatgggggtctcgggttcccgccgccaccgacagcttggcttgcttctccacagccacaagccatgcctggctcttctgctttccatcctcctgcggccggcaagactgatgtgcatcctgatcttgaagaatggtatgtctgtcaattggctttgttagttctgaatttgccatgctgattactccttttagtgctaaataaaa

SEQ ID NO: 46842 - DNA, 2308 bp, Oryza sativa
acctaaacacatgcaacccatcattccaaatttaagcacacaatgttcagaattatatttctaatcagcatggccagtggcgaattcacctcccgtgcagctgcccgggcttcacagcgacgatccttcgctaaaatagattaattcccgggcagtgtgtatgctagttagaggtaataacggcaagcatgtaggctgcaaccgacacttgggttaggcctcggctgcctatggcatgcatgcctcacaagtactagcctcaatgcgtcacacggacatgtacagaagcattgaacaacttgctaagttttaattctaataccagttccttgaatgaatagactaacttattgttgctagagtttcaggcataatgtaatatttagatgatatatatgagataagtcttaaaataacagagttacatataagataagtcttaaaatatcacaatgttaatttttatggctttatacaaaaaaaatgaacatatttaaatattgtagcagtttatttgttagctagccttgcccaggcagtttattcagttgaactggtccccaacaaaataaattggctgtctttttaataaaaacccaatagattagtgggcttctgctataccttgtttgcaccaatgtagtataggctcgtctgttagccctttgtactggatgagtgcatgtttattttagtagtgtatagaactccatttacaaactgaatggccattttcttgttaaaatattatattattcggacacaacttgaacaagatttgcatgttcatgtgttctatacggggggttgaatctcgtccgcccggcggtttcgttaattttatcaataccccatcaaaccatgtccatcatgtggccgaagggagtccatcacagcccatcaatgttgtgaatggacatgtcgctaggactgataagcgcttgtcatggatgaaggatgaagacttgagattggtaagtggcttatgtcagctatttatttgttaatggcatgcatgtcacttgcattactggcaataataaatttctttttcctgaaattgtagatcagtgcttggctgaacaactcaaatgatcctatagaatcgaatttcaagaagaatgataaatattggggcgatgtagctgcagcttacaacagcactacaccaaaaaaccgagctagactagttaagcaagttaaggatcgttttggtaaaattaggaagaaggtcgggaatttttgttgctcttggaaggaggttaattcattatatgctagtggggagtctaatgaagatctgatgaacaaggcacagaaaatatatgagaatgacttcaaggatggtccattcttgtttatgcactgttggaatgaactaaaaaaacaaccaaagtggcatgcatatttggagcagcttgacaagtcaaacaaaaggaaggcagattacaatgatgttatcccccttgatgatgaagaagatataccacgaccaataggagccaaggcatctaaggcgcaacgtagttgcaaagaaaagagcaaggtccaagtttgtacaactgagcttgaggatgacatccgtaagtttatggatgcgcatgcagcaaccaaggaagggcaaaatgaagtgttagagacccaaatacgggtttctattgacaaccatgcagccaaaaagcttagtcgccagacagctatgattgaaacctatcgagacttaatgaacaaagacacaaggaagatgcctgacgatatgagatctgagcttgttcacatgctgaaatgcatgagagaagagatattcaacaaaaatcagtgaggtatgaatctctgttctaaaatgtagttagatgaaattaatttgaagccttcaaaaaaaaacatgtaatcagcccaaaaatcaatgcaagttagtacaaacacacatgcaggtagttccctctttcatgcttattaattgcagtttgtccaaaaaaaaagaactttctccaagttcccatactgattgcttattcattgcagctagtcaaaaagttatgtagtcagtccaaaattttgcacttggtccaaattatgatgcagtcaactcaaatattcattgctagtagtctcttatggtgaaattagcatgcaaaagttgtttgcatttaaagtggacctttgtccaaattcccatgttgactacttattaattgcagctactcaaaaaatcatgtaatcagtccaaaattttgcacttggtccaaattataatgcagtcaactcaaatattcattgctagcattctcttatgctgaaattagca

SEQ ID NO: 46843 - DNA, 4300 bp, Oryza sativa
ttatctatctgttagataacatatttatgtattttgcttaatgtcacattgtttgtgacttttggatttgtaaaccattaagtatgttttgttttatcctctattaccttgtcggttatttagacatgcactaccctatccttttgtttagacctgggatgatccattaatctacttgctatggtattttatttatctgttgttggtgccttgtatttttttatactacggagactcttcatcttataacacaaatttggttgatgtgcactgtattgtgttaactatgtggtgttttatgattacttctgtagcatacaaatgttcatgccacaacaaattggctacaatgatccacttcactcttgatcatacacattgacatgtgctagttataattaattatttgatctatgagatgtagccaaccaacagacaacctactgtatgagcagttggctgcagcgttggctataaaatggagtgtagccggcaatgggctatactattagccttgctcttagggcaccgttacatgccatgcgtgtaagatcactaccgaaagaatttctattgaatatacttggttaacttgttttccatgctctctcaaatagttcagtatatttttttcaaagaagcaggtaggagctctgccattttattttatattagaagagactaaaaaaagttttttttttactggagcagcaaacacaaaaaaagaattaaaaaaagacaactttggtaagaagcttttggagctacatttgagccggcgcttctccccttgatttgcacaatagtagtagctatgttgaccacatcttccactgtctcgttataaacgttgttgaaaactctatcattctatcgttttgctccagccaaacgcaccatgacgtgcatatgatgatgccatcaaacatcctttgatgttcctttagagcaagtttaatagtatagccaacaactactagctccaaatcttctatagcgcctgaaaattcactagtaattttcaaactaatttatgcaataaaatcatcatccagaaatcagccgaggtacacaaactaataatttaatatacaaatccatcataataataacactacatacttacaaaagaaaagaaaaaacaacagcggaattacggtctagcgaagctccggcttcacttccataggcagctcaactggggtataaaccaaacgtcttctccttctatttccttttcttcaactgaggtttgattgattattgcaagatgagtacatggaatactccgcaagccatacagcaaatatgtaagtgtacaaggataccaaaggatggcataatatatggctcatttgcaaaagaagcatttagcaaacatttgagaattgtaaaacagtagagtaattaattatcaattttaatcaacactgaacatcatacccatgctgcacaggcccaaccaaacctgaacaaccatacccagctgtacagatctatctccaaaccaggaatgtaccgttccaaaccaggagctaatcaaattattaccagttatagcatcatttattatggtgagaagtgtgagactaatcacgaaagacattgttagatccgcccataaccgcgggcacggctattcgaatagctttactctggccagagatgtaccactgtacccacaagacacaacccaccgtcatgtcaccgtgtccgcgcagacacgtcaccatggcgagtgattatgacaagacccctcgcataactcaactcaaagctgtacaccattcctggatcataatcacccccttataaaacaaggcatggactcccagcaacccccgtgggtttatctccaccacttctcagtctgccacaccacaatgagccttgctatacaaagtgtccagccgttgcccattctggcttgtggttagcatgattaatgtttcataaccgaatctcgcgaaccggtccttaattgtcatgagcacgaccatcaaaaccatgtgctcactgttgacggtccttatcgatcagtttcgaccgtcaatattaccaaaatagaggagaactagttatgcttgcaatgcatatatatgttagaataataatattccactagtattatgtttactaaccttttgcagagaatgatcattaaatggaggagaatcgacatcaattcagacaataaatcaattggacgatgtcgagaatcagatttatgcatgaatgggccaagaactcaaaattgacacgatgaattgggccaaaattcacaagtttgcataaaggagcaatggaggagaccgccagccaaagatgggccaggatggcctagcccatggttcggccgaacccatcctgacgccttggatgcagggttcggcgtggacgtccaggattgcttcccaatgacggttggagggcactttggacaattctccttccacaaccatcataactacctctatataagaacttcactctcttcagttcaatacacacctcaagcaagagctctctcatattctctcaagttagtttagttgtcttaaactattggaataggaatagagtagaaatcaggagtccggaagtcttcgtaagagttcgggtatggctctagtagctcttctcttctcttttgtaagatttgtaattagaatattcttctatatacatttatggtattgaaatactttccgagtatgttaatacctactttacattatgttcatgttatactgaatatactgctagcttatctaggagatgctttggtgcgggtataatgtttgcatatgcaattactctatgtcatgacgatgatattagagtagtatctggtagtttaggcgtagtgtctagattacgggatatcattatctggggttatatgctgcggatgagaggtgggctgctgatggtgatagctcagtacgggtattcctccgcgcgtgtacatagtcctaagttaattctctggggagggtatttctccgtatttagccccggttgtatggtcatgacgggttgtcgtaaggaagtcggcagtcaggggtggcttctcgaagtactaggagggcatcggatagagggtatttgctagtatatcagagaactagaatgtatgtataccgtgtatactagaagaagtataggaatagattatcttccttttttctttccatttagcttagataatttattatgagaatgagtagcttaatgcttgtgtgtcactctacccttggattatcttaacctctgcttaggatatgattatcacaagtaatatataaattattagtcaagttctctctacatgatcttcccatgggataaaataaatacgatacccttgaagtactctcgggtgaaatgctacaatggtatatccgtgtgcttgcggatgaactctttaaccacaatataacaagagtatttctgcgccattgccgggaattatatttctggtaatgtcgttaagaaataccaacactcacaacccaccagtgtcaagttttagttgacaaattaattaattaaccaatcacgattgaccatcgtgagctacaattaaatatccatcattaggtaatagtgaagcattaatcagcctaatagtgtgctaatgtttctaagcatggctaagcaattagatctaatacatgcaaatgggccataacaaaggaacaggttcacaccacccggtgacattcgaaaataaatgcacagttgaaataaacaaagaaattaaatataggatcaacatgcttaaaggaattgtgtttgggatctgtgtgacttgccttgcaatattcggtcttcaattaatcttcttgaatacttccgacgcactcgcgaacctccgaaacgacgaaaacgacaagctaacacacaaaatgaggaaaaagactaataaaaaccaaataaacagtacatataaagtaaacaaagatgtcgataataaatttagatgaattatgagacttgaatggcctcattgtgacttcatatgaattagttacgaatttcacaagatttaatctaattaaagcctagtataaatattttaattgaattacgacgcaataaaaaattacttttgaaaaggaaaagagatttattgcgtcatcaaggacagtccaccataaaccgggttcacagaagcggtccacgaaaccaacggccgagatctaattgacctaaaattgaccgacatcggacggcagagatcgatccggtctaccacggtctacggctgacgtggcactgcgatcgacaatgatat

SEQ ID NO: 46844 - DNA, 4261 bp, Oryza sativa
  unsure (1)..(4261): unsure at all n locations
ccgagcgacgacgacgaccggagcgccggcggcgcacagccggacttctttcggcttcggcggcgcacgggctctagtggctaaggtgctacgggcgacggcgagctaaggagaaggtggtggcggatagaggaggtcctgggggtacttttataggggctaaggggcggtggctaggcccacggcgaccggcggtgagaaggaaagagctagggttttggaaagagaagctaaccaaatcggcatcgaatccgatgatttccaaacgaattagctcaggattacaaaagagaaaaggaagaggagatcgaggggattatttcccctcaattgattcagccggagaaggaacgaggtggccggattttaggaaggaggcggcggcttgcggcacagccagggcgcggttggaggttgaacacgaccctgacaggtgggccccacctgtcagcgggagacagaggggagggagggactgggccgagcgcgagcaggccgagggaaagggagagagagagaattgggccgactttcggcccaaacctgagaagaagattttaaaacctttttctatttaaattattcatgaaatgaaattccatttattaaaaatacttcctttgatcaaataaatcccagaaaaatctaggaactatataaacaatagaagtatataacaaaattttatctagcccacttttatattgagatttagcaaattaaaattagatcttctcttttaggcttttaagattatttctaataattccttttaaacaacaatttataatctaaggatttttaaacaagaaaggcacttaacaaacttataattagatcattaattgataaatttatagattaactaattactgaaacattctttgtattattaaaattaggaattgagctctgaaaaatcgagaaaattccaaagtataattaatcatggagaatttaatacaaattaaatccaaccatgctttatgtttaggaaattttatttcccacatttaacttcacttgtaaattaatgaacatttaatataaattctattaataatttattaaataatttataaatcctaaaacggaaattcaagctgtgacattgtcagttttgcttgttggtgcatttggaagcaacataatggactctcaaatgagattcgtctgcatgtctgcagaatgaatggttctctcacctctttcattcttagctggttacagagcttgtagtttatcaggttttgttttgttttttgtttttctgtacatgactcttcttttttttaatatatataactactaggcaaagccctggtagtaatatctccatccttttcttttctcgtcaagccacattaccttacttttacatttggattatcaatctatatactatttaaattatcataaaacttattaacttatataagcttatattgtttagctattttcatattatttttatttactgctatcatactaaagttaaagttaagtagcaatgcgcgagatttcacttagtatttaagtatgactgaagtacacttgtcttgctgccaggccttcaaccaaacaatggtcactagtcaggctgtgcaaaattcttttatgtttcaagtattccttttcgtagcatattgcggaggttgctaagcaaacaaccaatatcgcataatgttgcctaatatttaagtgcttaatagaaaatataaaactggagaacagagatggcgtgaggagaggggcacatggatggataagtacgatcgatgggtggttggattgacagagggtgccagtcatatgttatagttatcagttttcaataaaccggcacctatagtttgtttattgtatgtacgggttttttttaacaaaaataccggtaccaatattatagttgttggtttttatatagaaccgacatataggtaaccggtacctatattataggtgtcggtttttatttatatctttttctactagcaatatgtctgtgcgttgcaacgcgtgaaaatgatattaatattaacaataaataaatactaataattaaaatttaagtatcacaacatattgaaaaggaatatttttttgctaaatttcttgttggttccacttaggcaaaaaaaaaatcaaagtgcaaaattattcctaaatcgtaattccagtgggccgggggaataaaaaataattaaatattctaactaaacttcctgttggttgtatttagttagaaataaattaaaatgcgtcaacaaaatttactgcaattttatagcttaaaatgatggctcaaattgactaaaattatttataaattaaataaaacagtaagtgattttagagtgaaaataaatgaaaaatgaatttttggccgagaggctagtgtcggcccaaatggcatgccgacccaatgtggggccgatctgagccatccgatctgatggacagcttggatcggtcctgtgccgattaaatcgctggccggaggggggaggggtccaaaaaccctaaccctaatccactttctcccctactccccctatccaatctccagtgatgctagtggtgatggcggtccatcgtggtggagcacgcacacggctccgacttcatcggctggtacgtgttgacgatccttaaatcataatatctgaccgtcaatatctgcatatagtggaataaaatacggtattcaactgagtggtagggtttattactaattatttccactagtgttggtatctatttggatgcaggtgacaaactaccaaagttgaaaggaaatatacataaagaaggaggagaatcaaacttatatccaaacttatggagttttggacccaaaaacccaattaaacacctccaaatgggcccaactaccatgccaatggactgagggcctgaaaatcagtgtccacgaggaaaaacaggaacaacggagccggccagggttcggccaaaccctgagagaggccgctggcccaggcccaagttcagttcggtagcaaaccgctccacaatgacggttatggccattttcaccggtggaaaccgtcatcagctggatacttggcaagaagagaaggaagatgctctttggaagctatggaggatctccacaatcgcaaagcacctccacctataaatagacctcctctcccccacttcacccacacacaactttgagctgaattacaagaggctttattgtatcttttatacattagaaataggtagaggatgaggggaagctctggatgagtgcccagaagtttggcgctctcgccgacttctacctcgacaagtgtagctttctaggaggaattctggaggagtaccggggttgtcggtacactctgctccgtattcggagaaacttcttctattaagtaagcattcgggatcctttcttatgttatttaattactttgtctaagtgagatagatttccatctttgcgggttcattgtttagtattcgtactaagtgctctattactaggactttggataaagaaggaagttcatgcgcacgtattcgagtagtaattaaggcatggtgtctaggttagagattatctttgtttgttgtgtgttgacggttgttagtgatcagtttcgaccatcaatattaccaaaatagaggaaaactagttatgcttgcaattcatatacatgttagaataataatattccactagtatttggttcactaatcatttgcagagaacaagtataaagtgaaggggaattgacatcaaatcagacaataaatcaatcggacgatatcgagaatgggccaagaactcaggattgacacaatgaattgggccaaaattcacaagtctgtacaaaggagcaacagaggaggccacctgctgagtttgggctaggtgggcccaacccatggttcggccgaacctcccgtggcgccgatggatgcagggttttgatggacggctgggattgatccccaatgatggctggagggtattaccgaccattccaactgtcacaaccgtcattaccttcctataaaaggagctcctcttctcacttcactcacacacctcaagcaaagatttctcatattctctccaatttagtttagtgttctcaagctagtggaataggaatagagtagaaatcggagtccaaaagccttcggaagagttcgggtatggctctagtaccttttctcttctcttttgtnnnnnnnnnnnnnnnnnnnnnnnnnnnnnnnnnnn

SEQ ID NO: 46845 - DNA, 1040 bp, Oryza sativa
cataaccttggcatatgccaagaaagaggtggaccatctgaccaaacatcatcccagaaagaacaagacaatccattacccagagtacaccttgatattcctctgaaaaggtccattaacttgcgaacatccttccactaaaaagacccccttggaggagacagatgagggatcttgtcatagtaagaagatcagataagagacacccaaggcacttgtcttctattataaaacttgtccaaatatttaagtaaaatagcctgattctggatagacaaatttattacacccaaacccccttttaccttaggcttacaaaccttgtcccaagcagccaaagactttttactagaattgaaatctcctcctctccaaagacaatgtctcctagccctgtcaatattctcaataactgttttaggaagctgcagtgtgcacatataatatgtagggtgagaagagaaaactgaattaaccaaggtaagcctatccccataagaaagaaaggctgaatttgcagacaatattctctcaattctatcaactagaggagcaaagtcaatcactctgggttttgtggtacccaaaggcaaaccaaggtaagtgaaaggaagggtaccaattttgcagccaaaaactccagccaacatctcagccttatcatcattcacattaatagggatgagacaggatttatgataattcactttaagacctgtaccttgagcaaaggtttgcaacagggcctttaacacaaaaagttctttaccacaagccttaacatacaacaaagtatcatcagcatattgcattattggaaagttatggtcatcccccatgggaattggcttagataacaagcccttttgatgtgccatatttattatagactataagagatcagctccaagcacaaaaagcaaaggttagaggggatcaccctgccttactcctcttttgcaatgaaagtccaaaccagggacaccatttaaaagaactgaagaggatgcataagacaaaattttcctcacccaacaaca

SEQ ID NO: 46846 - DNA, 7925 bp, Oryza sativa
  unsure (1)..(7925): unsure at all n locations
tgcatccccctgaccaaaccctcccacattaggattacttgttaatggttgatcaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacaacacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggatatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaaaaattcaaaataacaagttcctctttacccagaaaaaaagaaccacttagaatagccaaacagattatatttgtcgagaaatgcaaaatgatatggagatgaccctcattatctattttggccaattgtattatttccttgcgtatcctataggggggttttgtacatgtgtattccgtttctcttttatcatttcgtccaagataaaaaggtcttctaattccatgaatctttctagaactcttttctcttgaatagcagttaagagagtttgggaatcttgcatgccttttccgcccgcctccgcacgcacgcacgcggtttctgcgcgtccacctcatcccccaaaatgtaaccatcttgcgatagtactggcatactccctccgtagtagtactcgttcgtagaggaatttgtgtagtacagcgacacggtctttcaatcatacttttgatttattctttctattaaaatatttattaaaaaataatataggtatatttttatgaaagtatttttcaaggtaaatctatttatatatttttttatattttcaaacttaacaacttgagacaacttgagagttattcatgatttatattctcaaggtttgacttaaatattgtcctaaacgactacgtacttccttccaaaaagccagtttaaaacagattaattgttacaataataataataataataataataataataataataataataataataatagcgaattatgtacaagataaaaatatataaattaaatatattcataagtaaacttaacaagtacacctccgttcatatgggcaaatatatttttatcatacgtccatctcatatggttatcttgtttttttcacaagctagtcaaacttttttaagtttgaaccgagtttgtagaaaaacgagctagcgtatgcaacattaacatcagatccaccataaagtatgtcttgataatatatttatttgttattgtatatgttggtatattttttagaaaaaaaacagttaaaattacggataaattcagggttgtctagacatatcatgtttacaatttcagttcgagaaacaccgaggggtcttccagctagctccacgagggggtgggttagataaactgggtttgaagcctcaccccttctaattatttgatattaggtcatttcttaatattaacgtttttgcaatttcagttcaaaatttcgccctcccccctccagtaagcaaatatactggctcaaatttccctttctttataaatttggtcaaagtttatttaaatttcattaacttttcaaataattttgtgaaagaagtatgaaaatttccaaaaatttcggtgtggtgccactgaaatcccgaaattttgaacaaaaacgaaattgaaaaccctgagtgagataaattcacagatttcacatactccctcctccgtccctaaatatttgacgccgttgacttttttaaatatgtttgaccgttcgtcttattctaaaacttttatgaattatgtaaaactatatatatacataaaaatatatttaacaatgaatcaaatgataggaaaagaattaataattacttaaattttttaaataagacgaacggtcaaacatgtttaaaaaaatcaacggcatcaaatatttagggacggtgggagtattatgtaatgtaatatacgtgcattaggatttttcccatgcaagaaccaaatgctcaatggttttttcattagaaagcgtttgttgatgattaactaggtggcatacatatcgtacacacgggggccgcgggcggagtcggtcgccgaacgagagctataaaggcggtgacgtacgcggcggaattcgttggccggccggctcgatcggctgacttcttttatatgcaggcgtgtgaaacgaattgattagacctgagagcatccatcagatgtgcgtgcgtggtcgatggacgacgtatgcgctcgctttgctcagccataccgtgtcactttttgtttcccttgtaaaatcacccgtttgtcctcactctcactcccccctccccttttccctgcctgctttccgagatgcaaaccgtctgactttccttccttttattttcttttgtttttcctttttttatgtatcagtgggatttgtgtttttctctattttttttatgattatacttttgtatcacacagataatattagagaaataattgttagttaaaaccttattttaacaaaacaaaaatgcggcctatattactttctctattctaatttgatcaccacctaagagtttttaggtttatcaaaatgatcattatataacaaagtgcctattcgtctatttgtgcaaatagttaacggttgtgttcgtatgagatggctgtggctgcacagcgtagcagctgcggcactcgcagtaaatttcatgcttctagtactgatgataaagtcaacagcagcctaacagctgcaatatgtagctcaagtgaacacagccaatgtgcgccgtgaaataccttgcacgcatgcgtgcatgcaaccaatcaagattattttctattggttcaatccatgtaacatttaaagtgtgaattattttttgttggacaccaaacgaacgtagcatcttaatcgataaagattaatttcagaatgataaatattttggtatttttaatcttggtgctctttgtttaggggtgattaaattgggatgaatggggtataaaatagagtgagtatatgtataattaacatgtacaaatttaaaattaagaaatctaatgcatgcacgcggctgctttacgacacggaaaggtggccacctttttggtcatgccagccactaaataatttggcaacttttcgatggttcgatgtcgatctactgtttcagtttgttgaggacaccaagttgacaagcaacaccaacatgcatgcatgcatcctctcttctcaaatctctagtggtacattttttttaatccatcaatccatatatggttgactcttgcaagttgcaccttttgctctagctaccgcctgccggccggcttctacatgcacgtggcaatgcgttgaacaaaataggtacatgacatgtttaattgaaaattggcttcatccttaaattagccattgccaagacagatgaagattaaacataaatcatgatgcaaaattaattttagtaaagaaagtctgaattacccccttaactattgggtgagtacgaattatcccctaaaaagaaaaccaaacatctatcactttcaactgttaatacatgatgaaaaaaaccccgagcgagtagctttgcaagcagttttggttgtacatagtagtcaagtcaatattttttaaaagaaaaacactcgatgcatagcatccaaattctttccctctcgctcctctctcttctccatcccatagtgcggacggccgacatcggagttcgcatgagcatgaacgccacgtcgccgtggtgcaacccgacacgggagcataagacaccgacgagtgcacacacccgcgacgacctcgctagtgacggcgtcaacaagcgcaaagtgtgtgggggagtagggatgacgacaaccgcaacaacgagaatgcgaacgccgggatggagaacaggacgaccagaggaggtgcgcaccacgtggagtggaaatgcagggtgtgggtatgcacgccagcggaggccagnnagnaggcgtgcactggtggaggtcgaggagatttggcgcaaccatgcagaaggtgccctgatggagcccaaggaggagcagcctccgccgctcgccgtccctagtagccttcgcctccgccttgtcatcgcctatgcggaatgtccgactttgccgccactgcagccacctctgcgcaagctccgacgttggccacgtgcgtgcgcatgcgggcaccgagcaagtcgtgctgtttatctaggggagggagaagtgagagaaggggtgctgtgagggagagaatttgacaggtgggtcccattgatttatttaaaaaaatactgattagattatcatgtagaaccagaacaattctagattgggttagagggtttttcacacggtattactagttgagggtgaaagatgtatagtttttgggtttggaggtaattcgtactccaacatgaggggtgtaattcagactttttcctttattttagtgatttcagttattttttttaatctaagataagttagtatagcatattgttggcacagataagttcgaattcttactactctcaccgtttcatattatgggcctgtttggagaagtttctaacagctgtagcttctcctagaatctccagctgccaaaagctcccccaaacagtccagctttttacccagattctgagaatatgtagttgtagaatctggaaaatgaattagaagtcagaagctgggtttcccggcttctccagattctcaccagctagcttctcagtagcagcttctcataatcttaaacttcccaaacaggccctataagttgtttcaaaaaattttcaatcaaatttctttagatttaactaagtttgtggggaaaagaaattaaatctataaaaatcaaattagtttcaagtaacatccaatttactttgtactcctggcattcaatatttacttttatacaagtaaaaaggttttcacctgcgaagtgagcatagctcaactggttaggctccttgtagtggaaccagcccacccgggttcaaattctagatttgatataggtgctcgcatttacggctaattattctttcagtggtagacgatgtacccgtcgacagcgaggcgcctgtggtgacttcgttgatcaaaagttttcaccaaacgctttgtagtaaagacgtcacgcgttgtctaaagtgagggaacaaacacgcgtgcagtgcagaagcactgtgaaagccaaaaggtagttctgaccaaagcgtagccagtcagtcagaaacaagaaaaacgacatctattcagtcagaaaacaagaaaaacgacatctatttggactttgaacgcatacatcgatcgtgcagacgtttgcatgcatggagtttaatttacgcgtgaagcatcagcctagcttttgaccctgtaaatttcgcctttgattaatttcgttgtactccctcctccgataaaagtaccaaactagccacctatctcataataaaatagattttaaagggatatgacacaccctaatactacaaatctaggctttataaatctggacataaagcctatgtagatttttaatattagaatgtatcacatcctttcaaaatcaattatattaggagacgaagggagtactagaccgccaaagctaattcacacgcgcggctcctccccaggccacgcctttctttttcattttttggtgattttttcgctttttttccggttttttctggttacgttttttaatctttagcacacatattttttcaaaatgttttgagttgaaaatttttaaatctgatttgaaaattttcaaatctcaagttgaaaagttttcaaatctgggttgaaagttttcaaatctcgagttgaaaagtttttaaatttgagatgaaaagttgaaagttttcaaaatttgactttgaaaaattcaaatttcgagttgaaaattttcaaatctaggtttaaagttttgaaaatttgacttcagatatagatttctgtcaatttgctagttagaaaaaatctttacattagtacgaagggaattactattttaaagtacgaagggaatagttattttagtggacaacataatgggcaacgttgacgagaggcttgcatttctagctcctgcactgacatggtggcacattgatgtgacttaacttattcctaccttcatcccaaaggaatgtctggtttactccctccgtcccaaagagggaatgtaacctctcctagattgatatatgtggatatatagagtatccatatacattgtcctaggcgttgatttcttttgggacggagggagtagtttctaacttttttttttaaacttttgacattttcatcgcatcaaaactttcctatacagaaacttccaacttttccttcacatcgttttaatttcaatcaaattttcaattttgacgtgaactatacacacactaggaggatgtgatcccttatagtacaatgtatatagacatagggtatatccacatacatcgtcttgggaggggatggagggagtaggttcttatttagattaatttagtacaagatgtggtattttttaatactatgaatctgaacattcatatgttgattcgtagaaatagaatatgtcacaaaattaacttattatgggacagggtgtagtaattttacgattacattggagactgattaaagaaatattaattaattgtttaagctgtgatccgttgttgaattttgaacataattttagaaattatttagagtggttttcgttgtttttgctgttcttctaggctgttaattaagtgtaaactataaaaatctcactactccctcgaccc

SEQ ID NO: 46847 - DNA, 14369 bp, Oryza sativa
gggtatttccttgatacgcaagtttaggaatttaaccggagtcctttaaatatattctatctacatatggtacccctatacccagtcggatatacatgccgtgtggtatagggtatccataatctccacagtagcccctgagacctttacattcgacggaatattcttcttttgtaatcctcaaagcgataatccgagtgcttcaattattcctaccttggtctcccgagtacttaaatcaaagactgtaaagggctgaaaataaaaaatcaggtgcatcgactagatgcacctaattaggtgtagcccccgactatgtgattagttaaataaaaactaaacatatagtcaaggtatattaaacatccatccgagtggttttataactgaatcaccaaagtgattatataattaagcatatgcggcatctgataaaacatccggccgactgctttagcttgaacactccaaaaaggcatagaaagatccgagtgaaaacactctacagatcttataaaccaacatatatgataaaaattcgaataaaaactcataaaggatttatcaaatgttgtataaaagatgttaaatgacaagtccaaatagcctaagccatgacttatgatattatcaaagtaggcatataatatgctgagagaataaccatttttaaaatagccatcttaataaaacccaagcagctttgtaacctaaaaaggtcaacaaagttagtataacacttttctgctgggcacctttttatgtgcatcgtagtaattccaaagaattatctaactgcctcaaaaaggattttcacggcatcgggctattctgttgtgagcaatttttaccaaagcaaaaacatatgcccaagtccctaaggatcacatccatccacgctaaaaatgaaactgggctgaaaacactattaaggcctaggcccattagtgttttccgataccctagcgaaataatcgctaaacagagcgccgcttcgtcttccccgccacaatctcctccattttccccactcctcgctacagtgcaaaaattgcaccggcgagaactagggttcgcaaatccgcaccaatccacttctcccgaaacttcatgcttttgtaaagatcttccgcacaaccaccgcatcaatctccctctcattcgttgctgccctcgcttcagatcccatcacccatctcgcactcatggcggaggagagagaaatctttgaaagtcaatgggctccctccgatgtaacagaggagaacttgaaggagatggtggcacacggtgttcttccggcgaaagaaatcatcggctggcgcccagcatacggcgaagcattcccgaccccggacacgcacgaggtcgtcatgttctcccatttcttctacggaggtttttctctcccaacttcaaaattcttcagggggattcttgagttttatgggattagcttgcatcatctgaaccctaattccatagttcatatcgctaaatttgtccatgcttgcgaagcctttcttgggattaggccacattttgccctattctgccacatcttcttcctgaagccccagccaaataaaaacaagccatgtgttgttgggggagccgattttcagctaagaggcaccctgagccagaaatatttctccatgcccttcaaaacatcgaagaaaggctggcacgcaaactggttttatgtgcagaacccagagccagcgcttcccgagtactcttgcctccctccgacataccaagaaacctggaactcgcttccaatgggagatgaagcttctcaagcgcttaccctgatggagtgcatgctaaagcttaaagagcaaggtctgcaaggggaacaaatcactcgacactttatcaagagccggttggcgactatcaaggagagatcccgcaccgcttttgagttcgatggcaaaaatgaccccaaccgtgaagatccagagtccctcgaattcaagatcatgaaggagcgaatcaaagctcttgaaaaagagaaggatgaactggccaagaaaagagactcggctctcaaagatgtcgaaggtaattgcagtttatatttcaagattaatcttgtcttcgcacccagatattgatgtattccttttatgcacatcgcaagattaaatctcaagctcaattcgaagtcttagtcaacaagattaagaaacttgaaggagctagggatgaggtcgccaatgctgctacaccactcgtccaagctatgttcttcaataacaatggtccgagttcattcgacgctgttgaaatcttcaacaagctgagaactgctccggatacatacttcaagaatatcaaggaagctggatgcatgggagcgagcatggcgctagcgatgaccaagtccttgtacccaaagatcgacattgacgctattgacggctttgcaaatgggacaagtgaggaggatgcactttgacctcatcaatgacgcacagaaggccgccgacaagatcgctgctgatgttgtcgaaagatttcaagacaacaatctcggtctgactgggtctagtgaatccaatgatgaaaaaactgaatctggttgaatccatgcaatgtaatctgtcttaatggaggctcaatttgtacaatactgatatatttatgctgtgcttcacaatttaaatttagcctctgatttcttaaaagtttttgtcgaaccttattgagcctagaacccgcaaaagttgtcaaaaaactcccagtcctcattaactaaaccaaaaaaatcaaacaaggcaatgataaatcaagtaagcaaattgaactgataaaaatcacactccattattattatagtagcccccgactggtaactcaagagatgacttgatgttggcagtcaaagagggaaagaatgtacaaaagtaatgcctaagcataaaaacgacgaagatgctcaatattccaatagttgtcgacgtgactaccgtcttcgcgctttagtcgataagaacctggccgagtaacatcagaaattatgaacggtccctcccataaaggagataacttgtgccgatctcgtgtagattgaatctttctcaagaccatgtctccgaccagaaacgcgcatgatcgaacattgcggttgtggtagcgtcgcaatccttgtaaataccgagccgactgaatcaaagctgcttcgcgagcttcctccagtcggttgagatcatcaattcggtcttctccgtagcgctcctccttgaagttgcaaaatcgcaaggactaaaattctacctcactcggcaacattgcttccgcaccataaaccaaaaagaatggaaattgccctgtagcctgactgggtgtagtgcgcagagaccaaagtactgatggtagctgatgaacccacttgccggcgtagggacgcagtcggtcaaaaactcgtgctttgatgccttgaagtaccataccattggcgcgttcaacctgtccattgctcatgggatgcgctatggaggcataacaaattttgatgccaaagtcttcacaaaagtctttaaacacaccaccattgaactgagtaccattatcagtgataattcgattgggtaccccaaacctgtgcacaatattgatgaagaaatctctggccttgtcagctgtgattgtgatgactggtttggcttcgatccacttggagaacttgtccacagctacaaaaagatgagtgaaaccaccggtagccctttttaaaggaccaaccatatcaagcccctagagcgcgaacggccaggacaatggggtggtttgcaactcctgagctggtaagtgaatctgtctggcaaaaaattgacaaccttcgcatgttcgcacgattctgtcagcatcggatactacggtaggccagaaaaaaccctgccaataagccttgccgacgatggttcgtgcgccagcgtgattcccacaaatgcctgagtgaatatcctgcagcaattgccttccctcctccaaagacacatagcgttgcagaattcctaaagggctcttcttatatagctcggtctcatgcatgatgtaaagcttgctacgtcgagaaatccgctcggcttcgtctttgtcttgagggagctcttgtttagtcaaaaacttgacgaagggctctctccggtcggcatcgatcatgcttacttcttaggtgcctgccgtctcaattagttcttttcttggtactgtcggtccataaagatactcaacaaacacatcggaaggagctgcttctcgtttcgaaccaaaattggccagcctatcggctgcttcgttatcatgccaaagaacatgagttaactccaatccatcgaacttgtcttctaatttacgtacctcttctcgataggcagccatgttttcatcgaggcaggaccactctttcatgacttgattaacaaccaactgagagtctccacgaactatcaaacacctaatccctaaggataccgcaatccttaatccatgaagaagtgcctcatattctgccacattatgcgatgcagaaaaatgtatccacagtacgtagcttagcctttctccagtcggggagatcaggacaacccctgctccggtgcctgaaaacctcttcaacccatcaaagtgccaaggcctaggagttgattgaagtgcgtggcttgaaggatagatccaaagacatcaactctagggcccactttgcaatccgcccgtttgccttgcgattttgaagtatatccttgagtggaaacaatgtgaccaccgtaaccaagtgactttgaaaataatgagataatttccttacagtaattagaactccatataacagcttttgtacctggggatatcttgtcttggagtcggccaaaacttcgctaatgaagtaaattggttgttggactttttgaacgtggccatcttcttcccgctcgacaaccaagaccgtgctcacaacttgagacgttgctgacacatacaacaacagcggctcttgcgggtgtggtgaggctaggactgatggagttgtgagatgtttcttgaagtcttcaaaggctttctgggattcaggtcccctctggaaattgtcggttttcttcaggagcttgaagaaaggcatcccccgctcgccgagtcgtgaaacaaactggctgagcgccgccatgcacccagtcagcttctggacatctttctgggaacttggcggtttcatgttgaggatggcgttgattttctccgggttggcttggatacccctacgggacaccataaagccaagcagcttccctgacgatactccgaaggtgaatttctcaggatttaacttcatcctgaatgcgcggatgctggcaaaggtctcttctagatctgcaatcaaatcatccttctgcttgataatgacgtcgtcaacataggcttcaacattgcgtccgatctgagttgaaaaacacctctggatcatgcgttgataagttgctccggcgttttttaatccaaagggcatggtgatgtagcagtaggtcccaaaaggcgtaataaatgaggtcttcaagcagtcggatttttttaagctgatctgatgataacccgagtagcaatccaaaaaactgagtaactcgcaaccggccattgagtcaactacctggtcaatgcgaggtaacccaaagggatccttaggacaagatttgttgaggtcggtgtaatcaacacacatacgccattgtcctgttttcttccgaaccagaactgggtttgccagccagtcgggatgtagaacttccttaatgaagccggctgctaacagcttgattaattcctccttgattgcgtcttttctgtcctgtgcgaaacggcggagtcgttgtttaacgggtttagcgtcttccttaacatgtaaagagtgctcaatcacctctctaggaataccaagcatatcagatggtttccacgcaaaaatatctttattagcttgaagaaaagtgatgagcgcgctttcctatttacattctaactcggcgcctattacagcagtgttggtaggatcagagggatcaaggggaattttcttggtcttgacgtcgctttctccgttctttgatatcttgggtgcaggcacttctccttcggttgccgtagatgcagccagtcggatctcctcccgagcatgtgtgatctcgcgtatctgggccatctcgtagctttccttgtcgcaggtgccggcttgcttgatgtcgctctgcaaagatatgactcctcgaggtcctggcatcttcatcatcatgtaggtgtaatgtgggaccgccatgaatttggctaacgccgggcgtccgagtatagcgtggtacgctgtcttgaaatcatcaacttcgaagcaaatgttctctgtgcgaaagttctcccgagtgccgaaggtgaccagcagggtgatctggccgagtggagtagaagatagcccggggatgactccgtgaaagggcgtgctactcggctttagctcagtccgagggatctgcatgtcgtccagagttttggcgaaaagaatgttgagtgcgctgccaccatcgatgagggatcgttggagtttgacgttgcgaaccactgggtctagtactagggggtaccgcctcgggtggaccactcgatcgagatgatccgagcggtcaaacttgattgttgtctctgaccaccgaagatattggggtgtatccggctggacggcgttgatctctcgttcagtcaacttttgcttccgcttggactcgtaagccaagggcccgccaaaaatgtgattgagttccttgcgagagtcttgaaagccagtcggagcgtcgtcttcatcatccttcttctttgatgtgctctgctctccgttagtcggcttccgcgctttcttggcgtattgttctgcaaactgttgataaatgaagcagtctttggctgcgtgattggaattggggtgatgtgagcactgagcgttcatgatcttctcgaaggtgttgatgcgcgatctctgccgagaagacggtgcagtggttgccacaaggtcctcgggcttacgcttgcggtccttatggttggtgcttccactcccgcctgttgctggcgcatatttcttgggcttccaagtgtcgcccgactgcttggacgcagtgaccgcatcctctgctttggcatattcgttggctttttcgaacatctgcttgactgttctgggaggcttgcgtctaaacttgctgactaagagttcatgatgaacacccttagtgaaagcggcgatgatgacgtcgtcggtttgcgttgtttagaaaagtgtcggatgtagtctcgaagggattctctgggcttctggatgacgttgtagtggtcaaactgagtaccaggacgttcaaaagtgccctggaaattggcgatgaagtgttcgcgaatctccgcccaagatccaattgtaccacggggtaacccgtgaagccaggatcaggcagagtatgctacacgggcagataattagccatggctttgctatctcctcctactgcgtggattgtgagaccatagacggtgagctaagactcaggatttgttttgccatcatacttctcgattccagttggcttgaagccggccggccaatccactcgacgtagattgcttgtaaaagctgcaactccatccacatcgtcatcgtaccgatctgacgagtggtgtggtatatagcctctttccgcgcgacgctggttgattgtgtcgcgaagatcgatgggacgcctgcgacgtggggagcgagtctgttcggcccggtgctccctatgcctatcggcgggtgaatgaacggatcgttcatcgtgatccctgctcctacgactagatcctgcagcggcgatgctgagacttggttgatgatagtcttgagatcgaagagacaggactcggctgccagtcggcgtgcggacgctcacggagttcatggtcttggtctggttcaagatgttgacgacgtggttgggtgcgtcttccttaagtagagtgtcaagaagggtgatcgctgctaccgcgttctgctgtggggtgcggaaatccactgttccctcaatgtcttgttgtccgatgagatcgcacgctcggcgtcaagcgtctagggcgcgttggcgccgatcctcagcctccttcgcatcacgttcgcactcctgttgctcgtgctgtagtcgtttctattcttgtgcttgtcgccacaagcctcctccagtcggcgacgctcggcttccagacgtgtgttttgttcctctgcttctcgggcttgacgctgtttcgccgtctcgttatcagccatgataactccgaagaagagaggtgtgtaattgtcttcatagccttcgtcgaaatcgtcgaggttgctatagtcgtagcggtggccgaagtcgtcgtactcgaggatctccgttggtcgagagtcgacaccgggggagctaaggtagccgtccaattctttcatcgaaactgtcccgagaggctgaagtatgacgccgacttccctgaagctagattggatcggggccgaaaccagatcccgtctagacctacggggagaagacatccttgtggtgaagacagcggccaagtcgtcggggagcttcatcaagattaggtcgtgttggagtagatgggatctcgtccgagtggtttgaagccgactcgaatgagatgatcttggagtagatctcggccgagttcgggagaccgaacagggcagagagctggtctctccctgacttgttcagatccgagtcgaggagagaaatcttgttgaagtcgttggtgatgaagttgaggctgccgaaccggaacgtctgcccgggagggaagacaaagtcgtcgatgccggagatggataccattgcactagtcggcaaaaaacttgaccgcaacccctacctggcgcgccaactgtcgaaacaagatttcggcaatactaaaagggggtggctatcaagctggaaaagtggatgggtttagagacaaggaattttatacaggttcaggccttttcaatgagaagtaataccctactcctgtccagggattgatccgccgagtgtattattgatcgtatgatctgggggaaaaaattatgctccaagaggcacccggacccctccttatataggggaaggagtctgtattacaaggtatagccgatattcctaacggaataggcaagtaaagataaaatacaatcgtaaccgactaggaacccgggtatttccttgatacacaagtttaggaatttaacccgagtcctttaaagatattctatctacatatggtacccccatacccagtcggatatacatgccgtgtgggtatggagtatcgataatctccacaccgcctctctcccccctatatattgtaaccactgttatcaataaaggatccgttcattcattccctctacattccctctcgctcaatctctgtccctccaatcaattatattcacaatacgttgcatgtttatccatgtcaatttaagtggcatacgaaagtgtatatgttggtattgctgcataacccatatatgtagatcatttgtgaatagagggagtatagatcctaagagtatgtagttataagttaaaaaaaatgaactagatgttagaaaagtgtgttcctttagattctcatgctggctaccactactaggaaaagcattatcgcaagcgggccaaaacggtcttcgcaggcggggcggccgtccgctcgtaagccaatgactgtgaagaccgccgatcttcgcaggcggggcggccgttcgcctgcgaagataattttcgcaggcggacgttggctagtccggtccacctgcgaaaataggaatcggccgcttgcaaaaaaaaatatccgcttgtgaaaataggtagaaaatattgaaatttaataataattttctcgtaaatttattaataatttgcccattattagaaattcttgcaggtagattattatgtacatatattggaagattatcaagcatttggtactgagaaatctacatatattgcataactcaaaagtgttgccaatatatatatattacaatatttttttacattgtcacttcaaataacgccatgtagttacattatggcatagcagtgttccactcccaaagatccttgaattcgtcacttgccgctagggcaacctctgggtcgaagaaatctcctttcacatgacagtacttatggtggatgaagtggcacagatcacgctggatatttgtgatgcctgtatcgtcaaagcttgttcgacattctaatcttggcaactgcatgcattgaagttaatcaatatattagtatcataaatatgtgaagctgtctagtacatagtatagagacttacatcctccgcgttagtcttgtacctcacattaaccctaaggaattcgcacgcataatacttgcaacggaccgttcctcgcagttgcttgtgacacttcaggacgtatcatagaaaaaaatagttaaaatttgcaattagtgaaacaattggaatacattaagtgagtggagtattaccggccaataggtacgtactagcagcttctcccttgttcgggtctgttctccacccttgaacttgtagtattggtacgcactgtatggatgtcgtaccgtttcacattaaggagaatatttatttataatacacttatatacaaatgcaagagtcataatcacttactactataagattgttagaaactctttgtattgcttgtgactgtaatcgagagggtccaagactaccacggttccgtctttagggtggatgagtaaacagatataatgatcgctacatactaacaacagtatagttagttagtaccagctaaaataagacatgtgtacaagataaatgtaccggacttacttaaaattataagcggccatgacgactctcttattttgaaagtgcaagaaggctcgtccaatgtactgtgtgacactaatcaatttctccttgtgcaagcccttcttgtattcagctatctcttttggattcttgcccttcagctggtcagaccctggtgctaacctcacggtatgctgtgtttggcagatccgagttggatccaagaagtcgataggttcttttttcttcttagcatccatgtattgcatcctacagaagaagtttgttagtaacaattacatggatttgtattgtacatatttttcatataattaattaaaactcgtactcacatgcaccaaacaccaacatagttgatgtccatcttaccccgacgatatatggcgtggagatctgagaaatctagccatacgtaaccttgttcgctgaaataatctgccggtgatcaagctgttatattgcccaagcctttcttgctagcctccatgtagaaggtatgtaaccttctcatctcccatggtccttccttcagtgcccatttcggcaagagtgatttcccatgttcgtacttttccgggcaatcatcagttgtgaagtatgttggcccggttagttcagcggccttctggggttcatcatctctgagcttggcacgttccttaccacctctacagacggttaccatgaacttctccttgttctcatctttggacttggagtcgtggctcctaaccactctaggcacctcagaactggtagtggccttctcagggaccgtggtctcttgcacctcggggtctttcgcaggagaagggtcttcaaatatttctggctctgtaacatcccattccaatcctagtacttcttctatttctgtcccgactgatgccacaacttgcacctctggttcggtcactttaatctccatttggacatctggcactgcaatctccatgggcacctccggcacttcaatctccggtggcacttctggcactagattttccttatgcatctcgggttcctccgccttatcagtcaccttcttcttaggaggtcttggaggttttcccaaccccggttttggcaccagaggttttcgcgtggcgtcggtgcccaatccaaaggatatgtcattcttgtgccagataattacaatatcgaccgcatccccaagtacggatacaccatctgcagtagggaagtcaatgtcataggactcaaacccttcgtggaccacttgttgctgcactttggcatacgcatcgggtatgaactcttcattatatgttctctcagggatagcaatggctgtaacggcctcaagagttcaagagttttcccggagcgtccaatgggaacgtgcaatctgcagggtgtattctccttgaggtcatcgaaggggtaatctagctctggttctttggtttcggggcgaggcaaaagcatgtgcttgacgtagaaatccatcatttgcctttcaaaatccgcagccccttcatctctaagtttatccttgtacgcatcacgcttcttgtgggggtcatgtttgaacccttccttccaactcatcttggacgacacacctcaaaccctacccccatgctcaggagtacccagcgccgtacttagcacatctttctccctcttaggcttaaaaaatcctttcttctgtgaactagataaattctctattttatcggcaacaccctgcagcttcggatcttgaaacgatactttgccttcatccatgatcttcggagttctagctcttacccaattccttgatctctgtgtccatttctccattggtaccggaagccccgccttcctcatttcctcaccctcttttgtccactgctccacctttggtgcgtatcccgtgaagcctaagcgatgaggaaatttgttatttttggccaactctgaatacttttggctcctttgaatttcttccggggagttcttcaacgtcagaaagtcctcccactgattcggggttatgttggcatacgtcgaaaacggtgtacgtcccgtcttcacaaatttcttgttcaaggtggttttccaaccatgccaagacttggccattgtttgcagagcacaattcctcactgctgcctctgatccatctgggaactggaagattttctttaactctttccataggacttccttatccccattcgatacatgatcctagtccttgaccgtgatggggatcttttcccttactattatgccacactgtgaactgaatttcgcacatgccgtcttaggggtgagcggctctccttttggcgaacatgggtaacaacatggaacccttcatcctttctattcacgcttctctcgcccttccttttcttcgcctttgctgaccattcgtttttctttgagccggttatgttagctggtacctcatcgtctttcgatggatcctttttcttcggctgccgttttgatcgccatggcgccgtttcctacgagaaggtatatatcaaagtttcgaattagctcgggctaatagttatcacggtgaactatttacatattaagtttacttaccccttctatagggggaatgtagtcattgtcgccttcttcactgtcgccctttttccttctcttcgggcttgggcttggacaaggatcgcttggcgacgagtactcatcgtcttcgtcagctacgtcgctgtcggaactatcttccggtgggaccgttggttctggagcaactacaacagcaagggactactcttcctcccctaaacccttctcttcagtccctttagtactatctgccatcgtttcaaacttctaacataaaaaataaactgtatattaacaataggccatatattaacacttagagaaaatagtttaaaaaattgataagtactgtactatgacatattgcaaacatatcctccacattttaaattactcaaattagtacaaacaactttgtacaaaatttgaaatgttattattaagtagtgcactaattcacaataacatttcctcgacatgttgtttaaataaaaaaataaactgtatattaacaatatacaatatgcacaaatttaagtattgtactatgacatattgcgaaacttgtgtacataattgtgaaatgttattaattagtacaaactaatttgctaaattaattagtacaaacaaatttatacaaaatttgatatgttattattaagtagtgcactaattcccaattacatttcctcgacatgttgtttaaaaaaaattaaaagggcaaacatatcctccacattttataaaaaaaattaacataccctcccacatgttattaaacaaatttgacaaattcacatatcctgcaaaattgaacataccctcccaatttcattcacatatcacccacattcccaaattcacat

SEQ ID NO: 46848 - DNA, 2608 bp, Oryza sativa
tgcgagagagagagagagagagagagagagagatggcggcggtggctgtggagcggctggcggcggtggagaggccggcggcgcggtgaaaggggcctggggggaagcggccggaggcggttgatgggccacggcggcgatgcggtggacggcggcggcgacggagcggtggagcggcggcaaaggcgcacggtcggtggagctcagcggtggagcggccggcggcggtgatgtggccggcggcgggagcaggtggcggtggagctggatcgacggccggcggcgcggtggagcgcgaggccggcgcgaactcgaaggtcggcggcggcggaggacgatggttggagggtgaaggtcgcaggcgggcggcggcggaggacggcggaggcgtgcggcggcgaaaaaatttggcagcctgactacgccaaaatttctagggttcccgcctggacttagaaattttggcgccgtggtcttgcccttatatagggaaaggatcttcgcaggtggacggtccgcctccaaagatgtaaaccctactcgcataatttttaattcatttttgtgatttcaaattgtctacagtagttgtaataaaaatggtaattgtacatacaaatagacaaacctaaggattactacttttcaaatgtaaatattacttcaatgtttgaaacattaatattactactttaaaaaaacatatagtagcaattttttatgtggtaagtgaacataaaaatattgctcgggctaaatttttaagcctcttttaaataaaacttttaaaatataaaaaactgtaaatgttaccctacaaatggtaaatgcacataaaaaatagtacaaactaatatgcaaaatgttgagtgcaattgttcgtcaatttgcgatatgatcacacatcaccttacattccaccattacataactactaacttcttagatgcttaaatgcgacaacaatcattaccctttaacattttttcccacaccgtccgtgcgcatgtaaggcttcacggtcttctgagtagatgtctcgacattcttaatcttccgtacaaactgactataaagtggcatactatcgtattgattgtaatcttcgacatcttcaaccccatccactcccaatatctcttgtttcccgggtagcactatatctttcttcaaatttgaagggtctttcacataaaacacttgtgccacgcgattggcgagtacccaagggtcatccttgttacccacactcgccaggtcaacaacagtaaggccgaacttatcaacattgaccccgtttgggtattttacccactggcacttaaatatggggaattgcattgtgtgcccatagtcgatttcccatatttcttcaataaacccgaagtatgattgtttttccccggcttcatcaattgcctccacacggacatcactgttttgtgtataggtgttattatctcgggcccttgtactaaacgagtatccattaatgtcatatccctgccaagaatttactgtagttgatggaccacaagccaaccgcttcatagttatttcatcggtagtttgtccctcaggtaagtctaggtttcgcaaccaatctatgaagagtcacttgtgttctttcattatccactcggtggtgtgacccttattgttagctcgtattagttcgatatattgatcggtgtaaggctcaacaatagcaaactgataaaggacgttgaagtgagcttcttggaatgatttgtgatcatgggtgacgaatctcttctttcctatcgttcccctgccactcaatctgccctcatgttggggcacaggtactccaattgcatatccatctttgaggtaatcgatacagtactcgacaacctcttcagtactataaccctcaactattgatcgctctggatgtgcacgattttggatgtaacccttcaaaaccgccatgtaacgctcgtatgaccacatttgatggaggtacaatgggccaagcgcaaccatctgcggcactatgtgaacaatgaggtgctccatcatatcaaaaaatgacggagggaaacacatctcaagttggcactgtttctcatgtgcgaatgtacggagatttcctaactcttcaagactaatgaccttctgtgacactgcgttgaaaaagtagcacaaccttgtgatagcatcctttaaatgctcctgttttatggcccttattgcaattgcaagaaacatggtgaccaagacatgacagtcgtgtgaattataaccagataccgacaaatctttcatggaaactagtcgactgatgtttgatgagaaaactatgggcactctgacatcacggagtgacttgcaaaatgacttcttctcctcaggagtcagtgtgaaacaggccggtggaagatatactttgccattcttctctccttcttgagggtgtaactcttccctggttcccatctcgactaggtccatccttgattgcagaccatctttagtctttttcggcatgtccaacaatgttccaactatgttgtcaaacacattcttctctagatgcatcacgtctatggcatgccgaacttctagatctttccagtacggg

SEQ ID NO: 46849 - DNA, 21701 bp, Oryza sativa
  unsure (1)..(21701): unsure at all n locations
atggtcacgaagatgatggccttcactgtgaagtattcccttcggtactcgtcctacactttcaatccttcttttcataaatcagccatatcttccaacaatggttcaagaaatatgtcaatatcaatacaaggctgacggggtccctgtatgaggatacagagtagtacgtattttcgcttttgacaaagccaggtaggaagattatacatggtgagaagcactggccaagtactatgtgagctgctcatgtctccaaaagggttaactccatcagtactcagggcaaatctaatgttccatgggtgtttagcaaactctctatactgagcatcaaagtttatccactgacgagcatctgccgggtgtcgaatcatcccatccttcttgcgcccttcttcatgccagcgcattagtaccgcatctcgtgggtttgagtatatccgtttaatgcggtctttgacaggaaggtaccacatcacaagctgcgggatttttctctgtcttccctcagttgtgtcagacggttctaggccagtattgctattcgatttgtaccggctagcaccgcatgttggctattcatctaaagaagcgtactatttcctgtacagtatgcagtgattaatgcacgcatgaatcttttccacaccaagtgaaaggggacatgagtttcttcgcttgatatgtgctggatggtagtgagttaggcctcgggagcattttctgcagaagttctaacagactatcgaaactggtatcagaccatccatgtctcgcctttaacctcataagttcaagaactgaccgtagtgttgtgaactcgctgtcacagcccttcgactcatcgtacaaaacttccttagctgccttctgtaaagcttcaaagttatttaaacctctagccgaccccatcagcacctcgggttctgcatgacataacatttcctctaggtcgattttatcctcaacagaaccatcgtcatgcaccatgtcttcaacttgtgtcggtactacattttcaggcccgtcgacttgttctttgccatgatgtgtccatatttcgtatttgtccataaatccacgagttactaagtgctccttcactttaaaagcatcatcgaagtcccaggctatttcattcttacagtcagcacatggacaaattatcttcctcatattgttcttgtcagcgtgtgccttggcaataccaataaatttagacacttcgtttctatatggggacaaaaacctcggcaaatgatacatccattcccgactttccatatctcaaaaaaatgaacataaattatttgcacaattaataccaaatttgtagggtttattgaaaaaacttatcgctattcaaaactaattaactaaaggttaattgtaaattaataaaaaaacaaagtttatttcaatttttttacatagacatgctaaattagtatattaggaaaatctaacaaaatcatatcatcggcatattacaaactaatataattattttttgattgcaccaaataaatataaattaaaaattttattctctctatatatgacaagatctagatttagatctagaattaggaggtggatgtgatagcaaaataaaaaaaattgagaatttatgttaccacattaaaccactacaacaagaggcatcaagtattacacatacatctaacatcaacatatcaacagaaattaaattaaaaaacgtggagcttttccttcacaattttgcatgcataaatccatcacaaattgaggtctaaaagcttaaaaaattgcatacctagtgtggaaatgagtagatctaagcaccgtagaaaaatcccccgaagatttgaagttcaaaacctcccgcccccctatatttaagtcactttaggggagagaaatatcggggagaatgaacagggctcggggaggaagaagactatataggggcatctttgcaggcgggccatataagcgacgcctgggaagatcgatcttcgcaggcgcacgacgtctgcgcctacgaagatcgatcttcgcaggcgccgcttatatggtccgtctgcaaagatcgatcttcgcaggcggaccgccccctccaccccgggtatattttttgccggcggggttttggctccgaattacatgcccgcctgcgaaaatcgaaccccctacgacgccgaaaatgagttttctagtagtgtactcaccaaatgttttatttttttcaaaatcttaacttattctaaagagggctaacataatataggatttaaatccatttgtctatatattaacattgcacacacgttagtgcactttcaattgaaatttagtaacataaaaaaatattattggcatctattttaacatcatgtcctcacgatagtgtgtgagtacatagtgtgaatgtgtgtgatggccgcatgtatgccttcttcatgtgtgatttgccgtagctacaaattggaggccccagtcctaaacttaattacaatgagactcactatttagaaaactttattaagcaaaagagtaaatcaattgacgctgtctctggtttaaacttagaaaaaaatcattaaaatgattctatattttctttatgaagtataaaaatgaaatattcaatatctggaacatgtgttcatatcatcttcataagctacgagtacttgaggtggctataattttcaaggacacttatcaaacccaagaaaagaagcccgttcaagttagatcagtgaagaaggatgaatgaaactttaaaaaactggatgagaatatcctcaaacatggtagagcaaggttaatattacagctcgctattggctccaaaaataacacataatcctgttatagctagtttcaaaaaggcaaataaatacagtaatgagctctataattatctctacctatttctcatgcacaacttttattttttttaatctcaagtagtatcatttgattgggtgctcacaaaggatgcacaaagtcacacacatgtagggaaaaaagagctgggcctgtagcatggggagccgcgtgcagccgtctctctctcctaccattctctctcttccaactaggcaaaaatcaacactatagcctgctgatattgtacctactcttaggctgtgtttagttgagcacaaaatttggattttaattgaaattagagatgatgtgactgaaaagttgtgtgtgtatgacagattgatgtgatgaaaaaggactgaaatttggatccaaactttagatctaaacacagccttataacgcattggactgaaatctaaaatttaggacctgtaggataatcgggcacctggcaccttgtacttgcctatatacagtcacgttattcatgtcaactttctgattgtttttgcttatgatctcttgtcggcgtcacgtattaggggtgtttttattattattctgtgatgaacaattgggcattggagattattggttttgttatttggaatttactcacgaaatggttttgaagatgattggatttacaggtgaatcgcaggatctattattttatgtgaccggtcagaccgggcatgtattacgcggtcagaccggcacagcccgcggtctgaccggccgacgctgtgtcggtttcggtttcgggttgtttgtttggatatccgtggttgtttcatgattatggcttctagatggatactatacatatgtaatactgttgtttgctactaatgagtcaagttggagatagcttggtctcggaatatggtttctttgtttgttccatgtgtaggtgactcgatgtctcgggagagtatttgcggtgatggaccggaagtcggcttagggataagacgacgtccgtggtggttagagatcatgcgggatactaaggctagagttgatgcacgtggttgatggagattccatatggcatacgatggagttattgtgtgcgtatgggatgcgaagtcgaatttggaaggagtacaaatttggtacgattggttatgtaaagtttcttcttgtactagagggttttcctaaggtgtataggactcctagtatgagtttggttcgtggctttaggctgcctacctcgggtataaatagagggggagcatgaggcttcccggtatcgcttttgagagtaattgagttgagttttgagttagggtttcgagtttagtcaaaatttttgtaaggagtgctgttggtgcactttgtaaacacagagagaagtaataaagtcgtcatccactttaagagttcttcgatttgtgtttcaccgggtttcggcggtctaacaggcgatataccagcggtcagatcggcggcacgaggcggtccgaccgacgggagcacggtggtcagactggcggcggcaacaggcgcggcaggcgatctcggcggctagaccggagattcaacaccggtcagaccagcggcatccactcggtcagaccggtcaatctactccggtcagaccgatctccattgatttcgagggtaacttttatttccgctaaaagttttcggtttttgggtataccaaccattcactctctctggtaggcttagttcttgtgattcgatcctacatattttctattttctgaaataagtgaccactttatcgcttatagtcaattatgttgggaggttaataacgacttagatgtcctttatttattatataagggttgtttatgagtcggaggatagtttaggtaaggtgaaaagaaatttgaatgagaaacgataaattgatcacttattttgaaataaatttgaatcaagtggtgactgattttgggacggaggaacgtaagatttaaaatagccttgtatgcatggttttgccataactttttttcatttcaccttgcccttatatcttgtaaggtcgttataattagcttaacaaatgaactagtatctgtgtgatccgttccttgtcgtgttgtccgaatcgtgttttgttttcaactggcggctgcagaacacacagtgacacagaccacttgctattaatattccttcttcatccttctttttgttttgatgaaattctttttttttcttcccttcacacgattaaacgccatacgtaccgatgacttacagctctcgtcctccgctgtgaaagctgaatctgtcgacagatctagtggaaaaacatagttgaattactctgtccattttaagttagaaattagtcctattcaactcgtttagcaattttatgccccaaattagtcttattcaactattttatgccccaaatttcttttagtaattacggtgtgtttagatttaggggtgtaaagttttggcgtgccacattagatattatataggatgtcgcatagggtgttcatgcactaatagattaactaattaaatcggttagtaaactgcgagacaaatttattaagctaattaatccgtcgttagcaaatgtttaatgtagcaccacattgtcaaatcatgaagcaattaggcttaaaagattcatctcacaagttagtcacaatatgtgtaattagttatttttagcttatatttaatactttatatatagatgttcaaacctttgatgtgacagtgtaaaattttcgggtggatctaaacagggccttatttctattctttgacctcagtggaaacatgtcttacaattagcccccggaagcaaatgaactcttcaattattggctctgtcactgccaccgtggaaactctatctacaaaccagctcttacaaatccaataatttaagaatagatatatgcatcaaattttcggcttgataagtacacaaaaagcgaaacaaaaaaagcgattccaaaagataaacagacgcctgtactccctatcacctttattcagctcatcaatcgatcgatcaacaattcgttatcacatcgattgatcgatcgactgaattattcttcaatgtcacaattacttttattgcaacaaatcgaggaggatacgagtcagcgagagcgtacgtaaatctcactgcaagcgagccactaattttgaaaaaaaaaacaaatttgtatgttcatgaccgaccaatgcaaaagatcgcgtgatccttattaattgttttcacaccaaactgaattaaagaagattccgaaaatcatcttcgaacatggtgtacatattcaatattaattttgcatattctttaagtttccagtggaagattttaattaatctttcgtgagaagaaaaaaagaatatctctgcgatgctgcatctgacacgtaactgtgttgttgtgcaagttggggataataaatagcgtcgttttattatgtatattgttttatttatatgccaaagccgtggctgttgttgagctgaaaattcaacaggggttaggataattattagtgagtggaaaaattgcgtactgtatttgtattagtcagaattgtgttgctagcggcacgtacggtttattgtctcccttatatcatttctgaagaaaagacaaccgatgcttgctagaccgtacgtacgcagctagcaatgcaattttgaatgtccaattatatattaattgtggagaaataaaatttgactgtcaattttaatttttgacgaacaactactccaataatattcaagttttgcataagaatacataccattggattattgttggaaattactattttcttatgcctttgattgtgtaacctttgaaagagaaacttgcattcaaaactttgctttttatatagtcaaactatgccttgtatttctgaatacaggtacacgaccagttgttgtctaccgagtggttgctctggttggtattaaaatttccctttccatgctttgatgataataaaaatcaaaagctgcacaaaaaagaataagtctcagtattcttttcaactannnnnnnnnnnnnnnnnnnnnnnttatttactcaaatcatctaaaaatatgttcttttctaaaagaaatattttactatattgattagaccacttgttctatgctatttgtattgtttatttctattttttaacttatccctataataatataaaaagtatgtggcaataatacgatgaataacccatttcaaacaggtcaatgagccatacatattttccaaaagaaatatattgagaatagcgaatttatacaacacgcacatacacaagaatataacagagaacacgccaggaagttacttgcgtgtggtcagatatgtccaggtatggggttgtgcactgaggttattgagatttaaatcatattccctccgtcacattttaaatacagtttgcggatttccgtgaccaacgtttgaccatacgtcttatttgaaaattttttgagaaaattaaaaaaacaaagtcacgcataaagtattatttatgttttatcatctactaacaataaaaatagtaatcatgaaaaaattcaaataagatggacggtcaaatattgggcacagaaatacacaattacactttaaatgggacggagggagtagatttgacactgataataatcacattagtaggagtgtacacacatgtgagcattcaatatttataattgtacctactccgtcccaaaaaaattatattatagtataacgaatttgaatagtttgtccagattcgttgtactagaatacgtcactaggtttattttttttggacaaatggattattatgtactagtatgagggtcgaattgatacacttaaaaaaaaagcacacactcactggtgttctctttaatttttcataaattaaaactagctttgccctgtgctttagcgttttatttttgtcattgttcccatgttaaaagcatctgctgtgacatatatccaagattaacctaaaatcttaagtagtttttgttctgctatctactgtgtagacaccaagtgcgaacctttattaacttaccattaatttagcaccttgcatgagatccaagcaaagaacaacaatagtaaaaagaccagaaaggccaggaccaaacgccaaactaatgcactagcacacataagcatagttctttacacataactctgttggtagtgctggctttgaatattactacacaggagtgtatgcccctgaactcatcacatctccccttttcctgaactttgacaaatcaaaggggctccaattgcattatttttttatgatccccatttctgaacccctaaaaggatcatggttgcctcatctgtccaaattcaaggccccatgactgtttcctctaaaaggtactacttccccttgtgcccttgttggtgattctctcaccatgtcattctcccattgtactttattaataaaacaaaaacaaaaacaaagtgcatggtgttgtcattttagtagccattagttcaactatgtcttgtcggcaactgatttattcttgaactttacaagtgaacttcatcatttatatttgagtagacaccagctatcgaaacaattcaaccatcaggtatcaacttttacgtagtaataaaactattaacaatgtgagacttcagaaatgtgtaaatctatttcttgtttttggatatctgttttcatatatcaatatagaaacaaggaatatttttgaagaaaacacatgcaaaaacaaagatacacttcccaaataattagtaacaccaaaaataatttattatgtcaaaagaatttgagaaaataactgttgggtgctatcaaaaaacaatgtttaaaaatgcgaaagaggatgaacattgaaccaaattttatcgaaaataaaataatatggagaaaaccatgcattggcatgtagccttttccatccacatccacgatttctgtcatattaataggagagtgaaaagagcagcaaaggcaatgctagctagccttggacttctattgtatctcttaaactttctggataaggcaactgtgcattggttccactccatgttccatgaaaaacttccattcctacaccggggccctctgctgtgatgacccatgtagaatgagtcaaggcattacccacccaatcaccatagttcatccattttcaatttacttaagcttcatgtatctttcatcctccatgatggaagctcttttgtgctcaaacttcaacaaaattaccaccaatagaatcccccatgatcctaccattctgttttttacagtcatggtctccagtgtttccccacggcggttactgcaccgtagctgtgaatcgagtttaccgcgggggcaagttaggcgtaactgtagattgtgtgatctattgacatgagtgcttagccatttatgatcaccttaatgcggaatagttagggtcactgataattgtttgaagccatggataccgtagttgccctaaggttgtcgatggccggagtggatatagacgtagcagtccctcgaaccgctccagtgttcgtcggcgtaggggaggtagtcgtgcaaacgatgtggcggctttcttcaggcctccacctgcactgtcctgggacaacactacgattcccttccaacgcaactaagaatcagggattagggtttgagatgtcagggagattggaaccgtgagagagatcatcacctttctcaagggctggtcccccccccccccccccattttattttgcactgagggaatcgggggctgctccaaaaggaatcatttgtagcgctagctatcaattattgcatgtgggtttaaggaaatttaatcatcattttaatttcgctaatcatgctggttaacgggtggaaacaaaaatgtgtgattttctcttggtttgcttagctgagagattatttcccaacagtaaccaccagtagggtttgatgaatgttgtgtgaattcaaatttgaaaaagaaaacgatggaaaaattttaaaaaaaatcctactccctccgtttcaggttataatatgttttgactttggtcaaggtcaaaatgctttaagtttgaccaagtttgtaaaaaaagttattatgaaaaaagttaagacgttttgacaaatatagtaacatttttaacccaagacaaatttattatgaaaatatattcaattattgatttaatgaaactaattttagtattataaatattactatatttgtctataaacttagtcaaacttgaaacagtttgactttgactaaagtcaaaatgtcttataacctgaaacggagggagtgcttgttatacctaatttctcttgctatccggtgaacaagtttgtgaaaatgacaaagtttacttcatattttggagctccaccaaaggtggaaaaacaattaaaacaagagagttgggttggggtatgactcctattttgtttaaatgtcaaaaatatagaaaaggttatgctaaaaaaaattatgagatatccacaattttcaataatttttcctatgttttacaattttttccacaatttaatctgttcagcttcaacatgctgtgtattaccacgcagaattcaaaatttgacaaatgaatttgctgggtggtcggtaaatagcctaccgactgattgtctctcctatgccccgatcttaggtactgccatcacgagaacgcaattacatgcccttctctgttatgtgctttgtttcttgccaatgaaggagacaaatcgacaatgccacttgtctctttgtgatgacacatgagccatggagaacagttggaagagaaaagaggaagaaaagggatacaatgacatgtgggaacaccaaataacagagaaataaaagggaaaggggaagaaaggagagtcaggacaaaatgtccattttgcagcatttggattgaaaattttctagcaattatatttggtatcatgttatttatgcaatggcattttcaacttctaaacttttttctatggtaccgacaaaattagctcaaaatttttcatgacaaaaagaattatccaataaaatattgttaccttgcatccatctgtctagaaaacaggagaataatagaaaaaaaatatttcctaatagtggctattgaaatgcattcttctctgtcctgccatcttgtagaacatatcagtgtttttttatatgcttcaaatttaggaaaatgtgatccttacaaaagctaaggtcctccaaaatagaagttttgctgttttggagcactttttgccaaaatggatataaacactagtagcaaaagttggcaatttagtatttgtcatttgggagtccagagtagtaaattttgccaaaaaatgcgttaggagccgtgctctctctgtctttactagtaaaatggcaaaactttaccatgcagctaaacactaactagcaaaacttcaataccaaatcttttgtcaccaaaacttttgcctttttttgccacagcaaattgatctaaacaggccctaactcctaggtaaactctccaatcaattattaccggttatgtatgtgcctgcatacttccttttctattataattgtaggccatgcttgaagcaacaacaaaaagtcatcccatctttgatatgcaaaaaaagtatgcaaatggaagcagaggcctttggcaggatccccaattaacacccctttggcacttaagactccacccaaacacttttgagggtggatgggagggtgctagctagctgctttttgggagaattttccttgggaatttgatgcatcaatcatggcaggaatgtctcaagtgtcactcaaaaaggccataaacagtggagtagaaagaaacatccagtgggcagtggagtgtgctttccaaaaggttggctggcaaagctagtacaatatggccatgctccctaataataaagtccctttaggatacctcagaaagcttctttcaccagtggaaaacaaatgcacatccaaggccccaaaagttgtactaccaacttgtagtggcacttcagcactactgtgtactcatctcaatatgagaaggaaaagaaaacagattagaaatgtagattcagttaccaggcataatgcctgcttttattttgttccacttaagtgccttatcagctactttatgtctaaaaggaacctgaagaagtgatcacaagtaatggcaagttgtcctaaagtgaggaggaaagcatcattatctggcacacacaagtttatgttgatatttacaatgacatgtgttgatttggagggtaaatcttgtcttgatgcagcttccttttgtcttccaccccttctactttcttgcacccattgtcttttcagttaactaccactgcatgactttaaccacataaagattatcaagaaagattatcaatccaaaaccaaattgttaactacaaaagtgatatttctaattgaggattgtgaggacctatattgagttatattgattgtattattgatcaaagtgcataacgacatttataaaaagaaaataatcaaggcaattaattgagatagagccaagtgatgtgaggctttgattctaagattggaaggtaaaaatgtcaggttcaggtaaataatgtcaattttaatagatttttcagtgaaaatgattccgcttaaaattttcctttttaatgaaagccattttttctgtatatatttttacttgtcttttatgacatcgacacaatctctcgtgccatatttgatccttttttttctaattatatatttataagaattattaaaaaaagtaaccaccttaaagtatttatcatgataaatccacctagtgtcattttcacatctcaaatcataatattttattatatatatacaactggtttaagattttgaggtttggcaatatactattccaaaacatcatatacttcctttgtttcataatacctgacagttttcacttggcattgttttaatttgaccactcctattttgaaataaacttgtaagttcaaaaatatgccaaattactgaagcttattaattacatggtaaattaacaaatgaatccagttcatggtaaccaaacaatttaaaagacagtaatggtgaaattaaagcaattgcttgtaaaattgtcaaatattagaaaatagatggagtatttgtcgtcataaggagcattagatgcattgtttgatgaactatctctacttgcacatcaattatttttttaaaaaaatataggtttcctaatttaataaattagttcacatcactccacattcatagtttttgtttacttaaccaattgttgacataagtgtcatataatttttaaagacacgaaaatggacctgaacgaaataaccaaacaaatgcgaggatgacactaaacgaaatttgaccagacacatgtttctttgtcattttcttggtggatgttgattcaaatgtccacattgaacaataaaagctaaggtacaatcatacacacagaaaagatgagcaaaaaggctagttagtggctatacaatcatgttgatccaaaaccaattgaggggctggaataatctaaagaatggatgagggttgccctgaagccagccagccagcaaacttgtttgcatgcccatgcatttacatattcagatgtgaattagtagtgggagctttgcagctatcctgcgttgcccaagggggcttggacaaattttcagatggaataaatgaggaccaaaggaaaggattggccctttccataacctcaatgttccatactttcttatttccaatcatcaaggaaaatggtgggttcatgcacacacacacaaaaaaaggtacaggaaaagtggtggggacaaaattaagtgaagtgcttgtaacttgtgacatttgaggaagaagcaagccatcagccatggggggcataagtgcatacattcagcttgatagccctcaaccagagatgatcatttctcttgtggtcctccactatataaattccttcatgaaaatttgtacatccagttgtggctaccaaatagagagagccatccaacagagagttcttagtgtgttatatcatatatctctctagcttgcacctagggccaacagaatttcctttgcatccagcagacattttttccacacaaaaatagtgccaacaaattaatgcaaaagagtgtttccattggagtgctgattttttttccctttcaacttgaaagaaactcatgtagagccaataattagagcgtactggatttttctattggtctttttgtgtgttttcgctatgttcacatcaatgacattaattaagtcgctagtacatgtcctagcttacctgggagaaagtctttttttttgtttttttccattttttaatttgtacaataaatatattctagctaggttatatagactgaaaaagtttttttttcttttgtatggttatagactgcaaaagttgttcttgttttgggagttcatatgtttcctagactaggtttatcatttgtaggttctcatagggtggactgcactaaaatctccctcttattgtctgcttattggttaagtgtttttcaaaagaagaaatactttattgttatgttgcacactctagtagaactatggatctacgtgaggttttgtattacatctctttgttgaagcttcttcgtaagtcaagatacctcgtcgctttcggtcgtatgaacatttatgtctcttgacaaaagactgactctcaacaaaatatatggactacttcccgttttttaaatgtacgacgccgttgatttttcaaaatacatttgaccattcgtcttattaaaaaaaattatgtaattattaattattttattgtgacttgatttatcattaaatgttctttaagcatgctttaagtatttttatatttgcacaaaaattctaaataatataaatgtttaaacgttaataaaaaaaagtcaacggtgttatacaattaaaaaaaggaccccgcaaaaaaatacattaaaaaaaggaggttgtacatatgttatctactccctccatttcaggttatcagacattttgactttgatcaaagtcaaactactttaagtttgattaagtttataggcaagcataagaatatttataataccaaattagtttcattaaatcaataattgaatatattttcataataaatttgtcttcggttgaaaatgttattatttttttctacaaacttagttaaacttaaagcagtttgactttgatcaaagtcaaaacgtcttataacctgaaacggagatagtattaagtatagagaatcatgtcggtgaaatccaacacgataaaaatctgaactaaaagtctctttcaaatggtcatcaaattcccgttcgaacggggcatttcactggccggttattacattctgtccacaagcacaaagccagttagctgccgaaactgaaactgaaaaatagctgccgatcgatatttttcacacatgcacggagctaggttaggccccacacccacaggccggtgggccaccacaagatttgtgccctgcaccacacgctgatcactaatcatcactaatacagtaacataccatctaacagtcgaaagaaattaagacattggcttaattaaatgtttctggtgctgctgcaatgtcatcagtacatcctaatctgtctttctgtccgtgtctatatatcgctcactcttaaggattactcagtattctcaccatgaaaagatgtctttttgatatctcaaataagtactttaaacattaattactatctgtttaaatattaaatatgtatatagatatatgatatccatacatgcatatttaccttgaaagatattatacaatattacagttttcaaatgttttataacaaaattagcgatcaaagttctatttcaaagattatataagacaatactccctttacttttaaatacgaatgttgttcacttttagatatgatgtttaacgatttgttttcattcaaagaatatagtgtacataagaaaaatacaagttatgctatctttgataacaaaacaagtgacaacgtaacaaatagtattcgcatactacatctatcctacaatataaggggttctgaaaatatcggtgcattaccataactcccttttaagacggagatagtaattctttgtaaacaacacaattggtcaaaagtcatataaaaaatcaacaatgtcatataggagtatttgaaaacagtggtaggagcaaaccatcgtcagatggaggggcatcatcatcagcaatgcagcatggtgatcttctcctcaattaagctccatcgcatgctttcaatttggggcagctgggaggggggggggggattgaatgcacaaagcgacccatcaaaaaggtcccagagagaggcatccccacaataataattagtaatcccagtctcacatatatgacaagggcccctgattaattgttcagttaatgactgggaaatggtccatgacctgacctgactccatcctctctctatctctttctgtgtgtgtacaacgctgaaaaagattttgtctgcttgtaaactggacaagaatctcttgttgtgttgcaggaggagtatgaaactatgaactgtttggctgctgcccctgcttctggttagaaagagaaacagaagaaaggacttggttatgctaatcattgctggttttgactgacaggtttgcttcctggatttttgtcaatgttggaaccccgacaagtgcccaggattaatttgatctgaaaggtcgtcaaattttaccaaattaaccccttttacaatgccgcagtaattcctttacggacttacaatggcatgaccaaaatggttgccccaaaatataagttggagattaatcattttaaaaatagaataatagtatcaaatgataaacatgttgctcgaacatattaggcaggcacaactgttgtaattgcctctgtatgaaatatattcgactcccagcaaaaaagaacagagaagaacggagattcatcccatctcagttaatttaaaacaagacgatatcctgccattaggaaatacaaaggaatgacttaactgcatcaaagagaaactatttacacttttcagagctcagcccatccaaacaaactgtcttgttatcatgggcctaatggaccattattaattcttaaacaatgctacgtatgatatatcaattgggccgcataatttttacttactgggccgtacgttcacttggatttcttagaaacaagtctattttgcctccctcatgttcttgcccttggtcgaatcacatccctcaaccgcaaaaccgggtataacgcctcacccatctccgaaacccggtgcaaatcgactcctcaggtagttttgtaagcggttttgtcctatgtggtgcttaggtggcattctacatagaaaaaaaatataaaaacatgatagtggccccacatgtcagtctcactttctccacctctaccctctctctagtctccctttcttctccggggtccaggactgacggctggcgaagaggagaggaagaggtcaggggcggtggatccgccttcttacactcccacaccttggcctctgcctcttatccatggtggtggagctctacctccgcctcctatctggttttgctatggattaggctctagcatgcttctcctcgaggcagtcctgcgccagccatgtctcctctgtgagttagcaaaatatcacaaaatatcaattgactaatgtgtgaagggaatacgtctccacgagctgtgcgagctagccacggggctcgaggccagcgccgcgccgttcctctggtcctgagggaggaccaagcagcacgccgtggggctcgttgtcccgtgggcactgtaggtaggtgttttgtgccacgcatcggtgggcgcgctcatgacgcacatctggtgggcgtcggtgatggagggcgtgtcaagcggcgtacccatggtgtgccgcccattcttcggcaaccagaagatgaacgcgctattggtgtcccacgtttgggggttcgggatggcgttcgacagggtgatgacgtgcgacggcgtggctacagtagtggtgtcgcttgttggcgggaaggatgggtgccggatgagggcgcgggcgcaggagttgcaggcgaaggtggcaacgatgtttatcgagccaaatggaaactgcaggaagaacttcgccaggcttgtcgagataatctgtgcatcgtgaatcaatcatgttggccttcaaactgttttgttgactgtttgcttttaaattttggatatttttggtgagataggaggcggaggccaagctccactgtcacggataggaggcggagaccgaggtgtgggggcatgggaaggcagatccgccgcccccgacctctccctctcctccttttcgcgggcttcgtcggccgtcagtcctagcccccggagaagaaagggagaccaaagagaggggtagagagagagaaaagggtagaggtggagaaattgagactgacatgtgcggcccactgttatttttttttttatctaaaatgccccctaaaaaccatgtaggaccaaaccacttacaaaagcacctgaggagttgatttgcgcctattttcggtgatggaggatgtgttatacccggttttgtggttgagggatgtgatttgaccaagggcaagacatgagggatgcaaaatagactccatggaattattggtgtagaaactgaaagcccataattggagtattttcatgggctttttatctgcctctgtttagtggatctgctcctctagcgaattcggcccattttgcgtctctgtcaattccaacaattctctgggctggttgaacttatatatacagctattatgtgcttctgctaagcatttgaaacaagtcctctatcagaaaaaaaacgaaagtttgaaacagattaatttgaaaattttggctttgaggtgaatcctgataaattcgggggagaataagttgcccacggattggataggaatcggcgatagcggggtccacgtgcatgtttccagttttttctcccacgcgcgcacgtttcgtttttttttctgttttcctttctttttttttttggaaaaaacacgtttttttcctttattttaggatgcggtaaattatgatagcaacggagagttgactgtaacaaacttttaaagcgaagatttaaaatttttaacttagacttgaaaacttttaagtcaagatttggattttttgaaactttcaacttagatttgaaaattttcaaatcaaaatttaaaaattttcaactcgtatttaaaagcttttaattcagatttgaaaacttttaactaaagattggaatcttttaactcaaatttaaaaactctcatctcaaaattaaaatcattcaacttaaattataaaaactttcaaacttggacttcaaagattttaattaaaattctaaaaacttttgactcaaaaattgagtcgaaagttttcaaatttgagttgaaagttttataattttgacttgaaagtttccaaagtttgggttgaaagttttcaaaattcgagttgaaagttccaaatttcacgtagattttaaacttgtagtgaaaatgggaaaaaaatctgaaaaagagaatgttaattaataccgtgattatcggaagttaaaaaaaaacttatcacgatttttcctccgaatccgcgtgcgcgtgtacctcccatcgttttgttgcgcgaaaaaaaaattggactcgcttcctcgctggtgggccggaatagaacgcagcgaagtgggctagaaatgcgcgctagatcgataagtagagcgtttgcgctaattagcatttccggacaaattcttagggaaaacttgctctttcaaataccaggggtgaaacaaactggatcgattagccactaacagcctgaggctcctttttcttcaaaatggacaccacagcctaacgtttaggttcctttttgttcaaattttgcatttgggcattgtccttgagactactgtagattttggactttggacgaggaaaatctgacccaaggagctcagcacacttgatgtactgtcaattgacctaattattgtctctctcaaactaagaaattaatcactttgtacttttctcacaaaataaagaacatggctgaataccttgaaagaactgtatattatattgcttttatatagagtatgacgatgactcatgacttcatttgggtaatgaaaattaaagaaattacactctgctatttcccctcaaaacaatcagcaaagcatgcaccattgtaccaaagtcagaccaaagcatccaaaccactggggatagaatatcctgctcacatactagctggagttgtactttccattgacctacatcttggtaatcagcaattagtaatctctcctagaaaggtgcaaagatcccccacctgtatatagatataaattcttggaagtcacattttagaaaaacaaagacaaaaccccagtccttggtagccattgacaggccccatacctagatgttcatatcagccaaggtctacatgccagtacggtttcatagaagcgatttatcatgcaataattctgtgacacaacttaatttgataacaaggatgcatatattgttttttgttaacaaatatacctatactttgataccagccaaatgtaactcaaaatatccgtcctttctttgaattgtggcaacttatgatggtgataaaagatatcaaactcggtgcaagcttgtcgccagtggacaccttcaaaattaagagtatatatttctacttaatttgtaagttggtccaaaattttaatttcttaaccaagtcactgatcaaactaacccatcataggtgattccacatgccaccacattgcatctagatccattgctaacgctcatacttgaccttacagcatgcctaatataaacattgaggttcaatttacaatggtggctagttagacttgacactgaagaagagctgtcaaaccaagtgcatgaatcctagctcgctatcaatggacaccgaaaataatagggtatttctacttaatttataagcaactcgatccaaaatctttatttcttgtagtgactcgcgccatcgaacggacttactagcgaagagctataaaatatattttaaaacatgtttctagatctgctgttttttgacgaaaaccaacaggagagactcctactgaaatgaattgccaaacaaatattgacaaacaaactgtacaaagaagagggaggagggcggggggggggggagattacatatcacaaattataagctgtctagccatgatttccaaaaaggtttatcctgagctttaaccctatgcaaaagtagggtaaaatcatctctaaaaagagatttccaagagttgaaggaaggctggacgttattaaagatgaagtcatttcttcttcgccagatgttccaaagagctacggcaatgacctcaatgaaaaagacatgggggaaattcctttttgcttcaataaccataggcatgaatcccaagtttgattgccattgtattcccacaaaattccagcatctagtggcaaaaggacaacagaagaaaaggtgcatgaagtcctccaaaactgagagaccacacaggatg

SEQ ID NO: 46850 - DNA, 1061 bp, Oryza sativa
ttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaagcatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgccccccccggaccgcccggatcccacgagtgaatagaaagttagatctacatgggatctcacctgaatcgccccatctatcctcgtgaggagaagtttgtttggtttcaaactccgattcaaacaggaggagtacgccatgctaatgtgccttggatgatccacatcttcgggtcaggcgctgatgagcacattgaactatccatgtggctgagagccctcacagcccaggcacaacgacgcaattatcaggggcgcgctctaccactgagctaatagcccgtcgcgcgggcctcccaaagggaggcctgctacgccaaaagcgagaaaaactccatccctttccttttgacatccccatgccgccacaccacacgggggggggggggggggcatggggacgtcaaaaaggggatcctatcactatcaactaatttgttccgacctaggataataagctcatgagcttggtcttacttcaccctaaacgaaagaagacttccatatccaagtttagctcagacgtagctgccttctttttgggcgtgaagcagtgtcaaaccaaaatacccaataagcataagcattagctctccctgaa

SEQ ID NO: 46851 - DNA, 6213 bp, Oryza sativa
ccatgagattcatagttgcattacttatagcttccttattcgtagacaaagcggattcggaattgtctttccttccaaggataacttgtatccatgcgcttcagattattagcctggagttcgccaccagcagtatagccaaccctaccctatcacgtcaatcccacaagcctcttatccattccccgttcgatcgtggcggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgcccttttttgagacctcgaaacatgaaatggacaaattccttctcttaggaacacatacaagaaaaaggataatggtagccctcccattaactacttcattttcatttatgaatttcatagtaatagaaatccatgtcctaccgagacagaatttcgaacttgctatcctcttgcctaataggcaaagattgacctctgtagaaagactgattcattcggatcgatatgaggacccaactacgttgcattgccagaatccatgttccatatttgaagagggttgacctctgtgcttctctcatggtacaatcctcttcctgctgagccccctttctcctcggtccacagagaaaaaatggaggactggtgccgacagttcatcacggaagaaagaactcacagagccgggatcgctaactaatagaatagtactactaactaatactaatatatagaaatagatatctagaaatagaaacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtctattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaaataagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacaggaagggtgacttatctgttgacttttccactatcaaccccaaaaaacccaactctgccttacgtaaagttgtcagagtacgattaacctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacagaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttagcccttataaaaagaaaatggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaactcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaatgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcaatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcatcgagcctatggaaataggatactctgtttacatagaaatccccacgtccttacattctatttaggattaggaataggtgtaatcagacctgcttttgacaaatctatcc

SEQ ID NO: 46852 - DNA, 15781 bp, Oryza sativa
atcaaactgtgacagaaatattcaattatttgcattgcgcgtgagcagggcggtgcacatagcggaggcaacgtttgacctacacagattaacaaatgctatagcatgaaaacagtgtcaggggaaaagcataagtaacatggttaattgagatcacctaggacacaacaccgacataacttaattattaattaatttatataaacccagatacattatgcacagttatgtttgattagacacttggggttggtgtttgtcttgatgagtgattcttgctgctcctgcttgatggcaggatttggttattctacttttagggttttggggttcaggctacgaatatgataacatttgtgtacaaggacacttgctcgatcaggctgcagtagtggtgtcttgtgctcactataaaagcatccagcaagttcacctagatggtgatcagtttagtagatggcagtcaatagtgatcagtttcattagtgatgtgtcgagcaaattactcatcagttagctggaccaattctgtaccacattagaggaagcttatgcttgctcagtagcaaagaaactacaaagcaacctagctcattaactcacaattctgtccagctcttgattttgcagtattgggcatgagctgaactgattattttggaaattccttttgtgaagctgaacttagtgttttcaggccagatcgatgcatggtaaactgtttttagtacagtaggtcgtaatatttttttgtaataactcataaatgtattaattaatcaggtttgcttttacggttttgtaacaaattaaagattgtgaacggtgctccaggtttctttagaacaacacacttccaatagtattatccaaaaacaacttcttgacacggtgaacactactccaggcctctgcacatattgagaatgtgatatcaccatgatgttcaccttgccactaattcatactcatgaacaagcccatctactcggatcgatgttggactaccttcaattagcctcatgtctccagaatatgaagaaccagcgaagggatcaacaagatactaagttccttacatacatatatataaggttcaatagaaacacaaaaggagaggtgcaagtcgatctattatgaccagaagaaagagtacagttgtttgtatttcattttcttcttccaagccgatgtgctctgcatggagcttacagttgggaagagaactcaactagctcattgcattcttcttcatcaaggataaaattaattggattggatgcacaaaagtagtttgcagctagcttcctctaccaatggaaggtcatccatgcatgtcctcttggatcaacaggaacagggatcaaggatgaactcgtggttcacaaacatattgaagcagagatacctttgcataccttcgtatatagtaatactaattactatctccatttcatattataagtcattttgatttttttctaagaaaaatatagcaatatttttaacataaaacaaaggaactatcaaaaatatattcaatattagatttaataaaactaagttagtgctataattattactatatttttctataatattggtcaaattttcaagaagtttgaccttacaaaagtgaaagagaattataacatgaaacggaggaagtactaataaaatatccgttagaaaaagagtttaggggtacaaatgaatgtatcatgctcaccagatcttgtgaacgtgagggtaggtgctaacatcaaaatttggtaagccccgaagtcatcatcggtctagagtcagtatcggctttagagtcctggaatcggccgatgggaattatcaagtcttcaatagttggattctaagtagaatcgattaaagaaattatatattaaatgaagtttatccaaaagtgaccgagtttaaaggaggatgcggcatggcagtttatctattaattaggaagagtctattagtttccttttatctttaggaaaatgtgtttagtgtctgataaagactttatgttttccttttatctttaggaaagtttctttcttgtccaagaaggactaatatctacctatgggtataaatatgtacaccaagggtcattgtaaactatctcacgatcaatacaatttcggcgcatcgccaccttttacctttctactttttcgatgagttcttacttcgaattagggtatcgatttcgatcttctgacaagaggtatgaattgtctcagcggtttgcgctggcggattagggcatcgctttaaatgttctaatctatcttctacagccgctggttatcatatatcctagttaatctagcttagcatcttaatttgatcagatcacctgagattcgttttagggtttatgtcggtatcggctaaattatcttgctagattagattaactaagatatccaccactcttaaaatttgtcaaaggcatgattgtttaggctttatgtttctttgcatactttgagttgcatcgaccttagtcgtgcttagaaccataaaaactaacctgcctttgattgccaataagggttccatcggggtttcagctgatgagttttctggacattgcatcggcttacaagaattgtatattaggtggttttagccgatcacaacaaaggtttcattgtttatctaatcttgtggattttatgacatcggacctccagccgatgtatgctttgatcttcatatcagtgtttattctatcatatcattgttagccgattggtttctacgagattatattattgctttattatattaccattagccgattgtctttatatcatcatctacattggacatatagctgattgctcaaaaccctatcggcatcggctcactggtgatcttcaatttatatatcttgtcagttgcaagatcaaacagactggcacgtccacatctcatcaatttttggacctacattagagctaagcagatctcccaggccgttgtgttcatcgacttagttcgcgccaacacagacccgacaccatcggccgagcgcggattttccgtcagcagtaggttatgggggtgaaaattttctacattgtccgtacattgtaacgggtcagacctatataattagagataggataggagggtaattgagtattgcacacggtggtaggagcagatggaagggatgttgaacagtccatgaggacctaagctccagagtgggatgggcagcagctgtgccctaaccgcagaggcggaaggcaactgtgccccaagctcggaagtatatgcgccccaagcccggaagtaggcagcggtattgccatgagctcgggttctagcccgctgccatatgaagtggcccaggctcaccttcgttgcatactgatcgatcagatgacgagttggtaggcccccgagcatctgatagaggggctctggttaccactttaccaacataatatatttggatggtttatagtaagtttagagcagataacgtgaaagagagagaaaaagagctgagccagaaagagagagtgtgcattggaaattagcaaacgaaatggaaaaatcactactacaaaatgggtttttgctgacagtcagaataagttttttacaagcagttaggctagccgtcagcgaccataggccagaaaaaatacacaatcttcataggcgggcatacaaccgctagcgaaaatttattttcattgacggctaggttaagccgaccaccagtgaaaatgattttccccgacagagctaggttaagtcaaccgcctgcgaaaatcatttttgcctttaaaaaaagaaaaaaaaaacccttgcatgcaactcgcttctgactgccaacaaagattattttaggcaaacgaaaaataaaaaacccacatgcaattgcattcacaatttccacatcaaaccacaaatcaagcaaatatgggaagaacaattcatcacaatttcatcccaggtgtacaagaaatccattcacaatttcatagctactctaagatttagcaatcagtctgttctcatcgctgtttcttacaaaaattgtgaacagagaagtacaagcaaatatgcagcgattatttgtaagaaaacattcacaatttcatccaagatttagcaatacacaagaaagatgagagagaagaggtcactggtgcattcaccgatccacggttgttgccatcaccgagacacgtgcgaacatcggcaccaaagtcggcgagctccgtggatttgagagaggagggttggcaccgctggagcttgaggcctcaccatccccctccaccaccgttgggggcggagtgcactcattggagctctgacccggcgggaggttgggctcgtcggctagcgacacctccacaatgagccctttattcaacgccatggccgcaagagcaccgtcgaccctccccttcacagcggctggaccaggcggcgaatctgccgctcctgagatcgccggtattggatccgccgttgtcaagctcgatggcgacggatccgccactcttaagaccgccagtggcggatccgcccttttcgagcctgccggtggtggatccgctcctcctgatctcattgcagccgtagccgtcgccgtcgcccccacaatcgttttggccatcgccgccgccatgtacgccgtcgtcgccaaggacgagggagagggggggggggagggagggaggaatatggcagggagaggagggagggaggacttatcggtggggaaggagagttagatgcggtggagatcgagcttttcttttaatatgatggtcctctttagcaaccagcagcgaaaatcgatttttgctggtggtcgtttaggtgagccaccagtgaaaagggatacattttcattggcggcgctcttaaccacgttgttagcagagatccattttcgctggcggcccataacccctcatccctcgttacattgttgccgatggttttgatgtatggccgtcagagaaaatgatagggtgacgccatgaaaaatcgatttggtagtagtgaattagacaaagttataagctcatgttaattataaactaggactggtgcataggaaaataatccataataatttttttaatccaattccttttcttcaaattatatatgtgtgtgaaattttttcaaggattcaatactccaaagatcctatgaatttccttcaatccaaagatatgaattgagtttctaaataggataataaaggttggtataggtattctttcggaacagagatatatacaactagtaactcccatatgtgcaatacgatatcaaccatgattgattcgtctgatcaatttacagttagacttgaaattttcatctgaaattggagagagaaaatgtagatgtgatttacagatcaaataaattttggcaaccaatcaagctttagtttatcttttgaacatttcaatcattgcacagtctcctaagtcctaccagaattcatataagaaaaggctggattaccaaataagagctgcttcaatagagatttctttagacattagctagttactagctagttagcgtagtagaatcaaaattatatacttatccggacataagagaatgtcattttagaatatgcatacgctctaagcgcaagttattttttattatattattgtttaggctatatgttttggacctctatagccaagtatattataactagtgcttaatttaatgatgttactgttgtgtaattgtttttgcatttacggggaagacttaaattgtcaaaatcatgtgtctgtttgactataacatgcctaaatcgacattcttttgggtgacggaaaaggaccactagtgaagaaattgccggtttcaaaccactcatcaataccggttttagaggcagcaccattatagcggaactaattatgagggtagtcactaacgttggttctaaaaccgatactgatgacacccttattgatgctaattctgattaaaacgaacacctctaatgggtgctcccggtttttatttctacaaatgcggaaaaaattataaaaaatattttgcatttaactaggtttctatctacgcacggtcgcaaattgattctcacaattcacaagattttttcacgcaatattcacacacaagagattcacaaaatctaaacccaggacatctctcaatttccaaagccttcttaccatctcacctatcaaacacacacgtcgtcttgtaagcaaatcgacactactactaaatgaaagttatagtacatatttatcaccatagataagctcaaatgaaaatatttttcaaccaaactcgtatagattttatctctgtccgagattgcttagaaatttccaaaatccgcttgttcaaatagaactgagaagtgagaacttaacacattttgtgatatctaaacgatcttaaatgaaaaagtcaactacaaagtttagatcttgtagaaggacctgtttgtgcggaaaaacctcttataggtgttaattttaagtgaactgcaacctataaagacattacggacgtggtgttctgtactaatgtaccattctgatgtgatataagaacacccaaattcttcaatcaagtgatctatggttcttcaggttcttgtgtagctggtttcctagcattagaaattcttcgagttagagctactggtcaattaaggttatcaaggtaggacgatttatacatttgtagtccaaaataagacaatagttaatagatttaaatatatacaaactatatttcatattttccataagacttatggaaatggagctatatatgccaaaccatcctaaatatagctagcttgcaaattaatttcaccatggactctataaatgcctgcaactacaaataatttactccctctgtttcagattatataaaaaaactgtgtagtaacatttttaacccaggacaaatatattatgaaaatatatttaatgatagatttaatgcaactaatttggtgttataaatattaactatctttgtcaacaaatttaggcccagtttagatcccacctcaaaattttttaccttgtcacatcgaacatttaaacacctgcatgaagtattaaatataggctaacaaaataactaattgtacagattgcgactaatttccgagatgaatcttttaagcctaattactccatgatttgataatgtggtgctacagtaaacatttgctaatgacggattaattaggcttaataaattcgtctcgcagtttacaggcggattttgtaatttgttttgttattagactatgtttaatatttcaaatgtgtgtccgtatatctgatgtgacacggcaaaaattttcacccttggatctaaacacacttagttaaacttgaagtagtttgactttgaccaaaatcaaaatgacttataatctgaaatagagggagtaattaccgcagcatcttcacttctctaacaagttctacctcttttaataaaagaccttattttcagactaaagcaattgttaaaaaaaacagtgtaattatctttagacgtgtggttcattgatactcatgcttgttttctctcttgtggttagagaccatccccgccttcaatcgttatgtgcaaatgccattaattttagtttaggcatgtcaaaagtctaatcaagtatacaagcctagaaaaaacttagtactctctccattccaaaatacttatcaatcattctaaatgtttagcataaattaagattcaagaaagaaaaactagtatccttcattaaatgatgtacggtgtgatagttggagggtattatagggaaaaaaattgaatgaacgatgatgaattgggcaagtagaacttaagagtgataaatactttaggataaattttaaattataaaaagataactattttgaaatggaggttatagtcattatgagagacatacatcttcattctcatccatactaagattgtgttcttttcctaacttttcctacatttgcttaatggtttttgcacacacgcttcctaaactgctgaacggtgtgtttttactaaagttttatatagaaaaattagaaaaattactttaaggaatcatattaaccattttctaaattttttatgctaatacttaattaattacacctaattgataacaccgtttttcgtgcgtggacttggaacgcaggctgatatgtgtcaatgacaggttaaaaataagatctctttacgacagaggcgttagataattctgtagctctgttgtcttgaagtatattcttgagacttgagagagagagagcatgcacgtacgtacaatataagtatacatacacatggataaacgagcaacatatacgtacgtgtgtcgaacttaatatatatatacccctatttactagctagatgtgcattattgatggctctaggtctcgctagctccaacaacacgatcggaccccaggtaagtgcttgcctcgagatctgcgctaatgaatgtgcctacaacggaattagggcctgatcaaccaataattaagagcttaataatataattatgtggatgaatataccaagaccgcaggttagcatggacttgctccgtttctcaaatgattgttgtcgttgatcgattttttacgtcagttcaaactcggtaagcttaattttactaaataactgaagtgactgtttatagcaacgaattttccaaaataacagtcgttcttacacggtgaattacctacacttacattatacgctgcaaatttcagaacttacattgtaattactcctctgaaacattgtaagttttgaatattcacatggtaatttttctaatacataatgtatatgagtattattatcaatttgaaaaaggagatagaagagatggaattagcacacttgtttacacatagaagatagagcaatcacatagagaaaaaaaggcgattgaaattaaaattaaagaaatgttgttgcgattgaaattttgttgctagaaaggtgtattattaattaattagtagatttttataaatattttttgacatgttgccttcacaatcttttacaaacatatatattaggatttttactttattatattctctcttcatctttcagaaaatttgaacaaaagtttgaaatttaaaaattctatcgatgcgtatgaatgcaattagttagctaggaaatcgtttggccagcgaggacaatgtgtaaggacatggaatggcagagatcgataagagaggagcaaagaaatcattgatttgaccaattttgacccaagttctccagtggagtcacttaatacagacccacttgtaaattaattcgaaattacacggaggagagtaccatgctcaagaaaggttagtagtagttactccacgggctaaaaaaaaaggttgctactactccctccgtctaattttgatagttatatttctaaatctgaaaaaatatttttgatagtcatatttcaattcaacaacctatcatcttaatgactttctcagatttaatacataactattcattcttccatacacgattgactacatgggcatcggaaaatgtaaatattaatgaatcgcttgtttacgagaaatgactagtagcatatttaaatagatgataagtagaattacttatcattagtctgtgtgccaagatgaaatatgagtatcaaaagtagatggagggattggttaattaatactccctccgtcccattttgagtgcaattgtaagttttccgtatccaatatttgacaacccatcttatttgaaaaaattataaaatttctttaagaaaataagtcatgcatagaatactattcatgttttattatctattaataataaaaatactaatcatattttttaaaaaaagaacggataatcaaatattgaacatgaaaatttataactacacttaaaataaaaagggagagaaaatgaaaagggaaggagtaactatacttatattggtactacacaattgtatatatgattctagctgggcgacctctcgtacagttgtaccggccatcgtctagatttgcacatgtgagaggtcggtgtatgcatcgtgggttgcggccgatggaagcttcagatgatcgttggcgccagcccacgtgaggttctgaattcgggagccggcctagctacctaccacccttctcccgccagccattgccgaggagattgagcacgtggcagctagctttgcatcctgcatactaggtgttagcatccataagtagggcattaaagaaaaggcactaaagaagagagaagaataaagggccgagggacctagttattaagacccgaccgggaaaaaccggaaccacagcccttgccggtccggtccaggtaaaagaccggcatgcaattgacccctccccccggccatgaaccggttagagtacgtgggatggggtccggtccagataaaagaccagcatgcaattgacccgcccccccctcctcggaaatcgcaacaacattttttatcaacattggaatttctatttttcttgtccgttttcacttttttctatctttcttgtcctattggaattttttttgtccgtttccaactttttttttgtctgtttactctttgtttgttttgtccgtttacacaaaacctaatcgtaatacccttctatttttctttttttcttatttttttcgattaacatgggattttctagaccgtgagagcgaatatggagacttctttttcttttactctatagatataatagatgtcacctccaatattatgttgttttttttaatggagggagtagagaagaaatatacttaagccttcgtatcgctgctcttctgtatagactaaacacaagacatatatgatagaaggcattgcacattagaggatgcagatcacagttgtgtgctttgctccacatgggaagaaagagaaactttgagatacatgttcttcatatatctttttagtggagcttgctagaagagaattggcataagttgaaattgcaatctggattttttttttcatatgatagttcttgctaagatcagattcagaaacaaagggttcttcaagattatattcatagcatattggcacctttggaagcaaagaaatggtttcattttttttcaaaatattaatccaaaagaaggatagttggtttagaagttttaagcgagagattcttccatatctctacataatgaatgaatctgttctttcaatggtttctatcagggtacgacatttgtaatcttggagttggaccttttgtagttgttttctttttatcctaatctaaaatcaactactggacacaaggcctgatagtattttcccttaagaaaagaaatgtactcaagccaaacactgggtagcaagggcatatagagacggcaccttcgaaggctataggtcggtatatcgtgagattattggctaagtcaccgtatgtaccttgttgtcgacaaaaatatttcctaccactgaaataataacagccaatatatctcaattccaataacgttgtgttagcaagtacaaccgattaccattagagtttgtctacacgggcggagctaaccccattcgtcgaaatttctaaattaaaacattgtttagatctgtagatcactgtgctgtacaatggagctaacccgccgggtgtcatttttggcttgcttcgcctttgtaaatgttatattttcttaaagtttattttaatttccgtctttttaatgcaattgcaaaattgtacactttatattctagaaaatctaaaaatatgctaaacatattaaaataattacattcggatggaaattaataacaaaacacaggtttgatggatgctgaacattactaaactataatacttgaagttattttaattgtatttatatttgacatgctagcatgaattttattgggacggaaaaggggttgaatatcttgggacatggcaacaaatattatatataggagactaggaactctttgtctagaaaaaggacttttttgtcaaagctttgtaatagtttttatatggccattaggacatatagaaactactagcaattaaaactaccatttgattttttttagataatggaactaccatttgatgaaacttgctgactaagatttacttagaaaaaacaaagattttagacagcaagagttgtttaattaattgtattattgttagagctagcttgacttgttagctagatcgaggtacgttgacacatgtgatgaactaaagctagcccaagtggcacaattgcacaagaactgatctgatccactgagatacctaatcagttacgtgtttgcccagaaggagccaaaggaggacgacagtacattaagcaagtcatatgtggactaccgatgacaattatagaggcagaagcaccaattcatgttggaagctttactaccacgtttatgaaataataatgagcaccaatttaccaataggagggagtgagattaattaattaacctgcataattggagcaatcaaaaggaaaacacatgggcaaatggttcacctcgcaactacatagtttcctttttccagaaatgttatggaatggaagttgtctattgtgaaggaccacatgaaaacactatttcggatgggaattattgcattagccatcgtaaagtaaactttgttaggatcatgcatgtagatgttttgttcacctcatcagacttaaaatcatttctctataaattttataagtctaggcatttttaatcaataaaggaaaaatgatttccacatacgggtgtcataacaatcgcctgtagaaacaaattaatcaacaaaggtggctagatatgaagacgtaccgcccatatgtaaatattagtgcagttggtcttcaaagcaaaatagctcaggtagattgttaggacgactgcccatgtaaatgtctgtttatatatttgggccttcacgaaaaaaaggtatatatgtcctagagaaccccaaaccaatgccgtcatgttgctgaaattcctaatccgtcaacactcaacaggcatgagctcgaccacgaccacactccgaagacactgccaccgcaacctccttctcgacacagccatccactccactgccgccagcctgctcattatccctaacacgccggcaatccagaggtcaacccggccaccgccgcacctcctagatgccgccaccgccggtagcgacctggtcttccttccaaacgtgtcggtgataccgagttcgtccctgacaacgccgctagccacctccaccttccttaatcctgatacactgtctccgacggttagtgtgaattgttaaaataaatgaatatagtttaaatgtgaaattaaaatgatacttagaatatatgtatgtgatttaaaataagtgtatatatatagtttagaatgtaatgataagaccaatgtggtaaaaggaaactgaataaccgttgcgatttaggtactctaaggaggataacaataatagttttgagccctacactgaagaggagactacaactagagatttacattccacaaccgacataacagggtgtccacgtagaatatccgaacaacttctacaccaaattggggcaactagaacatgctcccgaaaaaaaaatgttaaaggccaatccatctacacatttggttcccacttcaagtaaagggggtgtgtgggggggggtgtggaatggatggatcacaacatgtgtccaaaaatcgtcggaggaaggataagtgtgacattatagtggcactcaactgcaggaaagaaccataagacctatgatatcatcatccgatgagagtgggggtgaaaccaattgagtacaacttgccgagccatgtcccatgcccgcagccaccctgatatggggagaacgacattgattttgaccctgccaaggaagtatatattaacatgatacgttgcattttacatttcattttccattgtctatttctttataacaactatcaatgttttataggtctggatcgatggaagataaacttgtcgaaagtcgaggcaagaaaattccctcccttagctacccaacccaagggtgcctcaacggagaataggattcttgtaatccgaattttgggagaaaaaactctcgtgtctccccttgtgtgcaatttgtgtttcacctgtgatttacctttcttagctattcattactttctttaagcttctttaagtattgggaatccttgagaaccaatatttgtgtctcaaaaagaaagaaccccaaaagtttcacaaaagaacaccgaaagttccgggcagccctctcagtcttttgtcgcgagctgccaggaaatttcggggcctgtcatctaactgtgtcaattgaagaaaacttcaggaaagcctattcacaccccccctccctctaggctacaccttgggctttcatagagtttgctcaaaagaatgccatggaggaagccaagaaattgagcgaggcgaaaaaccaactccccaagagaaattagttcccccgtcgcttgggatctagtaagtaagatggggaagccgatgaatggaggaggaaaaaaataggatgaaaggatcgggagacagttaacatcaaaatttggtatggttctttagtagattcggctaaggaaagaaaccgattggttgatggaaatttgtgtagataaagctgaattcaaggaggaaccgtgaagacaatggcaaggcggattcatattttttagtatatttcttaaataggcatgattagttatttccttgtgagtacaacatttgtgagttctcttaggttggatgggaggtatatagtgaaccccaactagttaagtcaatatttataattgaacaaatagtgtggttcttaattatattgatttttaatgttctaactcttttagttattgttttattacaacggcccacacaaccaacctctttcaaacttaatggaacacatattgctaatatacaaagtttgatgttgctagattatccaccgatagctattatacacaatgctgccacgggactgatagctatttttcttgaatgaaacacagcaggggaagcccccactgttaatatattaaaaagaataaaaagaatttacaacagcagaatccaattcttaactacatcttgatctctctcatttaatctaaaaagcaacaacagataatccctcttaaggagatttttccaagaagaaaaggaaaacttcttattataaaaaatgaaactattctttgcttccatatattccaggctgcaagaaggagtttctcaaagaaacaatatccagaataattagctttagccaccactaacatgttatccagtttcagattggtatcccaggaaatacccaaagagttccaacaaacagtagagaagggacagaggaaaaacaaatggagcatggtctcagtgcattgctgctgacaaagcatacagtacagatcacaattagggggggcacaatgcttatgatccaacagaaacttagtattcagcctgtccataagcataagccatccaaaaactttaaccttagatgtgaatttgcttttccaaagccaaacaaagtgttgtggtgacttcaaagctctgaaattgaaagcataaaatttctgcgatgtaaattt

SEQ ID NO: 46853 - DNA, 7140 bp, Oryza sativa
  unsure (1)..(7140): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgagctcttctcgtatgggttgttttcgatctggtgcaaatctccgcagtttttgctttactggcttggcatcgggtcgcaccatgagtttgtgctcaatcacctccctgggtacccccggcatgtcggacggctgccaagcgaacacgtcagcattgtcgcggaggaaggtgatgagcgcgacttcctatttctcgcctagtgatgccccgatcttgatggtcttgtcggggttggcattggagagtggaatgatcttgattgcgccgtctggtttcggcgtcttgtttgtcttgctcactttcttgggtggctctgctgtggcaggcaggctgggcatgtgctcgaccatgtcgaggctccgcttgtcgcattgtactgccagcttagcgttcccttgaatagtgattgttcccttcagtcctggcatcttgaacacttgatacgcatagtgagatgcggccatgaacttcgcgagtgcagttctcccaatgatggcccacctgtcagggccgtcgtctacctcccgccgtagccgcgcccaagagcgcgcaagccgtcgccgcccccttccaaaattccgtcgaccctttaacgatccgatcaaatcaatggaggggaaatgatcctcgagatctcctcttccttttctcttttggaatcttcggctaattttgtttggaaaccggtggatttgatctcgattcggattcgtttttccctcctaaccctaaaccttccttctcgccgccggccgccgtgggcctccatcgccgccccctagcccctataaaaggccacctttgccttagcttgccgccgcttgtagcgccgcctccgtgttagcccgtgcgccgccgtcgccgccgcgagtccagccgtgcgccgccaccgctccggtcgtcgtcgtccctcgggaaggccgccgtcgggatcgccaagtcgtcaccgtcctcgtcccgtcctttgtttctgtcgaagaccgccggagcatcgccgtcatcgtcgacccgaacgtctctgccgcttcgacctcgccgccgtcgccgtccgttgtcgtccgccgtcgtccgagccctcggtgagttcgccgcgtcgccctctacgcgtaggtgccctccgtttgcgtcgccgcgccatcattcgctggctagcacgaggtgccgagccgccgccggtgatgacgtcatcgtcgacatcagcgccacgtcagccgtagacccgtggtggattagatcgatctcggccgttcgtttggattagattagatcctagccgttcgatccgtagaccgtttccgtgcactcggtccaccgtgaacccgagcccgctgacacaataaatcctttttcctttcaaatataattctttattgcgtcataatccaattaaaatctaaataaataatttaatccagtttaatctttaaaaattcattactaattcatcttagctcagatttagttggttcaagtctctaaatttttctaaaattgagatctacatgttaaaaatatccacatgtgctgtttatgattgtttatgtactgttttggtgattttggtcttttctgcttagattccgacgttcccggagagtccgattttgcaggagaagactttgaggagttccaaggccagcaaggcaagtcacacaaatcccaaacaatcctttgagcatgttgatcccgtttaaagctattgtttctattcaactattgcatttatttttgaatgtcattgggtgggaataacctattgcctttgttatagccttttgttattgattacctatactttgtcccctggttaataatttgattagctagaacattatatggttttagctgaagtaattaggatgcttagccatgcttagagacactagctcatatgaatggcataattaatgattcactattacttaatgatggcttaatggtagctcatgatggttaatcatgataggttgattaattaagatgccaattaaaatatgataatggtgggttgtgagcacatggttttgatggttgtgctcatgacaattaaggaccggttcacgattttcggttgtgaaacattaaccgtgccaaccacaagccagcgtgggcaacggctttaccttttgtatagtgtggttcattgtagagcaccagactgtgaagtggcggagataagcccacgggggtcgctggggagtccatgccttgtttataatgggggtgattatgatccaggaacggtgcactgctttgaattatgttatgcgaagggtattgtcacaatctctattcaggtacttgttaagtattgcgacgcatggttgacatgatgttgaggttgtgtcttgtgggtacagtggtacacctctagccagagtaaaactattcgaatagccgtgcccgcggttatgggcgggtctaacaatgtcttttgtgattagtctcatacctctcaccataataaatgatgctgtaattgttaataacttgtttagctcctggtttggaatggtatattcctggtttggagatagaactgtgcagccgggaatggttgttcagaatggttgggcctatgcaacgggtatgttgtatagcgttggattaatattgtttaattaaatactttactgtttttctaaattctgaagtatttattgaatgccatttatgcaaatgagactatattatgccatcctttgttatcccctgcatttgcatatttgctgcgtggcttgttgagtatgtcatatactcaccttgcaatcattcatcagaggaggagttctacagtgatgctgatggtgtggaggattaggcgtagccctggtcaagctgcttgtgggatggagtcgcctgcgctgtttattttattttccgctgcttagaccttatttgtttgagaggaactatctacctctgtaatgactttatattcgcttattaattagagtaataattgtactctattatcaatttgttattttgtgcctcggctgattcctggacgagggtttatacacatgtaagcgtttggaattttggatagaaattccgggcgtgacagccccctgccacgtcgaacagactttacgttccactttcttgtattctcgctttgaggagtatgccgtggaacctccaaagatgtgtgagacatggagatcggaatctgggtatgctgagtccgattcctgagtaggcgcgtcagcgtccttctcaaccacgcgtactcgcttgtctttttccgatgccatgtgttttgcgagcgactttttgaagacgaggcaatcatcaagagaatgtctgtccgtcttgtgtatagggcaccatgctttcttcatgtcgctgccttgtgggtctgggcgctagggagggtccacgtattctgttgcgagaacttctgattgagctttccttttcccactcttgcgatttttctttttgcttgactcaggtgcgtccttggctggtttcttctctcctccggtcttcggtttgtcgttcttgcgtttcagtgcgtcatccacatgagcgcatcggtcgacaatttcgaataatctccgagtagtcgtgatgcgcctcgttgccaactcctgagtagtatagcgatctctgacaccggatttgaaagcgcgaattacagaagcatcggtgatctcggggattgtgtttctgcactcgttaaagcgcggaacataatccctcaaggattcgcccgggttctatgtcaacgcatgtaggtcgtcttcgatcgcgtggcgcttgtaagttccttggaagttggctacgaactgctgccataagtttgcccacgaagagatcgagtaggggggaagaagcattagccatgaacgtgcagagcctttcaatgcggttggcaagtaattcaccaacgcgttgtcatccgctccggcaacgtagagtaccgtggagtaaacctgaaggaactcttccgactcggtgctcccatcgtatttctctattgctccaagtcggaatctttcgggccatcggacatcctgaagtgaacgaccgaaagctctacacccagcgctgggggcggtgggttgtcggcgatcatgcgtccttcgtggatgtctatccgatgatgaagatgacgaggatgatgacgatgacgatgggtcgcttggttccggcatacgattacggggacgtcggctgggttctcgagaatcctgtcgtcgtctcccgctgttgtctcggcgccgatctccatcatcgtcgtcattattgcgacgtcctcgactagtatcgcccaacacccgccgttcacgatcgtcgtgatcgtggcggttgtggcggttatcacggtctcggtcttcgcttgaacggcctcctcgatcttcgttatcgtgacgccgtgaagagatatgacgccgggaatggttctcgttgtcttgtgtgtgtcgtgcctctcggcggccattcaggtgatcgcggagatcactggtgccgcgaggtggaggggtcgctcgatgaggtgattcccgccgttcagggtcttcaccatttgcatcgccagttggtggctgttccgggtgcgctgcagcagcggcctcttcgaacgcgttgctgaggttggtcactgattcccgtagtcattctgtccaatgtgtgagatcgtcattgagaatgggatcgtagggggtttccctcagtattgcgttgacggctctgatgtgctgggtcggagtagtcacttgattctccgctttcgctttggtgcgcgctgacgtgccgacatcgtcgatagacaatacctcacgcggcgtactcgtcgatgatccatagtcttcgagtaggtgcaagactgatggttcatggggatcgatgtcgattaccccaacaaatcgatctgaaattggcgtcgctccttgttccttgtcctcatccctgatggggatgcgtgactgctggaccttaggaggtggcgtcttcatggcgctgagaaagaccttgcagctcgagaggtcgtgattctttgtcttgtgaataggacaatagacatcacgagttggagaggtacgctgaattccacgctctttgcaggcacgaatttcagaatggacgttgagaaagacccagcaggcttgcagggtatgtttcctggttttgtggataggacaccaagactttgtcacctcagaagtaatcctcgtcggctcgtgattcctgtcagaaagacaaggcttggccgcactaggatccttctcgggttcggatgtcgtcgacgttccgatctccgctttggcgggaggaaccttcaacatggagtcaccccgggttgtagccgctgcgttctcgtttccggccattggcggaccagctgagatcggcattgtggtgtaaaccagaaagacgatttcgtcgacttgagtccacaccagtgttgttgaagttggaactccttggttgaggttggtgttgacgctgttgtcgacgaagctggatgtcatagtagtagaaccttgagcgccaagtccccctacctggcgcgccactgtcgacgggggatacccgtagaccggatatagagggtattggggtacgctggtatgaggatctacgtagtacgacatcaagcaaacaggaaacagggattatactggttcaggccccttggtaggtaatagccctaatccagttgatatgggattatatgatggaaaccacagattacaaagggaatagtgaagctcgacgataccgacaagatcgtagtcgagttgatccgactagatctcccggcgacttggcttcgataagctctagcttcgtaggttgtggtggatgtgttggctctgaaattcgatgccttaggtctacccgggtggtcccttttataccgtaggtcaactggtctccaagtaggactcggagacatcggacccgacacgatataatgacgacccagttctatctgagtaggactctttccatctgtagactccatgatggacttccttaacctatgctgagaatgtccgtatacgcgcaaacataccatatcgatacgtgacgtatatcgaagggtagagggtataccttacccgtaaccctgacagtattcttgtctgttggaatagctctgtcgttactgcttctcagattgaaatttagagttttgctgttaaaatttgcttttcctctagtcattctgggttatcctggactttactgtcggtgtatggaccctgtgctggtgttgaaagagaaaattttgtaatctggctccatagcttgcaaattgcagatgatgacatttggcttctccttggagatttcaatttttataggtcagtgttgaatagaaataggccagggtaagatatgaatgatatttttctttttaatgatgtcattagcgacctgggtctagttgaattatctattaagggcagggcctatacttagagcaacatgcagcaacagcctttgttagagcaacttgattggttctttacttcaactagttggactatcactttcctaaacactttggttaagcctcttgttagatcaatttcggaccataccccccctgtgtggtttagataggttccaatatcccaagagccaatattttcagatttgaaaacttttggattgagcatgaggatttttttgatcttgtccattctatatggtctaatcatggtgttctggcggattcggctaggaatatctctgcaaagctcaatgctttgaggaatggtcttaagaagtggagtaagaatctgtctaacttgcagaagcttatagcaaactgtaatgctatcattctctttctggatagtatagaggagcttagggatctgtcccttcttgagtggaatttcag

SEQ ID NO: 46854 - DNA, 2457 bp, Oryza sativa
  unsure (1)..(2457): unsure at all n locations
acaagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaacggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcatagagggaaagtcgatttatggatggaatcaaatacgcagtatttacaaaaaaaagtcttcgtttattgggaaagaatcaatatacttttaatgtcgaatcgggattcactaagacagaaataaagcattgggtcgaaacttcttntnncttnttnntngnngggnttggnttnntaanaaaggggntttaangntttaaaggncctttgggtttggnaaaaaaattaanggnnccnnccaatttcccgggnaaaccccttttttcccgaagggagaaaatggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttatggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaa

SEQ ID NO: 46855 - DNA, 5804 bp, Oryza sativa
aaatagaaaaggtcaatatgaaggaggagaaagaagcaatagtgacgtggtccggggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaataggtaagcggggaataaccttatttatgacaagtttcaaactggtaaagtatacccctaggataaagaagaagaagagtgggctaaggaaactcgcaagaaaagtaccaaccgatcgtctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggcagcagcaaatgctactcattatagggatttcgacaaagcaaatttattcatcactaaagccgaagtcagtaggagtactattatgaataaattcagacctcgggctcgaggacgtagttctcccataaaaaaaaccatgtgtcatataacaattgtactaaatatagtaaagaaatcgaaataatctttagatccatctaagatttgattcccggtaaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgtagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgaatgcatcaaaaaaggtagacttcccctccaaacaattcgcgctaaaattgattattgctgctatccaattcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaaattctacctctttctataagatttaatgaaaattgagaaatcttttaataaaattgctatgcttagtgtgtgactcgttagttttttttagggttcaaaaaggggattaaaaaaaaatagaatgaaccctactatgtaattatagaaaatgaactaataaccaacctattgcttcgtattgtcgagatcctaactaagaaacagtcactatatgaataaatacatctatcataaatgagtaaatctatcatatacgtgtagcaactgcaattttttctttaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattcgaaatcgtaatttgattgaaacaagaaatacaaatttcaaggaataacaaagagcgtcccgagttaataaaactgagaaattgactcggaaagaaattttttggaagctccattgcgagattcaaacctaaccattaaaggagaagcagtgggaacgacagaacctatgactggataggattttcttgaaaagaatcccaatacttcattgggtgggatggcggaacaaaccaaaaaaattgtcttatttgataaggttatgaattaacaaataagacaggaaagagtaaatattcgcccgcgaaatttttattgaattagaatactttaccgcgattcaataagagtaaaataaaaaaaggagattaaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccatcgactataaccccaaaagaaccagatttcgtaaacaacataggggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacgtatgggttcgggaaagggatcccccgaatattgggtagccgttgttaaaccaggtcgaatactttatgaaatgggcggagtatccgaaactgtagctagagtagctatttccatagctgccagcaaaatgcccatacgaagtcaatttcttcggttagaaatataacccccccaaaaaaagtagtattgaaaataaaaaaccaggttcttctttctggaaagacaatatttctttcatccttttgcattgaaataacaaattgaaatcaaaataatatgattcaacctcagacccttttaaatgtagcagataacagtggagctcgaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacatgttgattatagaaaaattaggaggaacctagaattagagtcttatgggcaaggacactattgctgatttactaacctctataagaaacgcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagtcttatgttatatatggtaatcgccccgcctatagcggtaatcgccccacctatagttatagtacccgaattctatcttgaacttcctatttttcaaacaaaaatacaacgtttttttatttgaaaataaaaaaagaaaaataggagaaaaaaaatatgacagaaaagaaaaataggagagaaaaaaaaacccgagagaagcaaaaattactttcgagggtttagttatggaagccctacccaacggaatgttccgcgttcgcctagagaatgataccatcatcctgggctatatttcaggaaagatccggtctagttctatacgaatactgatgggggatagggtcaaaattgaagtaagtcgttatgattcaagcaaggggcgtataatttatagacttccccataaggattcgaagcgtaccgaagactcgaaggataccgaagatttgaaggataccaaagattcaaagggttaggtttttctttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgactgattcgtaggctggacgaattagagtcatttgttccaatccgaagcataaacaaagacaggggtaatctttcgaaaaaagaacttgactttctaaaaagtaaaaaaaaaagtacccgcgaaaatgtccaaattccaaataaaaaaattcaagtaaaggatatattttaccctgaaacggatatctttgtatctttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctcaagaaaagcatcaccctatgctggtcaaagaacagctgtagatgctattcgtacagtgggtttgcaacgagcagaagttatggtaaagggtgctggtagtggaagagatgccgcattacgagccattgctaaaagtggtgtacgattaagttgtatacgcatgtaacacctatgccgcataatgggtgtcgacctcctaaaaaaagacgtctgtaaaagaattaaacccctttcaagagaaataaacgattcaatgatcaaataataatactagtctatatggttcgagaggaggtagcaggatccactcaaacactacagtggaagtgtgttgaatcaagagtagatagtaagcgtctttattatggtcgtttcattctgtccccgcttagaaaaggtcaagcggataccgttggtattgccttgcgaagagctttacttggagaaacagaaggaacatgtatcacacatgcaaaatttgggagcgtgccgcatgaatattctacaatagcaggtattgaagaatcggtacaagaaattttactaaatttcaaagaagggctgcaggaat

SEQ ID NO: 46856 - DNA, 9977 bp, Oryza sativa
gcatcaatttgcgtcaaaggtcctagatacataactgcccaagatattatcttaccgccttccgtagaaatcgttgatacggcacaacctatagctaacttgacagaacccacggatttccgtattgagttacggatcaagagagatcgcggatatcacacggaagtcagaaagaacactcaagatggaagttatcctatagatgctgtatccatgcctgttcgaaatgtgaattatagtatttttgcttgtgggaatggaaatgcaaaatatgagatactttttctagaaatatggaccaatggaagtttaacccctaaggaagcgctttatgaggcttctcgtaatttgattgatttatttcttccttttcttcacacggaggaagagggtactcgtttccaagaaaataaaaacaggtttacttccccccttttaagctttcaaaaaagattaactaatctaaaaaaaacaaaaaaagaattccattgaattgtatttttattgatcaattagaactgccttctagaacgtataattgtctcaaaagggccaatatccatacactattggaccttttgagtaagacggaagaagatctgatgagaattgacagttttcgtatgcaagatggaaaacagatatgggacactctagagaagcatctcccaatggatttacctaagaataagttctagttttaaatccattgcaattttttcctcttcttctttttcgagttagaataaaaagaaaaaagaaaacaattttgcatctttgggacaatctatattttcgcgaaatggatcataataaaatagattataggtatctagggaagattcacttggaagtaactatttcctagatacctatgcacggtacttcacgattgaatgaatcaaactgaaaaatccctaaaaaagacctaaagttaaggatttttcaatgggtaatgttgctccaatacctaaccaaagagctactgcagtaccgattaaaaaaacggttgtagctactgggcgacgaaatggattttggaatttattgacattctctagaaaaggtactgtcaataagcccgtcggcacagaaaccattaagagaatgcccaataacttattaggtactgtacggagtatttgaaacacgggaaagaagtaccactcgggtaatatttccagaggagttgcaaacggatccgccggttcaccaatcattgacggctcgagaaccgctaaacctacattacatgcaatagtacctagaattactactggaaaaatatataaagatcgttgggccacgcgggttccccgtaataattatgtcccatccctttagctaattttgctcttaatacaggatcgtttaagtcaggtttctttgttattgggataggtgaattctttaagatccagcccccaaaggaaccggacatgagaatttttcatcatccggctcgagcaagaatgaaagaaataaaaccgtagaagatccataatagaataaggtatataatggctcaatggctctaagtaagaaaagctttatcagattctattttccgaagttgcacctacaactattcattgaaaagaatcctactcttatgggtaaatgctcaatatccaagtgggcttacaaatttgatcatgatcaattgctttgtggattgtctcgcgtctcttgattagttggtatttatcccccccaatattgcaagtttcttacgtccaaacaaagtatttacttgttactaataaaaaatcaaaaagtttagcctacgttcttccttagatcccttcttttactccgatagtattgcagatcgcaatcgatgcaaagaaaatgaatgcatttccatactataataaaaagtaagtgtaataaatagagaattggatcatgtcacatgacttattccatttctactctatgggatcttacggagcctcttcatggatgacatggttgaggtatgatcatagaaaatattctcctcaagtgaaccagcctatccttactagacaggggacttacgtgttgattggatatggagacacctttggtcgtgaattctaatgtggcagatccaactctctatctgcatggccaaatcaataattcaagtcgcacactcccataatccgccttcttttctttcgtaaaattaacttcaactatttgtattatttgtatcacaatagttcggagttgaagagaagtatctaaatgacatgtcttattttagaataacccatgtttgtagcaatgaaataccacaacctacccgatatgatatatgagaattagaactctctatgagatgccttccttataaagggcccgaaataccttgcttacgtatcattagaaagtgcattaacataaatacggcagtaagcagaggaagtacaaaggtatgtaaactataaaaacgagtcaaagtggattgacccacactagcacttccacgtaataactccactaaaggtgatcctattaccggaatcgcgtcaggcacacctgtcacaattttgactgcccaataaccaatttgatcccaaggtaaagaataaccagttacaccaaacgatgcagttaatacagctaaaccacccagtgacccaagttaattcgcggggttttttaaacccacctgtgagatacacacgaaatacgtgcaggatcatcattagaaccatcatacttgctgaccatcgatgaactgatcggattaaccaaccaaagttggcctcggtcattatgtattgaaccgaggaaaaagcctctgtaacggttgggcgatagtaaaaagtcatagcaaaaccggtagcaacttgtactagaaaacaagtaagtgtaattccccctaaacaataaaatatgttgacatgaggaggaacatatttactagttatatcatctgcaattgcctgaatctcaagacgttcctcaaaccaatcatatactttattgagataggtaactaacccgaacccccctccgagaaccgtatatgagaatttcatctcgtacggctcaaacagaaacgcacaaattttcaacggatattagaaaaaaggttcaaaacttcatcagccactgggttgggtcgatttgccttgaagatatgaaataagaaaaatccataatttcttctttgtgatgataatgccaaaaaatctcaagttggctcgtctatctttctttcccaaatgttgatcattagaggcctcttgatttttctcttccctattttggatttcttttttttgtgcgtaatgcagatttactcttgttttactagataaataaataaagcaaaaattggagtagttttctggtagaaattatcttgttgcgatcctatgaatcagttcaattaaaaccttagattcatactagagccacgatgattgagtctcaagctaaacaaaaggcaagggttcttcgaataagaaccgcttgatgatcatttattgaatcggtgtaatgactcgacaaaatcgagagaaaaaaagttgttttttgggcaaacaaaattggaaggaagaaattttctttttttatttttattaagaactacttgaatttttttcagtctggttgcgaggtctgaatagttaatatgaatcatagtttcatttttttttcttgatccactctatctatttcgtgttacagatactagaataaataatatccgacgaattagaatcatcttgatagagataacaggtgctttctatgtattatcaataggagcaaattctaacaagtcacacactcatattccagagataccgaaaccaaaaaattccacggtcgaactaccagaatgtctagaaatgtagagcttaaagtagaaaggctcttttggatggaaaaactatgacttcgtagttttcgttagtagaaacctaattcattaaaattccgtccagtaaaacggaagaattataaatttctaaaataatagataggaataccgcgaataaagccattgcgacccccataaaaggagtagtcccccaacccggagctactttcccatattccgaattcaagggtttcaataaattacctacgcgagtttgtcttggtccaggtctagaactatcttcaacggtttgtgtagccataaattccatttaatgatttgtgttgactttgtatactattccgttgtagttgtaaatacacgatcttttcgtagatccattgtaatcttgaaattctataaaaatggaaacagcaactttagtcgccatctccatatctggtttacttgtaagctttactgggtatgccttatataccgcgtttgggcaaccctctcaacaattaagagatccattcgaagaacacggggactaattgaagtaagaagtctcccgatggggagacttcttacttcaattaaattatttcacttttttagtcggaaccttaggtggttctcggaagaagatagcaaaaaaaattatccctaaagtcgaaactaaaaggaacgtataaaccaatgcttccatagattcgatcgtggtttatttacaattataacttccacacctattcatttgtcatttgggatcatttcccgtataaaaaaggaaaaagagtcaaagaagggatgggagatgtttcccatgtcaaatcaaaaaagagaggtgaaagataccaaagcaatgcggcctcagactggctgtctcctcgtagttggatctccgactttttggaatgttccaaattccacttgagcatccaagtctggatcaataccagcaaaaacatctcggaacaaggttctagccccatgccaaatgtgtccgaaaaagaagagcaaagcaaaggtagcatgaccaaaagtgaaccaaccccttggactgctgcgaaaaacaccatctgatttcaaagtagcccgatctaattcaaaaatttcccctaattgggaacgcctcgcatatttttttacagtagcaggatcagaataacttactccattaagttcgccaccatagaactccaccgttacgcctacttgttcaacactatatttggattctgctcttctaaaaaggaacgtccactctcacaattccctcttcatctaccaaaacaaccggaaatgtttcaaaaaaagtaggcatacggcgtacaaaaagttcgcgcccttctttatctctaaagataggatgtcctaaccatccaacagctattccatccccattgtccattgagcctactctgaataatcccccctttgccggattattaccaatataatcataaaaggctaatttttcgggaattttagaccaagcttctgataaactgagattttcggctaacccatcactaactcttcgatatatttcttgctgaaagtatccctgatcccactgataacgagtaggcccaaacaattcaattggggtagttgctgacccataccacatagttccggcaactacgaaagctgcaaaaaaaacagcagcgatactactggaaagtacagtttcaatattgcccatacgtaatcctttgtatagacgttgaggtggacggacactaagatggaataggcccgctaatatgcccaatgtacccgcagcaatatgatgagaagctattccccccggaacaaaaggatcaaaaccttctgcaccccacgccggatttacagcttgtacttttccagttagtccataaggatcagacacccatatcccaggaccatacaaacccgttacatgaaatgcgccaaagccaaagcaagccacccctgcaagaaataaatgaattccaaagatcttgggcaaatccaaagaaggttttcccgtccgctcatcacagaatatttcgaggtcccaatatacccaatgccagatagctgccaagaaacacaagccagaaaacacaatatgcgcccctgccacgccttcataactccaaatacctggattcgttacagttcctcctgaaatactccaaccaccccacgaattggttattggttattcctaaacgagtcatgaaaggaatgacgaacataccttgtctccacattggatccagaacaggatcagagggatcaaaaactgctaattcgtataaagccatcgagccagcccaaccagaaactagagctgtgtgcattatatgcaccgaaagcaatcgacccggatcattcaatacgacagtatgaacacgataccaaggcaaacccatggaaatacccctttagcaaagaaaaatagacacgatgtcactttattttatcgcattggcaaagactatccatatcctatgtacctaacccttctaggggattctgtgtcagaaagcgtgaatatttatttcattccattaaaaataagaagccaattctgttcgtaagaagaaagagaagcagatctattctatactcgataagtgccaatatgcaatgggcagcttggcttatttggaaaaaacgaagaatagatccctatctctttttgtttagtattcgaatcacccattcttttttctttattcaatctgtcttatcctacttatatgtataatctttcaatctatgtattatttcaatctacgtattaatagaatctatagtattcatatagaataagaaaaaaagtgaaaacaataaactgcggattctttctttctcttccattcttacgtttccatattaaagtgtagttttcttacttaaatttaataatattaatctaatatgcccattggtgttccaaaagtaccttaccggattcccggagatgaagaagcgacttgggttgacttatacaatgttatgtatcgagaaaggacactttttttaggtcaagagattcgttgcgaggtcacgaatcatattacaggtctcatggtatatctcagtatagaagatggaattagcgatatttttttgtttataaactcccccggcgggtggttaatctcaggaatggcgatttgtgatacgatgcaaacggtgacaccagatatatatacaatatgcctcggaatagccgcgtccatggcgtccttcattctgcttggaggagaacccaccaagcgtatagcattcccccacgcgaggattatgcttcaccaacctgctagtgcttattatcgggcaagaacaccagaatttttactagaagtggaagagttacacaaagttcgcgaaatgatcacaagggtttatgcactaagaacaggcaagcctttttgggttgtatccgaagacatggaaagggatgtttttatgtcagcagacgaagccaaagcttatggacttgtcgatattgtaggggatgaaatgcttgacgagcactgcgatactgatccagtgtggtttccagaaatgtttaaggattggtagtggccagatttcttgtaaatttatttcaaccctaaattcgggttttatgcaatttaatggaaatacttcataatgatcaatcattcaggttaagatcgatctaaaccaatccattttttctatatacatacgacatgccaacggttaaacaacttattagaaacgcaagacagccaatacgaaatgctagaaaatcggccgcgcttaagggatgtcctcagcgtcgaggaacatgtgctagggtgtatgtgcgactcgttcggatcatgggttcaaacaaataagacaatttttgaagtatccatgatcggtaccaatgaataggatagagcttctctatcctagatttctacggtatatggaatttctggtttcctttggtgcaaatccaatcatctagattggaaataagaagcaattcccccattggtagcaaacggctattcattaagcggaggaaatagtaataaaaagataaaggcttatgctcctttatcttaaaaaaacggactaagagggtcagctacttagccaaatttcataattaaatgccgtcactgtatggataactcttattgtgaaaagagctatttactctataatggataggtagagccaaagaatgtgaactatacaagttcacaataccctttgatgaaatgaaagaaagggctccggtgtatagagagggcctcgccgtttaaaagggaaccatagaaacgatggaacccactattttttagtatcgtgcgaaataactgaagggagtagaagagaaaattgtggttgggaaggttatagtagcaaaagccattggaactaatattttatatatgggaataattcgttttgttattaatgggaaaaaggatggctaaaagaagagaaatcattagttattcattaaggttaatttgattcaatgaccagagttccgcgaggatatatagctcggagacgacgggcaaaaatgcgttcatttgcctcaaactttagaggggctcatttaagacttaatcgaatgattactcaacaggtaagaagagcgtttgtttcctctcatcgagatagagtcaggcaaaagagggattttcggcgtttgtggatcagtcggataaacgcagcaacgcggatacataaagtattcgataattatagtaaattaatacacaatctttacaagaaagaattgattcttaatcgtaaaatccttgcacaagtagctgtattaaatccaaataatctttacacgatttccaataaaataaagattatcaattaaagggataaaaaagtaatatacaggaataattaaaaaagaattcccggagaggtaactccgggaagatacaataaattaagattaagtggtaggaatcaacgagcatgttgcaataaataaaaaaactattttttcttccccattgttctttcttataacaaacccaagaatctaaattggattactttctttatatatagtctggccctttcgaataaaacatcaacaatcagaacttaagttccgattgttgtttcttaaagtctggttggagtttcttaagtttcgattggaattgaacttttgtgttaatggaggaatatgtctattttttctgggtctaggacctgtaattattgaaattgactgggcttgaaattgtttctcattctcatagttacgaaatggtaagaaagataaaatacgagcctgttttatagcaagagtaattaatcgttgttgtttcaaggttaatctatttattcgtctcgataatatttttccttgttcactaataaatcgattaattaaactcatgtttctataatcaattcgatcccccgggccaatccgaggacgcctacgaaaaggttgtttgggtttgcgaaaaggttgtttgaatttacgaaaagtttgcttggatttacgaaaagtttgcttggatttatgaaaagtttgtttggatttatgaaagggttgtttagatgtatacatgatttattccttattttaaaattgaaaaaaattgatttgtttattttattaattttggatccagaagaaatagtctctctttggtccatatattagatgaataccctcgatacatatgaaataatatctaatggaaatcagacaagttgatttgtattttgtattctatctatgctctatatattaaataggaagttcttattctttttgatctttggaaagatcgaacacaagatgctcctatttctttatttcggcatgaatcgtatgcttacgacaataacgacaaaattttcttaattctaattgtccgggtgtattgtggcgattcttttgagtactatatctagaaatccccgccgactcctcattggccccttttcgaacacaactcacacattgcaaaataactctgattctaacatctttccccttggccatgaacctcctttcctttttggattgacttaacttaattcttctacttattcttttattcctctattttgaaaccgaagaggaagaagaaaatccattagaataaaaatttttggaaatttttcaattaagtaataaaaaata

SEQ ID NO: 46857 - DNA, 725 bp, Oryza sativa
atgcagaaatagtgctccaggatccattacgcgttcaaggcctttgttcttcttcgcatccgttattttggcacaagttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgtaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtattgtatcgaaatatgaatcttttttcttcctattcggcaaagattactatttcttctttatttgggtctgtctcttgaacctcttttgcttaggttcaggcgatgtagtggacaaaaagagggaaagaaaatatggcgggggacaaattttttgtgaccaaatagaattgcttgacttgttcaattaagttcaatttagaacttacagaaattttgcaaaaaaacggatactcttccattgaaggctgttttttatttttaggctagttgagtagttttaattaaggtt

SEQ ID NO: 46858 - DNA, 1188 bp, Oryza sativa
tccgctcttgcaattgggtcgttgcgattacgggttggctgtctaattgtccaggcagtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagtcgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaatgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaac

SEQ ID NO: 46859 - DNA, 1018 bp, Oryza sativa
tatttgcaatacagacgtggggatcagttggatctttgattgagtaatatttcttttttgattgccctcctctctggtctagaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattaaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggta

SEQ ID NO: 46860 - DNA, 1740 bp, Oryza sativa
  unsure (1)..(1740): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatgttttctatttgtcatttgttttctctaggcttgtccaagctaacacagttgaatttggagggctgtccagtgactgctgcctgtttggaagctatatcaggtcttgcaacttttcttaatagtgtattgggatactacaattggtggcagtgttcacctctttcaaagcacctgattgcatctagagaacaccataaaaacacaaccttgtgtgtcatttccttttgtaggattggcttctctggtggtgttgaatttgagtcggtgtggcatatacggtgaaggctgtgaaaactttcaaggtaattgtaatgccaactgctgacaaactggaataatgccaacatacatgttttaagtaaattcaggtgagtagtaaatatgggggcattgaacgatgtttgcataaaagctggaaggatgttttgtgagctttgtatgttcaagatataattatccatggaaccttttgtcattgttatacactggcagttgtaataactgatgacgtgaactctagtgaaaataattgttgacagaattacctaatattatgtttccacctggttgacaccagtcgaaaagtttatgccctgcatatctgttcttctattcattacaacagttctgctttgcaggtcttaaaaaattgaaggttttaaacttggggttcaataatatcacagatgattgtttagcacatctgaaaggtaagactaagttcttgttagaactttatttacatttaagaatatggatgtttatgcaggaaatataagtggtgcagtcaattttttctctgttgtttaagcaatatatctggcttcattatgttagccagtaggcactagtgaatatttcctgtaaggattttaaaaatatatttggatggagaaatgaacttggtgatatttatcatgaaacagtgacatttctggtagaagttcgtaatattaaccatgcaattttgaaattggcaaattgattgtggtttgagctttcaatgccaaattattggaataaaagaggcattatactgattgatatgttatatatatttctcaagaatgttatcatagactggagagaaaaagaagatagagcatggtattttgtggtacattgtgttgtgtacatagaaactgaaatatcactttaaagtcacacaactattattgggtagctaactggtaacatttgctgcttctagagttgatcaatttggaatctctaaacttggactcatgcaaggttggagatgaaggcttattacatctgagaggtgagctagtttttaatcattttcatttttcaatactcttacataatttgttagaattatctgctcactcttaccttttcacctttcaaaaaaaaaaaaaaacttaccttttcaattttgctcccaaaacatgttg

SEQ ID NO: 46861 - DNA, 9650 bp, Oryza sativa
acctgttataactgcttttctgtgtattgtacattcagttgtttaagagcattacttggtttgctgattattaattattatcattgtctcgttggtgcatttgtgatctatttactgtgactatatatgccttatgttatgtgtaggccttatgcttttgaaaagtttggagctatctgacaccgaagttggaagcagtggactccagcatctatctggtctgttttcacttatgaacaataatatttctagctctaaccctttttagcagttaagtgccatgcaatgtcattcatgttgtaaaacactggataataggacttattctgcatctttggcatgaataatgtacaagattacttttatgaagtgttttcggcaagtggcaaaacataaatgtgttaatgctacagttttatgtgcatcttgtgattgtttttatcattttattttcttaatctctttactgcatgtattgtagatttgtagtatctagcatgtgaacagttactgaataatatgtttgcaaccagtgaatgttcagaaaagtgaaatgattaatacatgctctcatcgtatccttgttatgtctgatcatcttagaaaacttgtcaagttgtgcaacgatttttgtacagttttctcaatccgattataatgcttaactggcacaacctgctacatcacaaatcctctgcagttatttttgttattatctgtatttggttgtcgttgcacgggcatttgaagcatttgattggaaagctattaaacttttacaggccttcggaatttggaaagcatcatctctcgtttacgttagttactgataccggtatgaagaagatatctgcactgaattcactgaagtcatcttatcttgacaatcggcagattactgatgggcttagcagcacttacaagtatgtattatatgctacaactttggtaatgcatgatacttcttttgtacgaattgcactaatataataatgatcagtattggttggcgctaactgctagctgcagtttttttttcttcgcaactttgttttggatctcactgattatgaatttgtgtggcatttgctgaatttttccatgccttgttttttatttatgtttgataccttgcatctcgtgggggttttggtgtaattttgcaagatcatatgtaacttgatctattaacatgcagcgagtagttgcaaatcctaatttcaatgacactttatattagttttgatccttgggaggtaatgcaggtctcactgggttgactcatctggacctttttggtgctaggataacggactatggcacaagctgcttcagatgtaagggcatactctgaaactatttcaattttagaattattatactaaattgcataattgcgtccattttattgagacgactctctgaatttggtcttcggctagcttagaatcatctagaaagtatctatgttgattacttggttgtacctgtgtacctcgaagagtcaactacattatacaatgctacatcaatgtcaatacaaaatggatttattaatgttagctacaacaaaatgagcttgcaatttttttcgtccaatatttatcggtctgatctgtaccatggtaaattggtactaggcaatacacttggtactaaatgtattttgctccctctgaaccctgtcaagtagacatatctatagataagtgtcttataagcatagtggcatatgattttagcagcattatcagaaatatcagattgattatcatctgctgaatcctatatgttcacgtggcacatcagctaacatgatctatgctatttcagtttttaagaatcttgaatctcttgaagtctgcggtgggttaattactgatgctggagtgaagaatatcaaggatctcaaagctctgaagcaactcaatctttctcagaacgttaacctgacagacaaaaccctggagctgatttctggtattattcctccgtgtcaaatatgacgtccctatgtgcccactctattgttgtctatctgtgctgttatcacatgacaatatgacatgattgcccggtttgcaggcttaactgctttagtctcgctgaacgtctccaacactcgtgtatccaatgccggcctccgccacctgaaggatctgcagaacctgcgctcgctgtcgcttgattcctgcagggtcacgacaagtgaggtgaagaagctgcaggcgacggtgctccccaacctgataagcgttcgacccgagtagctggacactacatgatcacctgtaaataatcatctggatggcttcatgtagatagctttgcaagggcctggattgaagccagattaataagtaaagtctatggtagcatttgttggcctaaaaccgggagacgttggcccaaccgggagaaagcctttctacaccccaaaagctagctcatgaggtgagggacccctccccttttaagttggtgccactccccctaaactttcaatgtgggactattctcaacagcatttactaggtccttcctgctccgtttatcgggatcttttcgttttcaagtactgaaaaaattacttgtatttccttcactccgtgtaccctccaaggcgtgacgggaaggaacaaaattgtaaatattgcgcttcctcgccattgtgggatgcttatgtgtagtgtggtgtacagtgccgcattttctgtggcagtttgtgatgtcattgtgcttgggtttcttctttcttccgcattggctctctgtctctcatttgctctgttttactgcaggtttattagactaatagcatgcagggtggaactgaaggaataaattggacaacgtactattatgctattcagaagcacttagaccgttgacaggggaaagaccaacatttggatacgggaacaatggcgacggaatgaacgatggggcacaatgtatggattacctccaactcgtaggtgaacatatcctatgtatacaagatttccgtacatatcaactagcaaatctaaaaaaaaacagacatctactcctaatagtactgcacatatatgtaaagtgttactacctccgttttttaatagatgacgccattgactttttctcacatgtttaaccattcatcttattaaaaaaattatgcaaatgtataagatataaatcacacttaaagtactatgagtaataaaacaactcataacaaaataaattataattacataaattataagatgaatggtcaaacatgtgagaaaaagtcaacggcgttatctattaaaaaacagagggagtatatttaaattcattatattttaatcataaaaaaaatgaaaattttgacggttttaagagtaaaaatctgtcagaattgtcttttttgttatggttaaaatataataaatttgaagataaaatttcacatgtatgcataacattattaaaagtatgtgtctaattttttactgtgacatttgctaattcgtatgcacgaaatgtgcacagtatatgttcccagctcgtagaacgcatggaggcggtgcaactgtgttaggagcagtgacggtaagcaggttttcgctgcccatcaggccgtcacgtcctaagattctgaacatgaccaaagcagaaatgtacagtccagtccagtccggcacaaatgcacaatggctgcggcacagctgcagatcacgataggttgccgttgtcgctgcacattttcgaaggtttgtaaactcaggaggcaccggcgattgtaacgaactgagctgacagtgcggatcacgggatcagtcaactcaagcacacgcaacacgtatatatatatatatatcgcggcctaccgttcaaacgtggccacatgcgcgtgccaattcaaacgagtggagcagcagctaacttagccattgcaaacattgccatggagcagagcggccgcgtcgccgtgccgctcactgccttagcactcctcgccgtcgtagccgccggcgtcgcgctgccgcccgctccttcctccggcaccggcatccaagacggccgcggcagcgagcactcactacggcacgtcccggacgaaccccagaaggcgccgccgacgagtgtccatgctcgaccaatcaacaagaaggtaatttactcgcgcacgtcgccacgtgacacgcgaatggaaaatgttcactgcaaaatcacgctgcattgatcggtggcttggtgcgtatagcaggtgacgcgaggcaagatcgaggccggcttagctcggtcccgggcggccatccgccgggcggctcgcgcgacgccgccgtccgacgagagcatccgccgccgcggctcagcctccacggtcgtcgccgcggcgggcgacgacgactacgtgccgcgcggcgccatctaccgcaacgcgcgtgcattccacaggtacgtacgtacaccgtcgatccatcgatccactcctctaccgttgttgcaaaaaccgatgtgcatttgcgattaggagctacgtggagatggagaggaggttcaagatctggacgtacagggaaggggagccgccggtggcgcacatcgggccgggcaccgacatctactccatcgaggggcagttcatgtacgagatggacgacccgcggagccgcttcgccgcgcggcgccccgacgacgcccacgccttcctcctccccatcagcgtctgcaacctcgtccactacgtctaccgcctcaacgccaccggcgacctcgcgccgctgcgtggcctcgtcgccgactacgtccgcgtcgtcgccgagcgctacccctactggaaccgctcccgcggcgccgaccacgtcatcgtctcctgccacgactgggtacgtacgtatggaccacttggagatggatttttaattcatccctcgatatcctttgattcttacattaccacctaaataattataaaaatataaaaaaataataagatagataatatgagatatatcacactgcaaatatacaaagttaatttcgattctacaagttataataaaaacaacaaattaaattgaacatgttaacatatattctcagttatatttgttatttttgttagaacttatagaaatcgaattcaaacggttatttttgttagaacttatagaaaacgaattcgaatttttgaacttgtaggtttgtaaagtgatatattcacattaatctatatttttaatatttttttaaaaaaattatgattatttagacaacatttaagcactctaagtttgttcctgcaagaattaattaatttgtgtctcgatcatatcactgaaactaagttggccggtgatgcgcaggcgccgatggtgaccagcgcgcaccggcagctgtacggcaacgcgatccgggtgctgtgcaacgccaacacgtcggaggggttcaggccgcggaaggacgcgacgctgccggaggtaaacctcgccgacggcgtcctccggcgcccgaccgcggggctaccgccggagaaccgcaccacgctcgccttcttcgccggcggcaggcacggccacatccgcgaatcgctcctacggcactggctgatcgggaacaagggcggcgccgccgccgacggcgacggcgacggggacatgcgcgtccacgagtacctccccgccggcgaggactaccacgcgcagatggccgccgcgcggttctgcctgtgcccgagcggcttcgaggtggccagcccgagggtggtggagtccgtgttcgccgggtgcgtgccggtgatcatctcggagggctacccgccgccgttcggcgacgtgctggactggggcaagatgtcggtggccgtgccggcggcgaggataccggagctgagggccatcctgcggcgggtgtcggagcggaggtaccgggtgctgcgcgcccgggtgctgcaggcgcagcgccacttcgtgctccaccgcccggcgcgccggttcgacatgatccacatggtgctccactccatctggctcaggcggctcaacgtcaggctcccctactgatgatcagtcgatgctgtcgattatttatctgcgtgtaacatgtgtgtaatatgtttttcctcgacgatatcatcattaatttttaattttcggtatgttcaaaaatagatagtaaagtgtttttcagcatgctcgttgcccccccttggtaaaggggaagctattttcatccctcgaggggatatcgaggtcccctcgttggtaaagggacaattacttgggaggaacgtcttgcaaaaaggcaaaaaccaaatatatcaacatatgtccacactttatattttcccaatagacctttagtactcactagtcactactcggtaggcacaaaatgtggtagtaacaacctaggccccttaatctcaacatcatgtatattgttgcaagtcgtgtagcccataccgaaagcttctctaccaaatagagatcacaattatcaccgattcatttttgcatatttagtcattaccaacaagattgatatccaaacgtagacatgtaaggatatagtaactgaatcaaggcgtagacagttaacgaggttccatgtcataggttcattttacattagtggagtagagttctgtcagcgaagccttgggcttagtgcgaaacatgttatttgcagctgctacatgtttcggtaactttgataagcaagactatttacagcaaaatcgtgtttgcagaactccagtgggtggtcgttttcgctccccagcacctgcgcatggcaaagaaacatcacaaactcgaaccttatgcaagctgaattatgctgctgaaattttatatttagcaagtatagcatatgaaatcaaaaggagtgtcgtaaccaagggcaacagaggacgactttgggggttatcaagaggcttactagatcacagtctgctgaagagaacactttgtacagttcaacaaacaggtaaatactcccattaaacctgaagaagctggctggcgaatatcactttctcgtctttgcaatgccctcaagaactcatctgcgctaaggctcccatcccggtttgcatcgaacacaaggaaaatgacgtccaccactttatcagtcaagtccacttcacaaacctataaaaaatgttgtaaagtcaatcagaaaatgcagccaattatgtgggtgtcttgggaaggtcctactcccaagacctaggacctagctgttcagttagcacagggctggaaatatgaaacaagccagtgatagtccaaaatagcttaagacttacattaacattagctgattcagactacatcttatgtcaaaaggaaataaacggaattatgaagaatcttacatgagttgctgcacgttttagatcctgcttggtcagcaaaccgtttactttgccatagctgaagattgccattgcaaatggttctaattttcgccgcagatcagcaaaagccttgaactcctgaagttcaggtaataattatgatgataaagagagacattaaacccaagtactacaattggaatatctggatagcaaactttcaaacctcaaaggtaatgcgcaaatccttgagatcaggataatcatcaaaatcatcaactctgtcaagtagcttgtttatgtgattcatatctgcagaagcaaccatggataatgcaaagtccttcacagatattgtcttggatgatttgacatcatagtgactgaattccaagcgaacaatctgcagataattgaatgaaaaattatgagatatcaagtatatacaatgatgacaaaccggaccagaggcaataacagattaatcacgcgtatacccgctacacaaatacacagcaagtaaattttttacccctatgttgtactggggcattctataaaatgtacaacacattgggtgtggtatagtagttctggggtttataatctcaactttatgtttctttgttgatcccacttttggttttcgatggattctgaaatgctgctttagagcaagaacacaatgacagttctccaattacactaggacaaaacaaatcaatgaatgtacaggcattggactttgacctttgcatagtgttgttcttcagtggcaacacatcacaaaatataaaaacaaggaaattcagcaaatgttgtgcttgtataattatattagggatgtgacatgtgggttgtcgaggtgttatttcctaccctcctttacttccttatgtgattagatagtctggaaaaattatttactccctccgtcccaaaatataagggattttgggtgcatatgacacatcgaagtgctatgaatctagacagacaatgtgtcacatccacccaaaatcccttattttgggaaaggaagtagcttttagttcaagtctctgaaatgctgcatccacaataagatcattcggaaccataatgatgttaatgaaacaaaggatgaaagtacaaaaaaaatatttagctttcagttcaagtctctcatgtgttgcattcagaataagatagttcggaaccataattatgttattggaacaaaggatgaattttttttaaaaaaatcacctcatcatgcaattgcttcaaaaaattggagaacttatcatagcgtaactgttcattgccatccttgccgaagaagtactcaaccagtccaccattttccactgactgaccaaccttaagaccaaaacgtaaaccatccctatgggcagctccttgcctatgataggaccgcatcagtgccattactttcttaaactcttctttgtctatttccctgcgaaattcaaatgccagattagagtaaagaaatagcattaaaaaaaattgccaaattgtccatacccttctttaccatcaactaacaagtgagatgattgaacatgctcataaaagcaggtcttttctggaccacaaatttaactgcacatgaattgtcacatgtaaacaacaatatattcaatttatccttgtgtaaatcctagggaaaaggggatagtatacttatagtacctttaaaggcttcagcaaataataaagttcagaaattagatgaaaaatgcataagtgaatagattagggctgtcaaatctttcttatttagctcccggcaaccttgcaagcatgcaatgttgatagtaattaactgagaatttgatatacattcgccagtgaccaatgacattaatttgtttgcaggactcctagagttgaggtttggcataggctataggggaaaactgattataccagaatgatgctgcacatatatagttagtgtatgggtggactattccttaggtctcgtgtgtaagactgtaaggtccttctatcatgaatgggggtttggcaatggagcatagtagcatactggtaatctgtaagctctatacacggtatgatcaagtccattcaagagaagagaatgtagggatgctatcatagaatatacatgcagccatcataattaaagaaacatcagttagtataaattaatgaagtacacttcaaactaaaatttgtaagtgaaatacattttttaatgaaaatggttaaggtgcttgtacaattaaggaatagatgcatatagatctgaagagcacagtatttggttataagtttacaa

SEQ ID NO: 46862 - DNA, 9176 bp, Oryza sativa
cctgtcatggcaagcagtttcatcaaattcatcaagttacttctgccttcattcaataaaacaatagagcagcatataaagttaatgtcataccataccagtggcactcattaaccaaaatgttcatatctaagcattggtgattattagttgcaatgacgttatgcttatggcaacttaatgtatggtccacacaatgtgtttaagggaggattcaaacccaatatggctagcaaacagactgttctacttgccaatagaacctggtgcattttctgtaaatcactacatgacaataattgtgccgggtgcaaacaattctgtctggttctgaaattagataccacgcctaaggacacaaatcagtgagtcgctacttactcggcaaaggagatgagcccatctccgttcgtgtcaaacagcatgaaaaattcagacggggcacagtgtagctcgccagggttgcgctctcccctgagactcccttccctgacaattttcgattcagatggaggaaaaacggggacaaccgccctcatcaaatcggcgggtaacatgtaaacttcaccctctgggttccggatggacgcgaaatattcaaagatcttgcagtaaaaacaccacacaattattactacacaaaccaagaagaattatcatgtcatgttgtgtatacacaaaattgctctgaatatggcacattggtcgctaccttttcaggagggctgcgcgtccgaatcctcttctcgtagttgaagaacacccttctgcgatacgagtctacattcgaggaaacattgcgacgaaaatcatcgtgccgtttgtaaaatagcggatttaaaatttttcagaggcgaataaccgagtagcaaaatactactggacaaattcgcttttcacgcaaaattagtatcgacgaaaacaatgggaatgaaacccagtcgctctcccccgccataaacgcgccaaaaatcgcccgcattacaacccaaaacaacacgcatgaacaataaaaaaaacaaaaatcaaatgccctcacctccgaacaggaacctgcgcttctcctcccgctcctcctcctccgcgacgtcgccgaacgccgccacctcattccccgcctgcccggagtccgccagcggccgcggcgacggcggcagcagccagatccccagccccgacccggcagccaccgccaccgccgcggccgccgcccccctcgcgtcgcggcgcggggccgccgcggcggatgcggagaaggcgcgggaggatccgagccgtcggatggcggaacggacggacgacgagcgggtcaacgcggcggccatggcggtaacacaaaaaaaaaagaaaaaaaacggtctcgtgaggtgggggagggaggaagcggcgatgcgggggcgagaggcgagaggaggtggtggtgggcggtggccgaagcgagacgcaaggaattagtaggaggaggcgattagcgcggggggctaagcttgccattaatgggcgtttccattggtcgtgagacgcggacttgccccggttttgtagtggacctgggaaagtgggaaccatacacgcaaaagacaaattgttcctttttcatttggagcgtggagaactggaaatacaaacgtcctggataagggcactgggattattttccttgtttttgctaaagcctaaaagtctactataattttgccttgaatgtatgggtttatatgccatgttagaagtactataccataataacaagaactcctcgattatttctattgaggtcccctttgttttttattatatatcttatgtgtacttttcaaaccggaaaacaatgcattttttataaaatcttcggtttcttcaatactccttctatccacaagagcttgatagcctcttcaatttctttagtactctctctacatgtaagatttagacatatttcatattttagtttttccaaataagttgttcgtatttgcagtctctatgcatccaaaacttaaatggcgagataaattaaatgtttgaactaaacttgaggagtcatcttaatactgattggttgcatgtgtgcatatactccttgatctttgttacatatatgcaagatgatttaatttctccttagtattggtgataaagtaataagtgtaactttttgtggaaggagggagtacttcgcttcttgtattttataagttattttggcttgataccttttcaattgtggtcctcttagacatcatatagggtatgtgacttcaacaaatttgatgttgttattttgttggttgtaagtgtgatctatatcaagtggctagtgacttagtgttgcaggggatgctcacttgagagttttttttctttgatgaactaaaatatgctatagttcttcctaggatatctaataccctatatctgaagttctagtactctctccatttgactatacaaggcgtaacttctttggatgcaaaaaccaaggaagctcctataattaccgcagaattaggggtctttaaaacaaccaaagcaaactaacgaatagtgtttactgcatgcatgcgcggatgagaattacgggattcaaagagatgccgatgcaactgccttcaatgcatgcatgtgcgtggacgagactaacggagtggtgctgctgcatctgccgccctatattatagaacttttgaaaaaaaaaacagttatgccttgtataatggaatggatggagtattcattttgagtttgaattaatgcctcttaactgtccattggtgtggcctctcatttgaagttgcgctatccttcttcactgcttgttattttttttatataaacttttgtttagttgtcacgccattgatgtggtgttgcctcctagactcccaataattgtgtgcaacatagctttctagtttgttctcaggactatttgtgctcgtgtttctttctcaaagtttcatctaaatgtatgctctcgttggtcttctaaacatagatattaactttgaagattttatttttgcattcaacatttgtaaattgtgactattattttcatcgttgacaaatctagctaaaagctcatttgatttcattcatttttgtgttgttgttatagtaattattttgtctattttccttgttttgctagtaattttcttgatgtgttttacctatataatgtactgccttcgtcctataatatgaaaaattctagttatgaatctgaactagtgttcgtctagaatcatagctaaaagttgttatattttaggatagagtgagtattggagtagaaatttatattgaacttaattaagttttacatgtccttaatttggtgcttgttctaagaacctacattgataagaaatgcccattcaccggtaccttaacaattagtagttgcattattgcaagctagaacacgacacaatgctaaaatgaacaggactatcatcattgtaggaagtaggaactatcttcactttgtcaagaagtattagaggcaagcaagtctacattgtttttaattattatttttttcacttgggtacgtagtcacataatatgatgttgtaaaaatgatttccatttccatcgataggtatgagaagagacaccctaatatcaatgcgaacattaatttccccatgctttcgtgtgagggaacgagatcatgtgatcatcgggcagtgcaggtaaaagaaagctagtgcactatgcttaataccatttcctatcatataaaaaatgcttcaaaattagtattttcatttggtcatagggtgttcgattccaaacttatctaaatatttgcatatgcttgattgactataccacaaaatgtaccttgttaacacaactttcatcgaggttcaaatcattaaaagcttttcttgcatatagtagattgctaaatgttggttatgactgcattgctaatgtgcccatgcaggccactgtccaagattgcgaggctcaatgttttgaaggtcatcctaagctcctagtggggtcaaagaagggtgcaggaaagaaggcattcactgttgcccgaagaaagtatcaatgactgaacattcaattgtggtgctaaactgttgaaagagaggtgtaggaattgcgattctaaattgttgaattaattgttgtgcaattcatgtgtcatgtacacaaacatgattgtgggaaatgaaggggattgcggttctaaaatctaaaacggaggtgttgcttactctgatgactttctggattctttcgtatctactactgttaacagtgaaatttggtaagcccggagtagtcattggtttagagtcagcatcggcttcgaagtcctgagattagccgatgagagttgtcaagtcgtcagttgtcggattcttgctatattcggttaaggaaactaatctaccaaagaaagcttatccagaagagactgagttcgaagagaatgcggcatggcaagttatctattaattaggaatagtttgttagtttccttttatctttaggaaagtgtgtttagtgtcctataaggactttatcttttccttttatctttaggaaagtttctttcttgtccgacaaggacttgtatcaacccatgggtataaatatgtacacccagggtctatgtaatctatcgctacaatcaatacaattcggcgcatcgccaccttttaccttttctactttattttatcgtccggcgggacttggcacctgacgcggggctgcatcggtgtttgatctctggctaaggggtaagtccaatgtttcgtcggcccaggcaattgtatcgtctacgtcggcgtcgttcaaggctgcatcagtacattcgacctcttggattgctctgatttggatggtatatttgcctacctatttatcatatgtctctgttaatctagtcttagcatatcaatttagctctatcggctgcttctcattttagggtttctgccggtattggctaaattgtgttgctagattagattagcttaggcatctaccaccctgaaaaatcagtcaacggcttgattgtctagatattatgtttcttttcatacttagtgctgcatcagttaagtttgatctactaagtcgtgcttagaaccataatctctagcctgcttcttgattgccaatcagggtttcatcggggtttcagtcggtgagttatctgaacgttgcatcggctcataaggattgcatatacatataagttggatttagccgatgacaacaaaggtttcactgtttaatctaatcttgtggatttcatgacatcggacctccagccgatgtgtgctttaaccttcggatcgatgcttatttatcatatcattatttgccgattggtttatgttgttattttattacatcatcatcagctgattgcctttatatcattatctactttggacatatagccgattgcttaaaccctatcgctatcggctggtatcaacatcggctattatcggctagaactactccatcggcttgtcagccgatcggctgttttgatctactatttgcatatcttgtcagaggcaggatcaaactgactggcacgcccgcgcatcatcaagatttggacctgcactggagctaagcagatctctcaggccgatgtgttcgattttttcctcaacaactaccccatggaaacacgtaaccaagccatgaaacccccaaccgattggaaccccatggaaacacgtaagcaagctataaaatcaacgaaaaggacgttcatgtttccggatatccgatgcaataggatttaggtcctcattggttgcttaccactttatataagccataacggcttattaactagtaataaaaaaatatgaataaaacttttaaatatgtgttcttaataatttaaaaaccaatattgaaggaatttatgttgaaaaggcatctaaatcaaaagtttcaaaatttaaattttggcaacaaactggtataagtgatagcgcaagcaataagacccttaccttcttaccttggtggacagcgacacggacaaagctccaagcctcgattacgatcggtgcttcacactggcaatctaccatgccgtagactgtacccttctactacctcttttgtgctagaaagagttttaaccttggggagcaaggaaaacatgcttatcacaccgagggtgtgtttagttcacactaaaattaaaagtttgattgaaattaaaaacgatgtgataaaaaagttaaaagtttatatgtgtagaaaagttttgatgtgataaaaaaaattaaaaatttaaagaaaaagtttagaactaaataaggccagactcggccaaagctatctgccgagcacacatcagtccatcaccataggggtcgttctggactgctctcgagcattccggtggtttgtactcgtactcgtagcagggaaagcgcctagtgggaatgtgtgaaaccagatcactgtcttctctgaatcctgcagtgatactcgccgttcagattttcaggttgaaccccagtcccaagttaccgacgaaaacggccagaaaaccgccaaaagcacacagtaaaagagatgtacggagtacgtccatgcaagttagcttcacgtgcaagtctccacgtatagcacaaggccggccccaaggagcaagcaaccaaaccaaagcgctcgtttttaagcgctccagagccctccacgtagtaatcttatcctctatactaacctctctagcttcttcagttcttctccaaacccaacccccccaagaggccaaaaccctctcctatatagccacactcatccttgcaattagctcaactcagctcaagttggcaattcatatcaaacagataacatcagtagttcgcagctagatcgatcgtcacagcaacacaatcaccacgacgacgatggcggcggcggcggtggagaagaagagcgggagcgagatgacggtggtgcgggggctgacgtggcgaggtacatgggccggtggtacgagatcgcgtcgctgcccaacttcttccagccccgggacggccgggacacgcgggcgacgtacgcgctgcggcccgacggcgcgacggtggacgtgctgaacgagacgtggaccagcagcgggaagcgcgactacatcaagggcaccgcctacaaggccgacccggccagcgacgaggccaagctcaaggtcaagttctacctgccccccttcctccccgtcatccccgtcgtcggcgactactgggtgctctacgtcgacgacgactaccagtacgcgctcgtcggcgagccgcggcgcaaggacctgtggatcctgtgccggcagacgagcatggacgacgaggtgtacgggcggctgctggagaaggccaaggaggaagggtacgacgtcgagaagctgcgcaagacgccgcaggacgacccgccgccggagagcgacgccgcgcccaccgacaccaaggggacgtggtggttcaagtcgctcttcggcaaatgatcgagaaattctcagcggccgatggatggatcagaggacgacgatgtatagctatagtatgaatttgccttcagtagcagtggagaataaaatggacttttggtgtgagtgtgttcttgaggtgattgtgtgtttgtaatgctgtgctttacaggaattaatggaaatgaactcttacacgtgcttaattttagttcatggtttaattggtaaaatgtgtactgatcaatgatgaataaataataattagataggttgaactttgtcagtatgccggcttttcagatcatgcagtattactcgttcttcagtagttcagtgagactgagagagagttctgtttgctccaattttatttgttcttttttgagttttcgaagcttttgtttggggattcttgaaatatttagagatcactaactcggccatcatctatttttagatttttgtttggcgtattttactgctatgcgcttgttacttcacatgagcaaaacgaactttcaaggtggggattttcagttaattcgaaaaaaagctgtagattttccctgtcagaagttgtaatctttcggatagaggaaatccgatttaaacgttccaacaaactttggagacacgcagcgagattgaacttccgatcgagtgggaaactacgggctctcatccgttcacgctaaaattagaagtttggttaaaattggaacgatgtgacggaaaaagttgaaagtttgtgtgtgtaggaaagttttaatgtgatggaaaagttggaagtttgaagaaaaaatttgtaactaaactcggcctaaaaagtgaacttttgactccaacttcaagcacattggtcgagaaggcacggtgtctcgtctccaattgcagtaggagcagcaaatatttgtcgatgaaggctatgtttagttcatattaaaattagaagttggttaaaattagaatgatgtgacagaaaagttgaaagtttatgtgtataggaaaattttgatgtaatggaaaagttgaaagtttgaagaattattttggaactaaacaaggtgtgggaatattagggttggtttgttttgtgacctaaataggccttaccaaattttgttggtgccaaattttagcaagttttggcatgaataattttggtaaggtaaagttgtgtttggattgaagccaaaatagtctaaattcactattgaaatggcctattttcttaggcatgtcaaaatttggcttcaaaccaaatagatactaaacactattgaaattgataaatattggtaagcttaatttaggcctcaaaccaaaccagcccttaatgaacaatccagacaagatggattgatgtgtcatgcatgatttgtcgatgaaagccttgaatgaccctaaccaatcatcatgcccatcaatcatgtcgagctaggccagtactacgttctcttcgaagcatccgaatcccaatttcacacagtactgaaaaacataattcctatctggaagagaaagccttcggcctccggttagagatttatcaataatttgggattgtgctttgcattgagattagtgtaagttgctagagagatagagcatgctgctccgtttcaaaataaaaagatttctaggttattaagcagaggttaatattaag

SEQ ID NO: 46863 - DNA, 2358 bp, Oryza sativa
  unsure (1)..(2358): unsure at all n locations
ctgaacattattaactcaatagtaagaatagatgaatccacatcaagagcccatgtggccaatttgttttccagtttcaacgataaggtgttgaaatgagctgtatattaagttctgagactaatattcacaccatcacaaagtacacccgtacactctatagactaaagccaatcacaatttcatcttccaagtgatccattccaatataatgcagagagcattaatgaattcaaggcgtatttcaaacatactaaaaaaattatacacataatgacctattctaacacctatgattatcacatagaagtctaaggtaaaaaagaaacatctctgaatattagttgctgcatgttagtaattcaactgaccacatcttttccagaaggatcagcatccatgtcttccttgacatctgaactgtcttcacaaattgttgcgataatattgtcatattcattcaaggaagtgcctttaagtaactgcagaaagaccggtttcagtttttcagagcatgcacctatcaccttctctgcaagttcaaaagatgcagcagaagtttcctggaaataaaaaccaaatcaattagatggtatctttttgtctgggtaggaatgtagattcatattgttgatgtcaagaaagttaaaaacatatatatgtaccttcagttcggacttagcatgcttgagcagacattctgcaatgggtatctcaacttcatcatcctcttcaattaccaaaatcattattgtagtcatacagtttgtaacattttctgggtgatttggtctgaaatatgagacaagggatttcaaattatgagtgtacatacaaagcatacaatgcagacattaaagtataatatctaacaaaaatgtgttaattatcaactggccaaagtagtaacacaagcaagttatttaggtaaaaacaatgtaatcatgaaagatcttaatattggcgatttagctcagactgatgactttaaatacagagtatataagaagcctataagaaaaacattgaataagatctgtgcagaacagaacagccaattgtataaaaaactatctgatattcttgttcttgaagaaccgttacaggtaagaactatgttaaggaaataaaattgactcatttagcattcttggagaacataatttagcaaaacttacttcaaacttatcatgagaactagcaaatatagatgaaattaagaacaaacgaagaggtacttacttcacagttgtgaagaagttgtgaaacatttgcagtatcagatcttcacactcaagatccaacatcaccacgcatagccggacctttgccacagtttcaaggattgcaactatccttcgaaacaaggggttctccatatcatccaatttctcaaaagaccccaccattatggaaaacacgtcctgaaccgaaagtagatagcacaggtcagatgtcaggatataggatatcaaaacaagatcatcttcatccgataagaaaaaggtataccttcatgacatcatcgtcatatggagtgtcaggtgcagtgatcctagttatctcagaaatacaggacaccacagaaagtttcacctcatagctagaattatccaacagctctttcttgatcaaagctttcattgctggagttatagcactaatcatgctttcagaatgtgcttgttccacttttcacatgatatatatgcggnggcctctctggcatagaacaaacaagtcatgccaatcaaatgatcagttttctagggaaccaagaaatatatatgctcttaataaaactgtaatggtaaaggagtatggggcatttacaggaatcaaacaccacggcaaactccgtatatcaacaatccaactccatatgtcaacaaacacgacggaaaatactctagaaaaacaaatgcttgctctttgtgccataacggaaaatcaaacggattgcagagcagcagaaaccaaaatgaatctaaagcggaattccagtccagtaaaaatcacgactcccaaccgaatcaatcctcgcggaatggtatcaagccaaagcttccgaaccatcccgaaatcaaaccaaccatcccgaaaccacgcaatcaacaggattaataaaaataaataaatccaacaaacagcagaaccctgacaggagaggcaaaaaaaaaacgtttcaaagcgaacacaaacgaattccagcacagagagggttagagagactcacgtggatgagcttgagcaaggcatcgacgtcgtcggggggagactggagcttctccccgacgtccctcagcttcccctcgagctccccgagctccgccattcccgcgcgcgcggcaccccccg

SEQ ID NO: 46864 - DNA, 2206 bp, Oryza sativa
agcaacgccgcgcaccaccccctgcccacgcgcgcgcgaggcagcggccgacgccgacgacggcaaaccaaggtgacgggaagagaggagaggagatggatttctctatagctatctctgcctctctctctctctctctcccccacacccaccggtccccttttcccctccctccccccgtgcgagacgcgatttcggtgcggtgcggtgcggcgcaacccggaggtgggtggtggagatgtttggaatcgggcggggcattttatgggcgcgacccggggaggggttggggttgggcctcggccgccaaaaaacgaacgggagcggacgcgtccgggggtgaggagggttagggcgaaaatgtgcgcgggtttgtgcgtccgaggtgcgccgccaagttttgggggtctagcggacgggagtccccaggcttgtctgaggcgatctcggccgtcgctggctcgcgatggagcggggggcagggtggatggatggctggggaacactgctgttccacggccgccgaaaatggcagtccgtaatcctcggcccaggtacatcctcggccctgtgacaataggagggagagagagaaaataaaaaaattgactcaccggagtacgcgcgacacggcagcggaggcgttagagacggaggcgagtggtggcggcgagagaatgaggtgagcgggggcagcgtgacgaggcggtaggggtgcgctatgaacgagggtggagatcgttgttgttggtaccggcattggtggaggggtgcgggggcagataagatgggagagagtgtagcggcgcggacgggtgcgtctgaaggtagaagacgacgttccgagacgaagggtatatataaaggcgggagagaatggtgaccgtcggattagtgtgatctaacgatcattgtttgtaactgtacgacgtatgaacctgccataaataatatgcttattttgtcatgacgtatagagttacgctcgacatcagcccaccgaagtaactttttgtgaagaatgtgggacctagaaatattcaaatgctagattgggcttggaaaaaaagctaggcccaagtctgattctcttccaggaccgcatctttcacaatcaccaagcctaggtccccatcgacatgcatcatttggtttgctcgtctacacaatagattggagcgcgaaactttgaagtatatataggtcatacttgcaccattctttggtacacaacttcatcataaggccaaaaccatctgttgcttgacttactccctattgaccgatgatgctctcccacctcttggtctgcctcttgtatcacctcttccttcatgtggttagaacaatgtcctacctgactcctctattggtttacaacaccgcaagacgatagaacccttctaacctagtataaggcctctacgtacgaaccaaaaggtttgttcaaattaagaaacatttattggttcaattgctcgagtatttttgcgctcacattcacgattgccatgcaagctcaacttaaatttgcgttgtagatacaaacattgggagaaaggcactttttcgaaatggtgcaacctaatgtgcattgctaaatttgcaatggtgtacatatatcattatatttaatgagcccatgataaataatgcttctttggtttatcaatgtttgactctacataatggacgtggatgtggcacgccgtcaaatattgatgattagagtctagatgtagtattcctactctgtcgtgttgtgtatcataacacacttgaagtataggaattgatatatgtgtgttttaaattgcaaggtttcttatattccatccattcctaaatagtatacaaacttctagcatttgaatcttatttcaaaatataagattttatagcacagttcactgtactatttatctcatcaatcacctcctattcaaattttattcccattttatcccctacctaccctctcgcctccactcatctcatatttattgaggacactaaagtattttcctcttaacacagggatggaccaaaaatggaccaaggtctaggccatcccatcaaagctttggcccaatccatactatttatctcatcaaccacctccatttaaaattcattcccattttatcccttacctaccctctcagctccactaattacatatttattgagggcactaaagtctttt

SEQ ID NO: 46865 - DNA, 1783 bp, Oryza sativa
  unsure (1)..(1783): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaaccgtacgtaccatccaatgcatggttaattgaattataatccataaatgttctagaagccctgttttgggatggttgcatcagaataatggtgtgcctcccagcctgcacaaataccaaaagaaaaaaaaagattcaatgcatgcttcaagtaacaagaaagaatggtgcaatttgatgatactgcaaacatgccataactacagagtgttcaacaaattcctgaaaaggtaaatatttccagagtatccattacctgaaatatatcaggctagtactacaaaagcgaggagtcgttatactaaatagtaatatgatagcatggtcagcatcacaattatgtcaaccagaaagctttattatctaaagacagtgattccctgataatacaacaaccctatccaatgtactgcttataaataaaaaataaataccatcagtagcacaaaccacatatctttgcttaaagattatagtatttaagcagtggcggagggctcggtagggcgaggtgtggcgctcgctatacctcacgccacccgataaaccccccaccccccacactttctccggacagcagggcgccgagccgcaaagagcgcggcaacgccgctttggatgagcaacatgaaagggcgcgaggcgctgcgtgggtgcatccgcacgtacgctcaccaacaggtagcaggccaagctgggcttgtttcatgtaaatgtttcttttgactattaaaccctagacccaaattcccccatctccttcacctccatcgattctccaatccggcaatcctcatcccgaccctaatccccatcggcggtgcggctgctgcctgctggagcggagtcggcgcacgagagggaaggtggaggcgaggaggggcgaggccgccaggctcccgagcggcgggcgcagagcggcggcatccgcaccaggcgccagcacagcatggcactgcggcaggcggcgactgcgagctatcaggaagtgaccagccagccaggggtgcagccatgtatcgcaggcagggcagagggcgccatcgccagcacaggcgcacagcagccagccagccactaacctctgccaactagccagccagcagcagtgcagcaccaacaccaagcatagcaagcaagccaagtcatcagcagaaaatggatagaaagaggaaagggaaggcattggcatcacaaagaggtacatattgttgacaatttaagaatattacaatttgcaaattcaaagtgtacaaatttgtttctgaaattgcatttgtgtaatttgttttgcagatttgaagagttacttcaaccggggctctagtagtagaaacccaagtacaaagcctgaatcttaaggagttgagatatgttttagtacatactcttctatttacacttgtttgcaaatggatgatgaattatgaacttgtgattagtgcttgttgccatgcttaatgtagacttgttgagataatgttgtgtcgtacaatatcatg

SEQ ID NO: 46866 - DNA, 2689 bp, Oryza sativa
gggcgagaagagctaggtacgggcggaggctcgccggaggcagctctgagcggcgtcgagttcgtcggagtagccggcggcggcggcggcgtgtcggctgggggatttcacgagtcgcgggggaggggggaggggggagagcgtcgagcggtccgggtcggtggatggaaaaggagaccaggtaggagacccaatcctcgcgtgtgagttgtgacacgttcgcagcacgaatcttgaagcatcaaacttactaataagtgttgccctgttaaaccatcgaatcaattcttgtggctctaggatttccttcctcctagatttcctttcgccctgttgccagcattaagagcaaggataatagtatagctcactttctactattagcccattttaaaaccaacatatataatgattagctataagtttggctacaactttcttcttctctctctatctctcacatatgcatttaatgtatttacctaggagcatgtgttaagctagctcttgcatgagagccaacatccttgatttttttgttatctcgtctccacataagcttatagtaggcttatactccctccatctacttttgatagtcatatttccaaatcggaaaattctatttttgataggcatatttcaattcaacaacctattatcttaatgactttctcggatttaatgtatgactctccattctttcacacaagattggctaattgagcatcgtgaaatgtaaatattaatgaatcgcttgtttacgaggaatgactagtagcatgtttaaatggatgataagtagaattactattatacttgctctaaggcaagatgaaatattggtctgtgtgccaagatgaaatatgactatcaaaagtagatggagggagtagctcactattatacttgctgtaaggcataagtaatggtgtgacgttatcatcttaaagaaaataccaacatgatttttaatggcgtaaaagattgggaaagagaaaagagaatggtgccattctttttaacatactgataggcaacataatactacaatcataaagataatgctccctgtctccctccgtcccaaaatatagcaatttaagatcggatgtgacgtatcttagtactatgaatctgaacatgccccctatccagatttatagtactaggatgcttctaatccggttctaggttgtatattctgggacgaagggagtatattatattaggaattatcaatatatatctatatatctatgtatgacgtgtaaagtttgttgcaatagattaaaacatgatctctacattcgatatggacatacatcatgctctaaagttcttgcaatggtcttttgtcgcccaatgccaaacctgccgcctgctagtggttgtgcaacagtattatgtggttttgtaacgttagatgagtactcccttcgttcaataaaaaaaagaatctaatatagaatgtgacacattttattttagatttgttttttatagaacataagtactcttgtgatttgtgaagtaaaattttcactttgtaaaaaatccagagttatagccaaacgtagttttacctaaaggtctgcacgtgtcgagacgatctaagatctaaaacttggtagtctcgaaaaaaaatgtacgttcatatgtgtataataagaaattaaaagtcttgtttgccataaagcctgaaactatatggatctactaggctgaaactacattaatccactagacagaaactatatgattctactaagggaattgacagaaactatatgattctactaaggaaattgagacaatgcacatttcaaacaaagattagccgtatgcatctgttccagatgtagaggccggttttttcttaaaagaaaaaaaaaactgctaccgtctgcattacgccgtaacaacatttgcctctagtcactcgtgacctcatcttttcatttatacttatcagtcaaaatttaaattttcaaccttaaatttagagctaattttgagattttttttcattgaagtctatttttcaacatttgctttattcataaactactttcgtttacaaatatatcgtttggcttatttcataaataagcgaaacaatgaggccatcagattcatgacacgcaagagcgcgaaatgcaaacagtacgaattcccatatcctacctcacagcctcagatgagaagataagactgcattgacaggttaaattgaaccaaacaaatctcgaataaattgtcatgagattggctggaagaattacatcagatctcaactttcgactaaattatgaactcagttgtacccaacgctaacaagtatgcttgccaacacgcagcagtacctgttacaagaggagtagccgcgtaaaccaccatcgaggtattgttacggtgttatcagagctaaatctatagcttttctttacttcattatcagtcatctgaccttgcaaaaaaatacagctcacaaaaagctgttcctcaacttcagtgttgtagtttctcgaactgaaagggcaaaacctgccaactaccgagtaacaaataaccaatgtaacattcccagttaggacatcagtaataaggtagaagttggcctagtcaaacttgcgacaaatatttattccgaggatagaagtttgctgcacgcgtcgggctgcaggaa

SEQ ID NO: 46867 - DNA, 17540 bp, Oryza sativa
tccaagattgttttctgcctctctatgaatttcactgattttcttagctttcatctgagaaagaattaacagaatctcagagcaattcatatagcaaaataatatcatattgctttgatagaaacagtaaaacagaatccaagatctaaatgtttatcatgctcagtgactactagaatgagtgccactcggtgtattgcaaaaggtacataggacttgaagtgaactaatgtcaggtagaagtattgtaagcgtgtgaaacagaccatcatgactaactcttgtggtgtaaccatgtatatattaccagggcaatacttgggcaatttccaaaaaacaatgcattcaaaagactcaacatagtatctcaccatatatatgaaggttcttagtaatctaatttggtttcatttctgttattaataaccactgcatagctattagcaactagtagagagtactgggcagataaaaattctggagagtaatacaaatataaagagaagttgaggacctgtacctcttcacgtcgaggcacccattggtttgaacgaagatcaaggacatcgcgtgccatgaacctcaatcgtgatgccaactgagaattagttgttagatccttcagccggttgaagtatacgtcattaaatcgtcgagactttggattctcatccaactgtttaccaattgtgttgaagaactgacagatggcctccacattttcctcagcagggcatctgttgctttcagaacctaatagctcctgtttacagaaaatgggtaagaaaatatttagttgataggtaaatcaataggtctgtaaagtgcaaacaaggatgtcttgtgtcatcaaatgaagggtgttcaaacaaactgataaaaagtcagtcttaacatcccgattaggtgcacttctggcacatgcgtattcttgacttaatgattttcatttgatggtatattcaactaaacgcgaaagattgcatgcgcacctgaacaatgtgatgtactatcttctcagggaccattttttgcttaagtagctcaccaacaagacgaatgtttccaagtgtccgaagcttcactagcctttctttatcacgtctctccatctcttggtctagaccagtcaatttattgacctcagaccgcagattgtcagcaccttcaaatgcttcttggcaattgttcaacagcacacgtttgaacgtgatctctttaccaccaggttcttcagaagggaatgagggtaacttctcattgagatcaaagcaaagctgagcatacattggacagaaggtaggctcaagaacagccttctcaaatatgagactaataacatcctgaaacaaaaacagaccagatgtaaatcacaaggaactgtcgaaaggcaaagccagttgaatgaacaacaagaacataccttcaaaatatcagctgtagtgatccctgcttcaattaactggcccttaagaagatcaaacttttctggagtcaatttgttcagtatactgtgaaacaaataacaaataaatatatgcaagaaaaaacataatgtttggttactctctccagcacaaataaataccgctttggacatcagtacagtcccaaaagcaaaactatgacaactaatttctataaggacatcaataaagctcgatatagtgagttctccacaagtttcatgtgtcaaatcaaaatatttaaagaagcattagtgctcaacattcaaaaggtttggctgcaggtatgtctaaaacagcacattagggactagacgaaaaagagtaaataaattatatttcctaaatatgaaaatataaaaatgatgaggaaggatgatacaaatcaaacaataccctttcactgttttcagaactctttctttgttggagagattgcctctctggattgaccaagggacttcagccttgacaagagcaggagccggaccaacctgatgtttaccacgaatgagaatgttagataattgtcgtgtatcaaatcaaaatgatcagattacttttgcatgtagctttacttatgcagcatcagcatacagccaccaaagcaaacattctagtaattcgtaattatacatgccaaaattatagtatgaatttgaagcaatcatttcacttggtgcattgacagatgtctaattgcctccaaaggactagaattagataaagccataaagtccatacatcattgcgttgctatgatgtaattcataaatgcaagaattgccacaatatcaatcactacttgcaaccaggtatatgataatgtgcacccatcacaagcgtatattgccccctcgatggaacaattttctaccaacaatatatatggcacaacaacaagcttaggagttaggagcaggtgagaaaaagttcagcacaataattgtaaaaaaaaaatatattggcacatatgcagaacaagagagcttagaagacagcccattgatactcttttatcctcaagatacctgagcttttgcactgaactgggagctcaatttgtcttgattattaaattgatcttgctttccacttgaaatgtatgattcttttgcttcacgaaatttgtcccaagatttctcttcaccaccaatagcaggagtttgcacaggttgttcaatccgtgaacgccaatcacggttgtctgtctcagcgtagcggttatatgactgagtttgcacctgccagatatgataaaacatcaaacaggtagtaatcagtaaacgtgaaactgcaccagtcttactgagcagatacagtttgcaacacataggaacagttgaaaggtaaaggaagagttctcacacttgagtcattgttaatccagggttcatcttcaccatggagttctatgtcaatatcttgcttaagcttcaagatgttctcaggtatgtcgataatctgcaaaaccatagaatcaaagcatgtaattggaaagatgtcgagggaaataaagcagaagacaagaatatttggttatgaatacaagaaccagtggtaactgttgcaaatatatgttgttttatccatttaaacttctctgaaacataggttgttccacaactttgcttcactcctatcaatgttacaattaaaattcgagtggttttagaacagaattactgcaggagagtccattatgtatgtaggggaaaagatttagcatgattgggaattattcaaggcacaaaggccatttcatgtacaacttagtcattgtccataacacaaaaatgatatatatgtggaactgaaggcacaacatgatggcatgctcaacttccctttacagggaaatgaagagccatagaacaccagaggaaaactaattttgttatacaagtttcatacatcagatagcagaaaagatcaacagaaaaaataaaaggagacagattttctgagtaccaaagtcaatttctctaatcattttgtcatattcaacatagacaagtgcaagcaactgaatcacccctaaagcttgaagtgaattttggatagctagattgttatctcacttccaaatcttcagttctcaatgcacatatattaaatataatatgtaaaacgcagaatatgtgcaaaacaaaggtgagcaactgagcagtgtgtttcataaaccaagcaaatagattcagtgaaaccgcactattggtttatcaatatttcaaaatatgagcagctccatcattatagaagacagctatactaaatgttccataatgattaatttcatcatgtgaaatacagtaagtaaataagtagcaacagataaatacctcatgcagttcaacaagttgatccctagtgtaacgaacccgctcgagaggttcaaaccgcaagtctccaagctgtaacagattcggcaaatgccaaccaagcagaggttaataaactatatattcatatctggtggctcatattaaatgaaccagaccagaaacacagtctagacaaaatgcatttgaaacaagccaacaagttgcaactcaagaatctcgccatttgattggcccagcggagcatgtaacgatctaggatggattgtattctagctaattgttttctttgggtaaaagttctctaacactgggtttattgcagttagtacaaactacaatatcgaaggctcgaagcctcttttagtttgctgttagaacattgagggactttccctgtgaataaagcgaagggagaagtgcaattgttggggcaaatagaggggccgatttgctcctccattcatctacattgctttttgatttgcacagctagttgttgataaagagtagaagcactgcactaagaatagtaaaacacactcttttgataatgtcaatcattattggtcacaaatgctatcagaaatacagattctaaatcaagtatatccttcaagcaaatcaaaggggagtatcaaaccaaaaaaccagtgaaatgtcacacccatcagccagcactcgcaatgcaccgcagaccccccccccccccatatgtccccttccgcgaggatcgaaccctaggaccatcacccccaccatccccaaatggagcggtctcaccttggcagcgaagccggaggatgcgccgccgcgcgggcggaggaagtcgagggagcctgtggaggcgccgaaggggaagaggcggccggcgcgcgggccaccgatgccgccgccgccgcccgggcgcaggctgatcaccgcctgatccgcctgcgtcatgatccgcctatcgaagaagagaggcggagagacggaggcgcggattgggggcggggtagggttgtatcccccagaggcagaggcgttttagggcttttgcgttgcggcggtgcggcgtcgtgtggtctgttttgctatgttggtggaggggtagaacggtctttttctgtaggttgtgtcactgcgctgctcgccttctcggagggcgacgtgtcgggaggacgaacatcgaggacgaaaatgccgtttcggtgctggaaatgacggtattgggtcggggtctccgggagtgcggggaatttcactgtgaatatacacccgggacagattttttttgtagtagtagacggagtaaatacgaaattgattagaatttgttaagcagtgcgtgcacatctaaaagtagggtttactcttttttatctttaaataaataaatttatgacgaggttaatatatcatgataatacaaacctgtacagtaaattgtatagattaataatattaaaatatgtcgtatctcgtattagattttgtttttgttttttttaatatagagagtaaacggtagagagattcccaacggtagagagtaaaccgttcagttttgtggacttcggctttatatcgaagaagttttccagctgcccatcatccaattgctcttatctatgcattcatccacttacccagacgtggagccgcatgtagggctatcatcgagctgagctcgaacgagcttgcctgccttggctcgagctcgacacaagctcgagctcggctaggcccacgagctcgaccgagtatacaataatgtatattttgatgataaaatttagtaaaaacaataattttaattaacaatattgaagaaaaatattatgagaactcaagattaatatatgatgccaaaatacactaattattcatttgaatagatactaatttattctaaagttacacacaattaggctcgtgagaagctcgagcttggctcgacaaagctcgcgagcttgtagctagactcgggtttgactcgttaagagctcgagctgagcgcttgagacgctcacgagtctcgagcttttttttttacaaccctacatgcaggcatcacgcagaaccaacaaaagctagtgggcccatagagcaagagcaagaaccacacatataggcccagatcgcgggagacgaggcacccgcagcttgcctctctcagagcaagttcaatagtatagctaactactagctccaattcatctatagccaatctaatagctcattcatacaacagttatatactacactattaatacctggtcccacatgtcatacacacactacgtcttggagtccgtgctacagctggctataaatctgtagcccgctgctcttctctctcctttttttatctccttaaaatatgtttgcagttggcttatagcctgctattgtacctgctctcatgcgcacgagatgttcggtatcttcggtgaagtcagttcacagcggacaaaaaccgatctatacatggacaccgatatacataaaaataaatgcaccaaatccaaaaacgcgaaaactagtaattcggttcgattcggtgttcgttttatttgtgcccatacacccctccaaacattttttaatataaattgtgagcgtgttgggattaaacactagacctcgggggttaaaaccacatacccttgccactgcactatcatgtgaattgattactacttcggtttcaaccgctatggactcatcggaaccaaggccatcaccaccccgcatcgcttgagcgcacagaacccctctacgtggcggtgcatgcaacaagaaaaaaaaaggtgagacgagaaagagaaagaacgagagggatggagaagcgatgagaggagaggagaaacgcccatgcgagacccccaaccctgatagtcgccagcaccgccatctccgccgtcatcgtcatcggccgcctccgcaaatcgaagcttcatcgttcaccatcgctgcctttgcctcgcccttcccccagccggcgatgggtaacgaaggggagagagggagattgctgaaacaagaaatatacttcgcatgtggggcccactcgccacgtcggctaagaacagactctatactggttaggatctcgagtataccagttttgtaagttgagaaactcattatatcttgtattgcagtttcgaggacgaaattcgaactcagcaacgaagaagggatccaaaatgaagggctagtttggtttgtgaccaatgttggccttaccaaaatttggcatggcaagttttggtatgtcaatttttggtaaggccaacatgtgtttggattgaagccaaattaaactaatttggctattgaaatggcctatgttacataggcatgtcaaaatttggcttcaatccaaacatacacaattattgttgaggttgccaaaaaaaaattggtaagcctaatttagacctcaaaccaaactggccggaacttattctaaatagcaacgctgcctggttctgtttaatttaatcatggcctcgttgcctcagagcccaattacaaggcactaaaggcagtagggttcggtttaaggcccccagccggaaggcctcgtcaaaaggctcaacacgtgccggccgcgaccggtgcagtgcggcggcaggccgcggcaagccggcaacgcgccatatctcatcctgactcggatcctacgtaagacgatgattttacttagagcaagtttaatagtatagcccactaccagctccaattcatctatagccgatctaatagttaatttatacaacagctgcttactatactattaacatatgatcccacctgtcatacacacattgcgtcttagagtccgtgccgcagctggctacagatctgtagcccgctgctcttctctctcatcttttatttcattaaaatatatttatagctggctaataggctactattgtacctgctctttgctcttgttccgtcaagccttcccgtggacacaaagacacgacacaaacctcccgaggagcaaaagcaatggaggcagctgcgctaactacaccgacccactactacccctcttgcggctgctcgaacggcgaaccactactatgtttttgcatctacttttcccccatgcgagttgcgaccaaacgcagccatatgatcgatgcagatgcacgtccttgcataggtaggtgtaaagccgccaggccccagagtagtttgctcgatcttcgaatcagccgtgcgatcgtgtgaaaatctccgcatgattcacgttggattttgcggtctctggatggggtctttgattgacactttctccgtgcgcctttggtcccggactccctgtccactgcaactgcaaggccgtgcgaagcacatcatcggttattacgatttcgtggcgccgtgacagtgtacgtttctgttggctatgggcctgtggctgtcggtgtaccggtccgggatgctgacatcatgtgaaagttcccttttaggattgttgtatgcagacatgcagtacttgagtccatgtttctctggagcaaccatcattctaaacattattagcaggctctaaacattatgcacgaatgaggtaccagtagcactaatcgaacacctgcaacgcaaagacgtcgaacggatatccgttcattttcaaatcagacagctttgttacttgttagactgggtcagagtacaggtttgcaggatgaaaggaacacggcatatggcagcagtatggcactgagcacacgttgtacgttccggctctctgccggtgtcgcggcgtcgcattcgcatacctcgtcatctgaagctgatcgatcgctggcttggtcagagctagtgagtaattggctacagtattaattactgtagcacctaacctaaacattcgtcagaagatagcagcttggataaggatttcgcaccagtcgacgtcgcatcgccctcgcccgggagcgacttttctttctacgcagaagtgtttaggttcaaagtttttcttcaaactattaactttttcatcacatcaaaactttcttacacacataaattttcattttttccatcacattgtttcaattttaatccaactttcaattttgacgtgaactaaacacagccttcgtacaattataccactaaccaataatcttatactatgaaacgttcagccgtaagagctggtctgtgcgtgcacacacgagccttgctgctgggtcatcaccgcatcagtactatgtatcagctggttcaacgagacaactaaaatttactacatctatattttaatacatgacgcctttaactttttatttaacgtttgaccattcgtcttattcaaaaaaaatttatataattatcatttattttattgtgacttgattcatcatcaaatgttctttaaacataacataaatattttcatatttgcacaaaatttttaaataaaacgaatggtcaaacgttgatcgttactgtttaaccaaaagcgcgcctggtagtatttgacagcagcagcgatcgagctagtagtacccgccgtacgtagtgccacacgtaattcaccatctaattcgcgtcatctaaactccaactgccccatcggtgcagctgaacagagcagtagagcacgagttggacaaggatttcgcaccagataaagctggacgcggcggtgacccgatccatagttccatacataacctgggtgcccgaatatttgggaaacggttaactcgggtttgcgttgtcagaccatgtgccgagcagatcgtacccagcccgatctcgccttgaactcgctgcatttaagctggggaaaaatctcagattgctgctgtaagattaaccgcacatgcaaatccaagcaaaattgttcgtggaaacgatacagaagatgtgacagtgtcaccggagactgatgtattattgcatagtctcaaagagattatcagtccgatcgtttcgtttatttatttgcaaacgaaaaataatttacaaataaaacttttatacatgtgttcttagcgatttaaaaacaatactgaaaataaactttgatgaaaacctcccaaaatcaacttaaatttaaggttaaaaatttatattttaactaataagtataagcataaacgaaaagacaagtcgttacgtcaattcgccaacaaaaaaacacgggagatcgatcagtggatcacaccattttccaacgccggtgggaagctgccgctgctcctgtttgtcattagggtaggcccgcgtgaatgatagatagtactaggaaggaagctgtcatcgctgatgcggcgaagagatcatcatcaccgccgcgtccattgtccggtggggtggaccgcgtccacggagacggaggcctcgagccgtcgagcgcagatggaatcaaaccttccccaagccaagccaggaaaatccgatccacccccgacctcctccgctttcacgcaggtcatccatcccaccaactcctcacctcttcctcctccgaagcaatccaccaccggtcaattactggcataaattccaaataaaatacttattcaggttgcatattcataattccttatcttttaaataatgacacggtttactatactcttattatgatatatccaataaataaacatatttttatttttattataacattttgtaagacaaatctatatagattgttttagtgtctttaaactaaatatttttgaagttattaatagttaaagttataaaagtttagcttttaaaaaagtcaataattatgaaaattgatgagtaacactgctactccttttctttttctttataaaagtcaagaattatgaaaattgatggagtaacaccgctactctttttctttttcttttacttaaagaaaaaggaaaaaagaaatatatgcgatattggcaatttggcatcccagcgacagctataaaaggcgctccacccctcgttagctcaccagctctcccccaagagctgcttacctaacatacttttacaactccaccattgtccattgccaaaggccttcgatctcgcctcccagatctgccccgcgtcggcgaaggttggttggaatgctctctgttttcatctcgtttgcttgcttggatgtttctccccgtttgctggtttgccggcgaggtgttcgaccgattgattggttgatcgtgttgcgtgcgatgcgagcagatgaagatcaacgtgcgggggtcgacgatggtgcggccggcggaggagacgccgcgggtgaggctgtggaactctagcctggacctggtggtgccgcggttccacacgccgagcgtctacttcttccggcgcggcgaggcggcggcggcggagggcgggagctacttcgacggggagaggatgcggcgggcgctggcggaggcgctggttccgttctacccgatggcggggcggctggcgcacgacgaggacggccgcgtggagatcgactgcaacggggaaggcgtgctgttcgtcgaggccgacgcgccgggcgccaccgtcgacgacttcggcgacttcgcgcccaccatggacctcaagcgcctcatccccaccgtcgactacaccgacggcatctcctccttccccatcctcgtgctccaggtatccaattctcctccattttttctcctcacgcgtagtaggaatctactattctatttctaccgccaccaactcgatcgcttgcctgcgggcgacgacccggtcagcgctcatgcaattcaattgctaggtgattagtggctggctgcgtcatgccaacaattttcttttcttttttggaccctatcaagctctagcttagaccgagtgaagcctccattcatggtgccaaattgccgaccaacctacctatgtgaattatcgaaacacgtatgaatttttagcatttgtaggctttttttaatatagggatttttcattaatttattcctggtatgaatcgaaaagaaaaaaaatcatacctgttgcagaaaacatttgttagtactggaattttctatggaaatgattagctttattccttagaaatttcctggaatggccacatcagctctctgtttttataggccttctattaatacatgtctcatgtcaacgattatctgagtacggtaatgactaatgattggcctgcgcacagttgaaccctgtcattagatcccatcaatttggaacatatgaatttaaaagatcttttgcgggaaatttaaaagaaattgtacagcatgaaaacaacctagccgtgtaattgtttggttagaaccatatattctgacagctagacaagtcgaaaactaccctgagaattggggaaggtgttctacctacttgagtccgacttctcgctgttgttgtgacttgcgagctatcatcgtttcttttgtcaaacatgaaagcgaagtagcgaaccaattgtttgataagattgccagatcatatttgtgcacagcctcacaattgtcacaactgctccagttggtacatcatcagcatccacatgggtgaccccctgacccggttgagatagagtgagcttaagggtgtgttatagttcctgaaaaaagttggaagtttgaagaaagttaggagtttgaaaaaaaagttggaagtttatgtgtgtaggaaatttttttatgtgatatgatgtgatggaaatttgggaatagggggaaactaaacacggcctaaccaaacaacaaaatgttagttatttgctggacatcttattcttcggatgcacgacacatgttggttgaaagacaatgatgtaccagctagaatgtaaaaaataaatgtttctttgtctttgctttgtgctagcaagcaaaccttaatttgattgatcgttccatatagggggtgtttagatggggctaaaactttttagtacgtgtcacatcgaatgtttggacgttaatttgaagtattaaacatagactaataaaaaaactaatttcataaatgagagctaatctgcgagacgaaatttttaagcctaattaatccataattatgaaaagtttactgtagcatcacattgtcaaatcatggcgtaattagactcaaaatattcgtctcgcgaattagtccaagattatggaatgggttttgtaattagtatatgtttaatactctaaattaatatccaaatatccgatgtgacaggtaagtccctgtttactaaacaagcccttagtctgcccttaatcaggttctccagctgtatattttctgtctaggctccatctatgatcccataattgagttcaggcaggtaaggtggtctgcaacatccaagttggcttgccatgaccgagaccttgagtattattctaagcaatcattcgctcatacggagtacacgtttagtgggacagaggaagtacgttgagatacaagaggtcaaatgaattgcttctagacgattggaatttaatatggtaacgttagttgaactagaggtatcttagtgaaacggtaggtgcaataaagaagttgtgttttcccttaagcacatggtgctgtgtgatctcgtccttttttttttccactctaataatgctcaggagattaaagaagtctcggtcacgtataactctgtaaaaagaattttgtaatctttgtgaaagaacagagcggttagttaaactttggcgccattttgctccaggtgacccacttcaagtgcggaggcgtcgccctcggcgtgggcatgcagcaccacgtcgccgacggcttctccggcctgcacttcatcaactcgtgggcggacctctgccgcggcgtcccgatcgccgtcatgccgttcatcgaccgcaccctcgtccgcgcccgcgacccgccggcgccgtcgcacccgcacgtcgagtaccagccggcgcccgccatgctggcccccgagccgccgcaggcgctgaccgccaagccggcgccgccgcccaccgccgtggacatcttcaagctgtcccgctccgacctcggccgcctccggtcccagctgccccgcggcgagggcgcgccgcggtacagcacgtacgcggtgctcgcggcgcacgtgtggcggtgcgcgtcgctggcgcgggggctccccgcggagcagcccaccaagctgtactgcgccacggacggacgccagcggctgcagccgtcgctgcccgacggctacttcggcaacgtgatcttcacggcgacgccgctcgccgaggccgggagggtgaccgggtcgctggcggacggcgcggcgacgatccagtcggcgctggacaggatggacagcggctactgccggtcggcgctggactacctggagctgcagcccgacctgtcggcgctggtccgcggcgcgcacacgttccggtgccccaacctcggcctcaccagctgggtccgactgccgatccacgacgccgacttcggctgggggcggccggtgttcatgggccccggcggcatcgcgtacgaggggctcgccttcgtgctccccagcgccagcggcgacggcagcctgtcggtggccatctcgctgcaggccgagcacatggagaagttccgcaagatgatcttcgacttctgatcctctgaaatcaaacaacacgtacgtacgcacgcacgaacgcgcacatgcatggagaggaggcggggtggttcttaacacagcctatcatcggtaggatgcagcaacgattctttgattccacacgttagttcctgcaaatttttcccttcctgccttcccgcttttgggcaggacacattttgtgccaactgtatttgtattgtgaacagttaattaatccgtaaacattacgaaacacagagggttaataaggttaatcacggtggtttacttcgcctatcagtttctcaagtacagaaatcgcaatatgcaggattgtctgcgataccgcatctgcaacagctgccgctaacttgtggaaccgagtttacctgtaattcactgctactacagatataataccgcaaaggacccatgtatcttacaaacagaaatggtcttcgtacccaactacagcattccaagcgaggcccaaatgaaccacatgcatacgtcatacgtggccacgtgcgcggccaacgtggcgatatgggaccggagttaggctgaattccagcggccagcgctcaagtcacctatcagggcgtggaaaaactggaggcttgagggagtaggttgagaagacgtgaagcaactctgagggaaggagttggtgtttggtggtggtcagtaggtgaggattggagtatggacccgattcattgcgatttcgtagccgtcgtatctcacggattatctggcaggtgtgtgcaagtgtggaagcaaccaaaagacttcagctggataaaaagggacaagggaagcactaatcacttgggctggtgagaatgagatcaaaagtgtcggtctagctcaagagtcttggcacgtagaactcgtgctcatcgtcggtcaaaatggcaccaaatggtagagccaatttggtgtaggatttgtaccgcaaggtacagggtgagcagtaaggtagaactgttttcagacaacgtgcatctcacttgtcttattaaagaagatgcgtccttatcagaataacagttattgccctgctctcttgaccatctcaatagtcgaccaaacatcatgctaaacccggatgcagtacagcagacaaacagtagtacgtgggtatatttgtggcagtacacgtgccaatgtggtccaagtggaatcaaccgattttagcgggaataaccgatgatctttgtgtttttagaacgcaatacaaacgaaaaccctcacaatacagacacacgcgcactctatccctattgacatcttaaaaagattatgctgacatatcttgagattaacgaagttaccataagcactcatgtcaaatctagtacatgaatccaaattgattggttccaccacaagaaacctaatcagttaagctgcgctcacttcgctttatctttttgttgctcatcattagataaatgaaaacaacaagagggcaactcttggctccatgtgtaagggaggataattggacaaaagtgtgttgcaactcattggctccattgttgccttcatcattgccaccgtaccattaattatttttagatcaaaggctccacgcccagctttactaacaaagcataacaaggttcgatacagaaagcgaaaaggaaaagataaagaacagaaaaggaaacatgacacaattggggttgccaacttgaaacagaagtacagatagctgaaagtgactagcccctcacacagcccaggaaactaacataaaggcacacgatgcatcgcctggagccaaaaccatgttgctgacttcgctatctccctacactatcttcttcctcgagcaggaccctgagatcagcctggtcttccctcttccagctccttgattcgagcacgcagcgagtccttgaagggctccacctctccagaaaatttctgtgccaccaagggactccactgttgcagcaacattaccaccttgtgagccatcaagtaatgcccgaaagacatttattgttaaaaacaaaatcattcctcacaagccaaataacccaacaaacagcagagaaaatgcaaatgtagaacaaattgctcttatgccaggatctttaagtttctcaattagctcatttcttgttcggggcacataactccaacctaagatatctctcagacaacaccaaaggaatctagctggtgtgcacgcaaaaaacaagtgatccactgactcaacttctccacaaagcttgcactgctgatttccaggccatttcatctttttcagttgttgtgctgcctggattctccctttcagtatgagccacatgaaaatcttaatattaagaggaatcggagccttccaaaattccatcattctgctatctctcacgcctccaaaggtcatctctctgtatagtgatttagcagaaaatacaccagatttagttagcttccatctcatcttatctctccccccattcatttggaactcctataacaactcctgcaactctgttcactcttctaactccaactctgtcaaggtctcctaagatttatcacccattcacctgagttgtgcacttgcttaactgtttcattatggttggagcacgctttataaattgcagggaaagtaactttcaaaggcgcctctccagaccagacatcgttccaaaaactagttgaattcccctcaccaatttcataccagctccctagcctcaaccaatgtttcacagcatgtaaacctttccaaaactgagaaccaccctcttgtctagattgaaagaaacctccctccccctcattgctgcaatacttcctgtgaagtagcatgcaacaaagatcatcttggccagattcaattctaacaatccatttacaccgcaaagctgcattcatcactctagtgttaataaaacctaaccctccaaactctttgggtctgcataaagcttcccatttcaccatatgatacttcctcttattctcaagaccttcccagaaaaaacgaactctaattgagtccatcatctggtgagtagtttctggtagcaagtagacacccattgtatacataggaatagaagtcaggaggaattcaccaagattgctttccccccataagaaaggtgcccacat

SEQ ID NO: 46868 - DNA, 17681 bp, Oryza sativa
tcagcaaattccttacaaacacccaataattcctagttttctctagggatgactgggtcgggttgtgccagcccatgggtccatcctaattcgtttccatgcaaattaactcaaaaattactaaattgaacaccgtttggtccaggtgtgaagtaaatgggattcccacaaacatccctagttattccaattgtgaaacctgtgactaatttgtcatacttatttgcatcaagtggtattttgtttgataaatttgtgttactggttgtttcaagttccccgaagccacggggtaggggcagaaaaggaagagggagctcagtgcaattgaaggaaggaaatgcagaaacacctaaaaggtaatttggtaatcaaagaagcagtgtagacaattgactacatattttctgagacttatgtttctgtttaatggcagtggtggaggcgatcttcccaaaaaaaggggtcgtccgaaaggttccagcaatggtacacccaaaagtaacatctcggcaacttcaagcaaatcaaaggggaaagctgcaaggaaggatgaaaatgagacacctaaggttggcagtgaccttaagaaggaagctgaagaaggatccgaagacaaagccactaagtcaactgagaagacaaaggatgatttgcctgaggatggtagcaacaagagtgccagtaaaccaaaggaggctagcagcggaggcaaggatttgaagggtgagagcaaaccaagtgaaggaagagccaagccaggtcgaaagccaaaggttgccggtgctgcggtggctggtgaggaatctaaggccaatgtctcagctgagaaagagaagcagaaggaagcagaaggcgaggcagcagctgaagtggagcaggggggatctgctggtggcgcttctactggaggaaagaagcgcagaaggaaggcttgaagttagggatccgctggtggcgcttctactggagaaaagaagcgcagaaggaaggcttgaagttacccgctaatttctcttgtacatggattcgctctctagactcaaaaggttcgcttagtctcaaaaggtgttaaaacattgcaccctgtgtggttgtaactcttcggtcgggtgacctattggaatgccaactgattgggcatgtagcggttttaactaggggttgtagacaagataaaaatgctgtagttgtgatgttaggcgcaagtgcgcaacttttaatggttggttgaaccccatgcttgccaagaggccaatgacatcatagttgtgtcggatgatgttgtagctagcctgttgatgtcttatttatttacgccatatgaccaaatgacttttgtaactaatgtgccggtctgtcagccctgccggcaccattaagaaatcctgtttttcagagctcatattcctatgcgagtagactatacattatcttctcttttttttttcgcctatagactattttgggagatcatgcctattgctaactgctttttgtcatctctgcaggttgttacacaactgtaaggtcgactcattgtgtttatcttggcatacttaattctgtacttatgttattctgttcaacgttttatatatgccagtggaagcagcgatctccctgtcgcagattgcaaccatgttgaagctgactacggcctggctaagctctgcacttccagcattatccatgagaggtatggctaagccttaaagctctactcccttcattcaaaaagttgcacatgttactttgttactaaaactaaaaagaaattaacttatcttacatgtaataaagatagttttaagatagttcattgagttttgatcaaacatttaatatatctcttcatttaaatcttagatacatggaggactacaaatataactaacttatttggaaaaaccaaaatataaaataggtacatttttaatggaaggagaaacctaaagggccactcctaattacaattggaattggatgaaaatcatttatatcatcgataaaggccagcgtaaaaagttatcacaacttatagagattgcatgttgccacttcaaccttaaatgtaaagcatttctttagatttttcacaggaattaaggaattagataggataaatgaatggtgaaaggttatgattgatttagaagagaaagtaatagaaaaattaaatagggatagattggttaagatgagaggatttggcgaagaaatagttgcattttaaaacaaatttgtattctagaaatagctatattttagtcttaacagtggtaacaacaagccaataacagtccatgtaagaattggcccctgtgcattcgttcagtggctatgggtgtgtttagatcccaaaaatttttggacaaaaatagacatcaaatgtttggacacatgcatgacgcattaaatgtggaaaaaaaatcaattacacaatttgcatgtaaattgtgagacgaatcttttaagcttaattgtgccatgatttaataatgtgatgctacagtaaacatttgttaatgacagattaattaagcttaataaattcgtctcgcagtttataggcggaatctgtaatttgttttgttattagtctatgtttaatactttaaatgtgtgtccgtatacttaaaaaaaaattggccaatgaactaaacatggcctatggaaacaaacgtctggaaattgaggttcagattactgcatagtgcatacccatgaggccacacggcttgttcctcttcgggctagtgggctaccaagtccatgacggcacgaccattatcaactagtattgacttggtcggtcgtctcgtcgtctcctctcatctcatgccatagcggaggcagacactaaccaggtcaactattccattatttctcccaactatcccatctccaagtcgacagaaaagatgttcagtggtcaactaacacgttacaagatgaacgtcacctaatttttcagaaacaacggcttatgatttcgttggtcatctgggaagcatcatcggtcaaggggttaggtctaaactgttcagtttgcaatgtttcagtcccctactggtcaatttgacactagtaaactctatatatcttcataagagtcaactgaaattggaattgaatctctcttcaagccgagacgcgatagcgggattcggcagctgtccatgtctagtttgcaatagatggtcgccgtcgttttataacggggtcatgcactgccttgcgccggtcaaaaacgaaaagaacacggtctcgtcagacaagaaacattgtgaatgttatccgacagtggagtcgaccaggataggacctagtaagtgcgatgcttgatcagctcacctcccttttgcaggacgcgtcgttttctttgcacaatttttcgtcgccccgggacccgggtgatcctatcacctcgcatgcctcgcttggatcggcaacaacgcgtgcgggatgtgccatttgagtcccagtttttatccttgatgatgaggatgatgattcagctagcgtagcgttgttaacttttccgtcctttgcagagctgtgaggctgcctgaattcagccagaagaaacgaaggccatgattgagctacgtgcctaacatatcctaggttagtgcatatcatctctttaaaagttcaatccaatattttttatttgcggggaagttaaatgacaaaaaggccgtgctttatgggattacgagcgagaggcgattctccagtaaattccgcatccgctggtcttccggaactgggctaactgtgaaccgccctcccattagagcaagtttaatagtatagccaattactagctccaaatcatctataaccaatgtaatagctaattcatacaatagttgcttactactcctttcgtttcacaatgtaagtcattttagcatttttcatattaatattgatgttaatgaatctagacacacataacatctatataaatgtgggcaatactagaatgacttacattataaaacggaggaagtatattattaatacatggtttcacctgtcatacacacattacgtcttagagtccgtgctgcaactggctacagatctgtagcccgctgctcttctatctcttcttttatctctttaaaatatgcttatagctggcttataccatgctattgtacctgcccttagcgccctgtagttatacttatacaaattctttgggtggtagcactagttggactcggcaatgttggagcttttcatttctttttaaagcttggaactacgtagtgccgtggtgcgcattggtagaacggggagtggttcgggatcgtgggggctctccgaccgcgtgcaacgtgccagtccaactccaaccgacccacacaaacacaactttctactccactacgtgaccattacaaggactcgtaccccgtcctcgctcacttgggccgttcaccgcgctgccacccgagtcggcgagtcgcggagacgacgccaccacgcgccccaaaagtcccccaaatccaccaccgctcgcgccgcccccaccgtaatccccaaccccgaacgccactcccccccgtctcgcgtgaaagcaacggccgcgatacccgtggggttgggtgacgtctcccgcgacccgatcaaatcctccgccggttcacccgcccgccacctgaaggcccggcacgcgcgcgagcccgtttatacgggaacccactgcaaaaacgccccgcgtcaccactgcagccgcgcgacgcgagggcgtggcccaaccccaaccccaaccaaaccaaaccgtcgcgcgcgccactcgctctccacctccccgcgagtgcgaggccatgaaggggaagcggggccgcgtgcggctcaacgtcggaggccgggtgttcgaaactatggcctccacgctcgccagcgccggccgggacaccatgctcggcgccatgatcgacgcctcctggaaccacggcggcggcggggacggcgacggcgagggtggcgcggacgagtacttcatcgaccgtgacccggagtgcttcgcggtgctgctcgacctgctccgcacgggggggctccacgtgccgccccacgtcgccgacggggtgctctgccgcgaggcgctctactacggtctcctcgaccgcgtccgcgccgcgcggtgggggccgttcgacggggaccggctgcggctggcggcgtccgtggccgggagcgccgcgggcgacgggacggccgtccgcgccgcgcccgacggcggctgctgcgtcgcgcacggcggcgccgtgcgcgtgtacaactgggtgatggaggagcgccgggccgtgcacctcgaccacgcgccggtcaacgacgcggcctacctcgacgaggccacgctcctcgtcgccgcgcgggagaggcccggcaccggcaggcgcgacggcggcgtggcggccttctccgcgctcaccggcgacctgcgccaccgcttccgcgtcgcgcacgatcgccacgtcaggtcctacacccccggggcgctcgccttcgacagccggtgcaaggtcttcgcgagctgcaagggccggttcaacgagtacggcatcggcgtctgggactgcaccaccggcgagcaggccgacttcttctacgagccgccgggctgcgcgctcggcgacgccgacaagctccagtggctcgacggcacgagcacgctcatggcggcgaccatgttcccgcggacggactcttccttcatcagcctgctggacttccgggacaagaagaacgtcgcctggtcgtggtccgacgtcggcacgccggcgtcgctggaggacaagcacgtgctgcacgccatcgcgatggaggacggccggtcgctctgcgtgatcaaccagtacgacgacctcgggttcctcgacgtccggagcagcggcggcgccggcggcgtgcggtggaggtcgcggagcaagctcgccgccaggaagaagaaggcggcgccgcgcggcgaggagacgtgctacccgaagctcgccgcgcacggcggccagctcttcgcgtcgaccaacgacaccatctcggtgttcagtggccccgaccacgtgctgacgtcgacgctgcggggcagcgacgccggcgccatctgcgacttctcgatcggcggcgaccgcctcttcgccctgcacaacgaggagaatgtcgtcgacgtctgggagacgtcgccgccgccgatcatctgacctgaccatcattgggattggtctctgtaacaagagaggagtgacaatgatgattaccgaacactactgacagagaaactggcagagcaacacgttgtaacttctgttatcggtaggagtaaaaagttcacgtgtcatccaaatggcaaaattggagtttagaaattacacattaaattagagaaaaagagatagatgtgcactgtttgatcgcggtgagtcgttataacggtgtaatttatcgatatgcttgtgtacaatataaaattaagtttatacaaacaaaaggaagggtattaaaatctaattcaacttatttttgctatgtgctgtgcggggaaaaaaactgctaattattactaaaatgttttcctagtaattactactagaatagagatatcagtggaatgctgtcattttcaagaatcagctttgtcattatcctttgtcactcctgttcaattggttgtgatgttaatgatcaccaagcaacgattgttgttgctgagccttgatacatcagtagtcaatttttcggtggtgctctgtcaaaatcattttcattttcaaactgttgtgtcagatagttgccggatgtttcagggctacagtttgcaaatatttgagggcgaaagatctgctctccactgattatgatgccccaagatgtcataatcgtatcacaccgtgattaacttgtctgtttgtaccttttacttgcaaacctgcttgctatccatatctgcgagtaaaatcgaggaaagaaacaaaaagcagagtagaaaagagagcaagaatcgaacatatcttgctcggatctctctgttttgtccttctagtatatttgcctactccttggcctgtcctcattttccgaactagccatcttttttcctaaaagaacctgcgctagattcacattaacaacctcacatttgcattctgttttctgcttttgatgcaatccctaactaactactgtattaagtagcaaacatatcacatacggatcgaggtctcgagctctgtcaccactgatgaacattctgaatatgctgcaaatcgcaatgccgttctctctctttcagcaatgaccactcgtccaatttgaagcaccgttgcagcagctggtggttgagcgtttcgcttcagagtttggtacgtagaaaacaaacaaacaatcgaacaaacgaacagacatccgataaattttctcacgacatgctttgacttgaaacgtaaggtaaggcgaatcaggatgtgcagggagatagcttcgttttcagtcgtacctactgactactgactgaatgaatgacaggatgagcttgtgtcgagtgtgtaaagattgcaagaaatgtatatttatggttgtgtggaagttgtttgcacatatcaatctttgttgtttcgtacgcagactaactactactactacaattcatctggtaactgcacaacaagagtaaagagctgcagatcagagggaaaattgccaggacaccctcgaagggaaccttgcaagtaagcactaagcagtaacgtgtgtggtacccaactacccaactaggcctgtgaatctgcagaagtggttcggaattcagaacgagaagcaagtgaatctgttgctcgtcggttgtaagttcagagtactcggtgtgtgcaacattctagcgagaggggctggtgtcggtcggatactctactagctacagtgattatgacatcaaagtacgtactaaacctcgtatatactattcaaggtgtactttgctggaagcaaagcataattggatcctaatgattgcttcagtaaagtaaaggtaaagcccgcaagttggccaaaagcttaatccggaacagagtagtactaaattctgctagtaatcgtccggcgaaaatttgtgctagcaatgaaccgtgagcaggtggaagtccataacgcatggtacaactgaaatgggtgcctcggtagtccacagcaaccaactgcgggttgaataagtggcctgtggccgccttcagagtttcagacaaaccttcgtcatcgtgcacacgcacgtagcttgccctgacatgggtttaccctgttcgaataagttcacatcaggtcctcaatttgtcgccaagttcgaaattcatccccacatcccctacctacaaaaccatgcaaacgaggtccttcagcactattgtccccggttttggctatcggtggcgcctacgtggctctcttgacgcggcgcttacgtggtaattcaatctgaaaaaataataaaacccacgggacccacatgtcagtttcacacaaaaaataataaaattgttggggcccatgtgtccccacatgtcatcctcactactccactcttctctctatcctctctctctcgcaggccaagcgagatggagcggcggcaggccgcaggtagagcagcaggtcgggtggatgagaaggatgtcgccgtgttcatcgacctcgccggggcgggagaggagatgcaagcgccggccggcaggaagagaggagccacgggtaggaaaggagacgcgagcggcggccagcaggaaaggagtcgcggacagtggccggtgggagagaagtggcgcgcagtggctggcgagagaggagtgatgcgcgagcgttgaccgatgggaggaaaggagtcgtgggaagcggccgcttctccctctccattccctctcagatccctgccccctcggctctggctctaccaagctcaccgcccggtaaggggggcggagagggaggaggctcacccctcgggctttgcctatggctcctctcctcccgccggccagcgcctgcgcgccgctgctttcccgtcggagagaggggggtagagataaaaggagagagaggatagagagaataggggagtagtgaggatgacatgtgggctacatggacctaccattttttattattttgtatgtgaaactgacatgtaggtcctgttttatcaatttttcggatcgaattgccatgtaagcgccacgtcaatgccacgtgggatgaagacctagtcaaaggagccacatagttgccacgtcagccaaaaccggagtataatactgccaagggatttcgtttgcacgattttgtaaattgggggatgcgttgtatccggttttgcagtccatggatgaatttcctactcggtgacaaattaagggacctaaagtgaacttattcctcaccctgtttccccgtgcacacagctcgtcggatcagttcacagtggatttgccggctgcggcctgccttgacggaataggaggcgccgcaaagatatggcagggttgggtcttaccgcctcggcctagacccgcgttgcggcagggaccgggaccaccgggtagctggatggcacgcgactcgcgctcgtgcgagcggccaccgcccgtacgacatgcggtgcgtgcgcgcgatcgccaggttttctggcgaggtgagcgttacctccgcgtgagctcgcgcacgcagctcagttcggcacgtacgcacggcttcccctcggtggatggatctcggcgcgcccggcgttagctcgccgaagcgcaacggcccggccggctacgctagatcggcaagcgcgtgtgcgtttggggcgtccgcatcggacgggtgctgggtgcaacgacgtgcggcatcgcgggcttcctgaagcgggcaatctttggatgggctgcgaaaggcccaattagaagatttgggaggcccccatcttgctcaattttccatctgacccacgacgacagttatatatgaataaagcgaagggcaacagttatcaattttccgttgaagaatcggagcataccacacaatcttataagtttcaggtcaggttatatttttctttcttagaaaaaaaaaggagcatactgcatgtgcatccttaatactacacacttggaatttgttaagagtaccaaagacaataagaatgtggtaatgtatgtacagaccaatagattacggagtatatgtgctgctaaaatcgggagatggtcagttctcaaatcggggacacttaaacgttgtttggagctagtgagcagacagtcgcacgtccaggcaagccacatgaaagctgccagatcaggaaacatttgggtgggtggagagataagcggcgtaccaaataggggtactacacatctggctcactccacagagataggaatttatagcggccctaccttttaatcattgtacacaagacatcatgttttgaagggaccaaactaaagtagtgctatgcatgtcttcagttaagacagagagatctagagagagaaagggggtagatatcccgctcagttaatggctactgttgttggcaatagagagaggtgaagaacgtataagaagacaagaaggacgacgacaattctccgacaccagtatttatcgtgccacatgaaaataataatgcataatgttttttttgcactcgtacagtacaccctctttgtaaatagattttaaactctcgagaaaatatcctctcacatatcatccgaatagttataaaaaaaagataacatagatagattaatatgtgatatatcactctaaaacatataagttaaattctaccaatacaagttgcaacaaaaagaacaaactaaactatagcttgttaacatacattcacagtcaaatttatttattatgttatgaattataggaagttaaattcgatcttatatgtttgtgaagtgatacatcttatatttatctatcttgctagtttttctaaaataaatatataaccatttaaatgatatgaaaatcgagggaatattgtccactcgagagtttagcatcatttcccatcttttatctctctcacctccttctgtcgatgtcacattacggtcatttgtgtagtgtgtgggagctggagactaagggtttgttaggagctggaagccagccaaacagtttcagctccactaaaaaagaaacgaagctaggtgtagcgctctcacaaaatgaactagagaggtgaagctgggtttaggctgttccactccagacccacctccttgaagttcgagctcgaccaaatagaccataatctgagaggcagctatttaagtagacacacgatgagaatcagaaaaaaataatgatgatgttaatgttttatattttaaatcctactatgtgaaaatatatatattaatatttgttatccaaaaatgaaactagtagtactaatttgttatgaaaaatacattcatattgttgtattttcaactactttcacaaattcataattagaaaaacaatggtaaaatatgtacaatagaaattgtgtcaacgttataaacttgtaaataattaatgagaacatgatttttaccaagcactagcgcatatcatattatcatctacaggctaagcaattaaatatgctttactacgatctactagtatatatgttaccacaagcagaggaatacaatattgtatacgttattaaaatccgcgatgtatgcttgaatttcaaaacaaatacagtactaaggctgtgtttagtttttgaaattggggaagaagtttggaaaaaaaaagttagaaatttatgtgagtaggaaagtttttgatgtgatgtgatataatgaaaagttgggagtttgggggaagtttggtgtgaagtaaataggggctaaatggactacaggtacacttgcacgtcacatgcattggactttcccgactaacggacggagctagtacgagactacgagtcaggactcaggaaggtacgtacgatcatcacttggcccggccccgatctatcgtgtcggcacggcatacgcaattaccgcatacgccggtcatcacaaacacgcatagtacatcggtctctctttgtgactttgtctcctcttgccgtctccacatcgtttcctaccacgcgcgcatgccgcatgtctagctcgatcgctataccagctacgagcggcgcgcgccgctcgcgctctgcatccatccatccatcgaccgacgaactgtcgccggccggcgcgcacgcaggtacgtacgtacggcgccgcatcgatcgtacgaattaaggtctcgccgtcgatcgatcggtcggcgaccatgccatctactccccacaaaaaccgatcgatcgatctgcagacgtgcggccaaatgacagctcaagctagcgatggaggagatggatcttgcttcctagcttaggcgcatgcagtggcagagggcgcgcagggggggccacacagtgtgtgtgtgtggtggtgcccacactacagcgagctacggaccgaccaatcacgcgcacaattaaagtaaccctgcaggggccaaaaataaagattggcaaaagatactgtgccaatacacctgtcgatcgaatagtagctagctataggagagagtggagtacatgcatataccgtatagctttgcattcgtataggttagccaattattttgcgtctctagctttgcattcgtataggtatgcactactttatgctatataggctcgcacatctcacaacttggttttcaaaagagttcgaatcgatctcgctgagctagctatagctggtatagttatctagctactgtatatgtctcagaccgccgttcaaaaagcggcatggtggtgcatggaccacgcattgcatgcacaaaaacaagatcgatgcatggagcacgaaataggaccacacacacaaacccagcacgacgcatgcatacacgctgtgcaaccggtggaatccaaaatataatgtatccatatgttattcggtcaatttggtttgtagagtagtggtgtggatatagtcaattaaaggttttgggttagatcggaccagtttattctcgacacatagatcgtttatgaccgtccagttagaaatttattatatatatattgaacataaagttagtctcgtgacaacttaccttatagtagcatgtggattcaatatttaactagcaggaactgtgacatgtatcccgcaagttgtactttttatttaatacaactagacatatccaatctatcaacgacacaacaactaccgaagattgtcgaatctaagactttctctacatgcattaaagtgttatttaataatatgtctatacattataaattttcaaatttgaaaaaaagcaaccgggaaccacgacacgcatctcgcaagttgtaatacttttctatttaataattatacatgtatagtctaccaacgacacgccagctatcgaatattgtcgaatctaagactttttattttttatatgaatctaagactttttcttcgtatattaaagtggttatttgataatcatgtctatacactattacaaatttcttgctttggaaaaggcaaccagaaaccacttcatttgtttttctacatctggatcttgaggtgatattgtaaggttgagagtgggtgctgcttggaccaatagtaagttgtgctgcggggtcaagagcgattccatgccatttcgagaaaataaaaataatctaattaagccgtttgattaacactgaatttccaagatcgaagcctacatggacgtactagggaaataaattggtagtcttaaatagagagggggtaccacaatgtaaccatggcgactataatagagcgtagacacgcagagagatgatggcggcgaggccatgaccggactcatagcggttagaagctatattggttggggaggagcgcccataatcagagccccagggatgtaggttttggctgaacgtcgttaacaaatatcgtgtgttcctgtgtcgtcatctggcatgtcttgggtggtcaatgactgaagcgattgagaaggttagtcgtcattccgctatattgactaacttttataacaggtggaataatatcagaattctgagtagtgatgctaccatgccttatttaaattctttaattctgcctccaaaaatccaaatctcactgtaaattggatggcaatttaaaatagcaggaagagacactcaaattccaaagtccttcacgcatgctccgagtagaatatggtactacaggggaccagaacgccgctgactgaccttctatgaacctagggctaggagcatgcatgcatgctatcacttcgatcgaaaagcacacatatgacgtaccaattgtaccattgcagattgttaattttaaagtacaagaggagcgattattttggtgttttaatttacaaatggagcggttactatcgtattaaagtacaagaggagtgattactattgttctaaagtacaagaggagtataaagtattagagtctgaggaggaggaggagccgaatttgtgatgttccaatcatgcatgcttacccctgacgctgtacactaagaaaaccaaaaccacattttcccaaaataaaccaccaaatattgatcctattcgcgagcacttagcgcgacatgatctaccttaagaattacaaaatcttcgtcgcaagatcgatcgtgcacagtgcacatgcgagctcctgctcacccggccaaaagcttcggcattgtgcagactaattaacaacacattatctgattaaccaatccactagtacatatagtacttaattaactatcattattggctctgctccaataatgtccctgcctgcatgtctcgcaaccgataaaatttaaaagcagggctgcttttatctttctgacgattaattaagcactcttaaattaaattaaacaatagattagcgaggcgcggccaatcacgagtcgacaaagagtggctctggcctcctgcctcctcctgctcgatcgatctcgccgccggcgtgttcgtttcctcgaagcgacgcgagcgggcgcggcttatcttctgggacagcgcgatcggtcgatcgatcgagctccatgtgaagcttaatcgtggccaattaggaacggaccaaaagaggaaagcctagaggaagaggacatttccgatctcggcactcgagaaccgtgccaaaggagaaatttgtggagctatacgacctcggcctaccaaacagcaaaggaaaaattgtggagctacgtgccttgcctaccaaacagctaagagcaggaacaagaggttataaaccagctataaatatattttaaagagataaaaaaaagaaaaaaaagcagcaggttacatatctgtaaccagttacagtatggactccaaaacgtagcatgtgtatgataggtgggaccaggtattaatagtatagtaagcaactattgtatgaattagctattacattgactctagataatttggagctaatagttgattatactattaaacttgctctaataagttaggagtagctcgtaattggaacgagcagctggtgtgtttactgttggtgttttactgtttgtggagttgtactgtgaacgtaaagctagccgggtacaattagttactacagtgcgagttgatcggtcagtgatgtttagatcccgggagagaaaacatttgtgacagtgaacaataatggaaggcttttgtcggcgcacgtgaaattatatcgtgatgatgttttcggatgcacacaactgcagcgcgtactagctactggagtagtagtaatgatgttttccgatgcaaattaacagtagatgcatgggtggctttgggtagccgacgaagagaaaggacgtgtttggttggtaactgaatttaccacaccacatctaatcttagataaattatatttttaagtagatggtgtttggtttcggttacaactctgacttatctaactttttaatcatctgacccaactttttttatctaactttgtttaagcatggtttatcattttgtttgccacaaaaatgtgacatgtctaagctaagtcaccttacttaaaaaaaatgtgtgacaacgttagtcctcaaccaacagggtcatagatagtcaatggactccctaatgttgtgaacttgtgatatagcattcaaggcgtcattaatgctcctaataaacactactacctccgtcccaaaataagtgcagccataagtttccgtgtccaactttgatcgtccgtcttatttaaaattttttatgattagtattttaattattattagattataaaatatgaatagtactttatgcgagacttacgttttttagttttttctaaaaaaatttaaataagacagacgattaaagttggacacggaaactcatagctgcgcttattttgggacggagggagtatatatgttaaaagttttcatgaaaaaaaatgctataggatttgtggtcttaatttgcatggacgaaaatgtgcctaggctcgaggacatctcaaatagtaaccgataatttgataatttttgcaatgatgcttattttttcgccatagagagagagagagagagtgagtgagtgagtatgtgaaactcctctagcagggaagctaagtactcctcatttgtgagtttcggcctgggtgtaagttctgagcccgagttttttattgcgtggtagagatgaacacaagcaaatatgcaggttcttgccgcatgaatacgtaataccctactcctgtgcagtggactatgcatgttcttaggaattacaaagtgatgtgggaagaaaaactaagtgaggaggaaaagctccttactcactggatgtttggctaacctagctagcttagatgagagcgcaaacattttgtttttcatggatcctccttttatatgtgaaggggagtccacaatgttgttgcatgcatgcaggagtagggtctactactctaaaattgatatgcttagtcttgtcgtttttccttccaagcaagccgaccggatgtggcaggtacacctactgactaacaagtggagaggggagttaaaagtcttcgttccaaatgtccctaggaccatccgtcaaccatcgtagccagtagaggtgggcccatgggatggttgttgaggaagtgcaacgtcgcatgccttgtgttcttcgggcgatgtgggcatgcaaggggttgcgtgtaccgtcacgccccccaaatagcgtatgagttgtacgccaatcttgaaccacctcacaattaatgtaaagtagtggtttaaatgtgattactggacccgaacaactttccttaatgagatgaaccccagcaaggagtgctcgggagaccctaattagtgctcaaggcccgagagactaaatgcttgtcatcggctggctgctgtgttcgggtcaacctgtgtcctcttggcaagctgagtccttggggcacccacccggacactttagagtgctcccattgccggaagtaaatttcattgttgtattggacgaattttcaaagatgtcgatgaaggagttcatgatgggcatgtccttggacgagaca

SEQ ID NO: 46869 - DNA, 4276 bp, Oryza sativa
tgggttgtaagtgtaactaatgcataacatgtttccttgcaaaagttgagttcttctactggcaaaatatgacatccagatttcacatcgatcaatccaactaattaaagctaatttagatatactgtattccaggtagctatatttctatataccactacatggagaccaaatttagatgtaaagttatgaatgtataaaatagatgggcgctatttctgcaagtgttgcaattttatttggaattttctatggctaattttcatcatgtataaatgtttggaggttcactatatatccagacttatgatatatatatgcgcccttgtttgtttaaacaactaaattggtttcttattttctcgaaattcatcatgtatgtgatacattgtggcaactaatcaaactattacagtatcattttttgtatctccatgtaagcttattttgaatgagtatcaatagttccaaacttatatatgcagtatttttttggacaccaaaagtgtctatatatggatatgtaatgttagattgaattgtgtgttgtgtccaaaaagatatcttagaatatcatgcttactctagttaaagtgatgatatagccaatttttgttcaaccaagtttggatatatagtttatgactagcgctagctagttcgtagtaccttcattcaaaagttgcgtacacatttttctgctcgagttccctcacactgatatgtctgccgctatatgcatgtttgaaccaattgttgtactatggtttctcactttcttgtatatatgctataccatctataggaaggaaatttcaattaaaaaaattacttctatggtccctcgcttcaatcgtatttttcttgcaagaaagtagatgattttttggtatatgattttgtatgttcatcattctttttgtcccctcttggagaaaacttgttgtttatcagaaaataaaacaattttatgcaaatatgaaacaaaatatgattctccaaaaaatgtatacatatgctgctatagaacaaacaaaaaaagaaatatggagtaccttacatgcatactgattcgatattgtataacatttgttatatttggatcactagctaacaaaacataacctataaaattggagatgtgtaaatataactaattttgcaaccactatataatagtatatcagtctcagtatgtactgaaataaaaaaaggacgcgtctacaacgagatcgctctctgtatggtcataactagctacctcaatctcatatctagttgctactagtatactcaaaagtgcatgtatttttttcttatggaattttctcttagattactcatccgatttacgaccccattacaccattgtgtttataacaattaaatctttataacaagatctcacatgactatattttcatgaaaaaaatacaaattaattttataatatatctaaattacttttagatttcattaaattacttcttagtcataaaagtaatttagtaaagcctgaaagtaatttagatatattatagaagtaacttaaaacaaaagtaaagtaacttgttacgacattaaaagaaatctatacattcataatgttattcataatattgtgagttgtttattttataatcatttctagtcagtgatgtaatttgtgttgattaaatgtaatttctatatagactcatgtttttacctctataatggatttacttttgatgttgtaataaagttactttcttttttttaagttactttactaatctatgtaaattacttttagactttactaaatttacttttatatgtctaagaagtaatttagtgaaatctaaaagtaatttagatatattataaaattaatttataatttttcatcaaaatataatcatgtgagatcttgttataaagatttaattgttaagagcacaacggcgcaatcggatcatagatcagataagtagtttaagagaaaatttagtttgaagtataggtggtttctatttgcttgaaacatagggataaactactctctctctctagcgtaacagagtgcgtcacgtggcttccgattcggtctgttctggccttctcggacagcacgtgttcaaattatgaattttactggagtattccaatctataccttttatatagttgatacccattagcaattattacaagccaaaactcaacatacaaatataagcatgtaagtattatgatagagtaagacccatcatctagaatgttatatcatagagttcaattacatacaagtatatgatcttcctagcatcattattatatattttaatatttattgttcctataatatttaacgtatagtcagccataaatatctcgtcacaaaacactgggtatcaccaagttgatattaaagttatgttcaaatggcacatgcctacggtttttcgctttgctgttaattacacgataatgtgaacgtcgtaatcttgattttttacataacactgcaaatatttggatccacttcattatgcaacaaaaggaaatttctgtatgatttcttattctataatgacctttgagtatacactgttcgatagaagcgtatgcatctaaaaaagaaaagggttaatagtaagtaatcaaggcgaatattacaattgtgtatctagtttgatgatatatatattggtcctatatatatatccatatcgtcacctacttgttctcctattcagatcatcatgaatttgttatactattcagatcatcacctacttgttcttatctctttgcagattaatgaatatggatcagatcatatcagattaatgtggcatatttattctttgttggtcttgaagtgcatcattaaattataaatataaatatacacagtatgttcattagcttagtttgctttaaggttctcccaatacccgtttgctttgagattcataaagcaagaaactagaagaaaatggacgatggaacattttattttatttcaccgactttgtataccacactaaaatcattttttttctattaataatatgaagttcgattaggggtgaaaaaacgaagctcgtgactcggattgagtcaaactcgtagtattaacgagtcgagccaaactgatgagcaactagagataaaaatggagcctctgagttgccatgggtttggatggactggtttcatcagttgttaagtgtgcgcgctacacgaaatcggtggatttctcaggacagtagatatgtgatgactgcactatcgtcatatttgaaaacggaagtagtaatcggcccttgcttctgtgcatttatataaatacaaatatatatctttttatgcatagcaaatatagttatcaaagtggtattataatctgactaacatgattaaatagttcaaatctcttttttcttctttaattaacgtgttaatttcattctctaccttatgagagtggtattacgttccttttctacgtctcctaaaccttgcaggcttgcagcctgatcatttctagctcaagtaataagtgatggatatcaaattaatgtgacattttcgtgagttggtttgaatggcaaatactccgtcagaaaataaacccaacctggctgacaactctatcggcacatcacggcgatacaatgatcgaatttggaattttttttcggttttagattttttttaaatatttacagaaataatctatcggcaaaaaaattacaaaaataggccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggccattttgcaggcggccccttgccgccctctggccgggcggcaggcctcgctgcctataaaaggcctgccgcccagcccctagccctcattcctccctcctcaattccagtgaaaaaaaaagagaggggaggagaagagaagaaggggcgaagccctgccggattcagacgccgatttcaggtaatattcatagatcctatatgtgactattgagttaaatagtgtgtattttttaaaattttgtttgaataaatgcattatatttttagggttttagttgtactaatctagaagtgcgtattgtagatatcggtaactacgtagatctgctagtttgaaatcaatacattaccgttgcatgggctgcaggaa

SEQ ID NO: 46870 - DNA, 5886 bp, Oryza sativa
ccgttgcattgggttacacaagaagatattacgttgtagatgtttattgcatgaaagagtaatatgatctagttatttcgttgacagatatgtcgaccaaacaaatattccaagtttaccatggaccaggaaacgtccgttacgggccactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgaatgtggagatggtatttggaaaatgcattgcaacgcgggtggcctctagctttggttccgtttgttcacccgaaggatccaggtgtgcagatgaaaatggatgatggcgagggaccaagtgctgaagtaaatgagacttctgtggaagaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggcttatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtctcaatataaagttcggtgtgttaaggaaaaagatggttgtccctggagagtgcacgtgtataaggggaaatggaagaattattggacagtgtcagtcgttaccaagcatacatgttttctacctggtgttcagaaataccacaggaacattacatgtgcatttgttgcatctgagatatatgcgcatgtcgtcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcatttgtgaactgttgtcctgttctctgcattgatgggacattcatgacaggaaagtatcggggccagatactaacagcaataggggtagatgggaacaatcaggtattgcccttggcatttgcttttgttgagagtgagaaaccgacagctggtactggttcctgaaattggttgaaacaaaagttgttggtatgaggccaaatgtgtgcctgatacatgataggtacgctggcattctgcgagcgatagaaaagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaaccagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcaatggattctgcatgaaccaaaagagaaatgggccaaggcgtatgacacaggtggtgctagatatggaataatgacaacaaatttggtagaagtttacaattgggtgatgcgcggtgtccgtggactgccactagttggcatagtggagttcattttacatgggacatgcaggtattttagggatcggttccaggcagttcttccctctatgccgaacaacagcattttgtttggaactttcatgcagaaaaagctagaggagttgcgtaaaaaggccatgaaacatcgtgcactagtgccaggtacccaacagcacaggtttgagatactatgtcaagataaggcaggcaggggtatctaccgcaagagagtgaagcagaagtgtgttctcaaagccgacggcacatgtcattgctcttgtgcaaagccaaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggaggtcacagagactaacgatgaagtactcaatattcctgacccatcgaagctccgaagcaaggctggaaggaggaggactcgtcgcatccacaacgatatggacgagttggaggctggcaaggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcatcgtgccacgtctggctacgtggtgtagttcttatgttctatgttggcatgtggctttgtttgtaattcgtttcgaacttatcgatgtgtttatgtttcgtcgtgtaatgtcagacttcggcatgtcatgtcttttggtctcgtgatgtaacgtcagactaaggcgcctaacgtctttaggtatgctgatgtatgtcggacttcgacacgtaatgttatgatatattatcgagctctacatatatgttaaattgcatgtcatcgttatgtaccattagtaacgtttgctatatttaaatagcctgtactcttgttgtacataattattctcatgactttattactatttcataattttgcaagttatcttttgttttacattactactttctgaattgttctaacacgaaacactatattttccagagatggcacgtcaggatacacctcagttgttggacccggcgatagatcaccgacaccggtctcaccttcctgcggtgcagggggctcagcttgggacgttccgggcacggacgtgcggtgagctactcacggttcacgactcctttatcgagaggtacgaacagtgtatcactataagttagttgcgctgtaatattttttataatgacgcattaatttgttattgtaggctgtgtgaggccggcctcctaccgatgtgtcggctggtggaggctgctgccggcgacgcggacccggccagacgatggattgacaggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatgcattttatgtcttagcttacaagggtcccgttgtcgatgtgtaggtttcgcctagttcgctatgacgcaggccgcgcacttctcccaggctgcagggtcagcgtctcaggcagctgcgtcgacctcgcactcagcgcagttctagcagtacaccgggacttcgtcacaggtagccggcacgtcgagtcagggtccaccactggaccatgctgggacctcttcggaccgcttgctgccttccaccttgctcttcgacatcactgacttcgacttcgcttcaggctcgacagaggacgtcatcggcccctcacagttgggaggcgcaccgccggtgcagacgcaggaccaggcgcaggccactcctccgcgggacactcgtgctacccatgctgtgccaccggatcgtttcacctactcccaggaccatgtgcgagcacaggcccggaggaccaagcgtggtcgcggcgcggggcagggccagtagagcagtcttctctttgtttatttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgcgtgcgatacgagtattttcccgccatttggcgcatacaaccaatgtaactttcggcgctgatcaggcatgtaactttcggccccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggagtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattctttgtaacactactctattcagcagacccgcactacggcttgcgtatacatcgagtgggtcgatacagaaaatcccgttctcgacctaaccacttgtttacaagaaggtcgctggtatttcgcatccgaaagtactgagcaatacttacagagaaaagcggcttatgaacgataatatcgtgaacaacagagtgactggcgggtgctaactacggcactccctccatgggaagcccgtccaagatacaggtttagtgatcgttgtcaggttcttcgttccataaagcctacaacattgggtcgaaggttctttgtttgtccaaatattcttgacgacgatttcatggtaagaatattttgattacatgaatccttattttctcacaacatttcctaactttgctcgttttacatctattctttcctcttaggaaccactaaggagatgtcaatacagagaatggatagacaccagaagggttctaactctacctagtcgtgatgtgcagcttgaactaccagagcaatacagggttactaaagtgcggtttgagagaggagagggatcctcacgtaggggttagctattatcggacaacttggcatattgaaatttctactgtcatgcttccttgtcccattactacattgtcgttgtgttcaactattgcactacctccctcctagttcgaatctaatatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaccaacttcaatacatttttataacaatattaacaagttttaccaataaatacttctttatttattattaacataacatagaaaaatcttttggccgtacttttacatctgggtcc

SEQ ID NO: 46871 - DNA, 13034 bp, Oryza sativa
agggacccagatgaaaaaagtacggccccaagctttttatgggtggccaaaattgcaattagccccttgccgccctctgtatgggcggcaagggcctaatcgcaattttggccgatggcggcagacggcgcggtcgacccatcgtctgccacgtcagcttgccgcccaccattgaggcggtaggggctatttctacaatttttttggtcgatagattatttctgtaaatattaaaaaaaatctaaaaacgaaaaaaattctcgaatttgactacagctttgggataaaaaggtcctgatgggctggctgcttgtggatgaagagatgattctagatgggccgaatgggggataagtcatcgtacgccggcccagcacgaccataaaacctgccatcctctgctgctgcttgcaacacaaagaccgaacacacgtttcttgctgaattcgatggtggttaattaggttgctgaatgctgattagtctcatacaatcatcagcgttttgtttctcaaatactgtccgtcataaaaaagataaacttctggttatcaatttaaatagatctacatagttagaagttgattttttttttctaaggaggaagagagtgtaacattataagatgaacccggattcatttagtgcagaaagcactttaacacaacagatcgattttctgtacttgtgcagcatatactccctccgtcccaaaaaaatcaatataggattagaggggatataacctgtactctcaactctagattgatttttcgtgagataaagggagtagattgctatccttctggacctctttcggatgataatgagatatgtgcgaatatgtgcttgaaattgcaaaaacccaatcctaatgtcttggttttttctcgagagattgtccatcatacgggcctggtcatgatcgacaatggatgttgggccacacctgggctagacaggtcaatagctgacggacgggtacagcaacgagcaattattttttttttcgagaaatagggaatatattatttcctccgttttatattataagattttatagtattgttcatattcatatatatgttgatgaatagacatatatatgtgtgtctagatttattaattataacctgaaacgaaggtagtactcaagagaagcttcctcacaaaccatacgtgagataaagttataagtattttctagccagagcccaaacacatattcgcatcgagccttattcgctaaaatatggctaatacagttttagctcctctggcccttgatgaatttagggcctgttcacattggtgtcattttcaaccttaccaaattttggtaaagttgctaaaaaaagtgactatatttagtttcctgccaaattttggtaattatataagaaatcatgttaaaattttggcaagttaccaaaattttagcatttgataatgccaaaatttgataaggtttttttacagcaagatgaacatgcccttaatctccctatttcctaatagcaggtccttgaccttcacggatcagaaaggctatgtccgaatatatcctctcctcatactgaatcatattgattgcagccagacagtccgactcaatgatgatcggcaccagggtccactgcaaggcccgagcaattccttctttacaggcgagcatctctgactctgcctccagtgcactatatggcaatgagcaaggtgatcataagatgcaaacataatcttcccagcactatctcttaagtcttaacacagcacctatgccccccttaagcttaaggggagtgacgtacgggaatttctgtgaaaacattacatatatttttaacatatatatcattttaagtatgttagattagattaaatagatgtatataaagatatatgcatgtaccaatacatatatttgtacgtattctgtacgagtacatatgcgcaggcatgattcatgatgtaatgtgattcactactagaaaaatcatttttttaggcggccaaaagtagttttttcaggcgggggaaggaccgcctatagaccaacgactgcgaaaatcgatagcccgcctacgaaaatcctctagacgaacaaaccggccccgcgccttgccgctctcccccggcctccctccggccgtatctgggaggggagccgcgccggagccgccgcccccgccccgcgcgttgtcgtcgccaccccgcgccgtggctggccccacgcctcgcctcaccaccgccgccctcccctgacctccctccagccggatctgggaggggagccgcaccgccgcagtcgccgtccgcgctgccgccgtcgctccccctccggcggggagggagggagggaggggagggggacgggcccggtggggagaggagaagaagtgttgagggagagagagagagttgagagggaaatgagtggtagggagggggtgggaggagaagataaggagttaagattttttttttttgtggtaggtacgatttttgcaggtggagtacataaggttcgcctgcaggcatcgcttaagtagtccgcaggcgaacagcgaacttcaccccgatttatattttttaggcggtcatttggttccaagggttatgtcagcctgcgaaaaaaagaccccaatgtcgggaaaaatgctttttctagttgtgattaataatccttttaactagatgatgtccgatgctttgctgcgggatatgtgttagacaatgtagaaatgataaaataatttggattgaaatattatgaaaataatttgagaatgatgatttagcatgtgtatgtttagtttttaaatgaaataaattgtagatataattattatatgtttgtatgttgagctttttgtgtttaatgggttgatgtggcatgcttgcatgtagcttttaggagtgctaataaatattatgcttgcatgttagtttcaggtgtttaatgcacattaactttattaactttatagaaagaagggattcctgcatgagaccatcgagttgcagaagtaaaggaagcaatgggtcgtatccgtatgcgagcctgtttggtagagctacaactcctaaatttagctccaggagttgagtctggagtggagttgtggagctgtctaaaaccagctccacctctctagttcattttgtgagagcgctccacccagctctgcgtggagctaaaactgtttggctgggctccaacttcatgagaggtggagctagagctagagctgtgccaaacagacccgcacgtttgctcatgggctgactgcttctatgtctgtttgtgagctgaaggaatgttgaatggacaaaactgatcggacagttatatatgagatataatctccgttgttataatttatagagtaaaatgcaccgatggtatcacaacttacgaggtgggtgcaatttagtcactcatcttgtaaattgctcaaacaagtcactcatcttgcttcgatagtgcaaatgttatcaaatacattttcacatcgattgtttgttttcaaattggagtccatattaacctagcatcatgcattttttaccaatgtagacaggataagcattaaaattacaaattaacacttatatttttatgtatatactactacccctactttcaatgaacacggtcatattgtgcttggcaatcaataacaaaattcatcattaattgaattttactaccggtagtattgcacgttggattatttatgaatcgtgtgaccatgtttgcaaaataaattaatatagcatataacttcattgcgaacactccatacgacacatgttttatatgatttacacccccaaaacaagatgagtgatttgtttgagcattttacaatatgggtgactaaattacacccaccttgcaagttatggtaataacggcgcatttcactctaatttaaacctaccgcgacctggcagtatagttatttattttttttctcttcaattaacgtgtatggtgatttcgttttagctatatttagatagatttttttttccaaaaagcataacccatgttgtgacaatggccatatcatgtacgttgctttcttatggtctggcaaaaattctgaagcaattaggagtcagattctcgtctcgagttagcatgcataaaaagcgtggttgaatttcaaaaccaaaattcagtttggttttgaagtttcttattgcctaagagcaagttcaatagtatagcctactactagctccaatttatttatagccgatctaatagccaattcatacaatagttgcgtactatattattaacatatggtcctacctgtcatacacacattacgtcttgaagtccgtactgcagctggctacatatttgtagcccgctgcttttctctctcatcttttatctcatgaaaatatgtttatagctggctaatagcccgctattgtacatgctctaaagactcctttaaaacacataaattgaaaaaacacacgacttagtaacaaggattgttaattcttatagaaagacaaaaggaaattttaaaataggtgttgttgtatcgcaagaaaaattgtaagaaaaaaattgaaaacatgagctatgacaattcgttattttcatataaaatcactttaggattgtttattccatagaaatttcaaacaaaacagtagaattcaatatttttcctttaataaagggttgtatgataggagatttttctctatgattacaatccttaaaatttctcgtaccaatcctcccattcaagagggcctaaaatttaacggaattaccccaaacttagagtaaatctcgtgaaatcggagaaaattattcatctccttcctccgactttcaactcacatcgctcctcccgtcctcccctacctggaggctgcagctcctggcctcccgggcaactagggttcggcaaatcccccgcaaggagggtgaaacccttccccaaaactccccaatccccacccgaccttcttcgaaatcggaggcaaaaccctaatcgcaaacagctcgtcctcgcgcggccgccgctccgcagcaatggcgtccctcttcaaggtacggattccccccccccccctccgaaaccctagctacccgagctcgtcgattccccctcctctcgcccttcctctgaggcggctcgcccgattcgcttttccaggacccgaccaagctgtccgcgtaccgggacaggcggttcaccgggacgcaggaggagtacgaggcggcgctgcaggcgtcggtgacggtgtacgtcgggaacatgtccttctacaccacggaggagcaggcctatgagctcttctcccgcgccggcgagatcaggaagatcatcatgggactcgacaagaactccaagaccccctgcggcttctgcttcatactgtaccctctcctttccttcctcaatccgttttttttttaatacaagagatgtagtttggtgctatgttcaaattaaaggtgctgcttctgttttattctagtataagcgggtgtccaaatgtagtttggtgccttttaagatgtttttctagttctagttatgcattgatttaacagtgaagtatcaatggtggttgtgacttgtgacagagaagctaagggagttttaggagtctgatgttgtgttggtactggcaggaatgtgtgattttccctagaatacgggcagcaaagaattctatctcagtgcgaatatttggcttgagcagttagatattgctattggttaagtgagtaattttgtagtagtgagctcatatgtggctccttggagagctggttttggtccgctagtatgggccaatatagtgcaccaagtttcttgttttttaccctttgtttggttacttttaatctgatgtagtgttgattagtccgcaatatggtccagatgtgtcttggttgtcgagggggcatggtttaagttatatttggccaactggtgatttttgagagtctattgggatcttttttatgtattcaggctcttgttttggtgttttgtgttcgaatttggggttttgtatgctggtagttagccatactttgtacctctaattcgaaatgtggcatcatcttgatctctgatctgttaaggttagagtatgtcttttttgttcattcaaaaaatatataccacagttcctttaactggtgtgcgtgtcttggattcctggcagcaaggcaccccttgaattatcaatcttctattaaccttacagttatggaagggattattctctgataggcatatattgctttattgtcttgtgcatcgggcatgttgttagtttatattggattttggaagatgtaaaaatgacatttatctagtttgagccaacggtgtatgtgctgttagcctacatatcgttataataccttccttcctttcaggtactactccagggaggatgctgaagatgcggtcaaatatattagtggaacaatgcttgatgatcgcccaattcgtgttgattttgattggggctttgaagaaggcagacaatggggtcgtggacggagtggtggacaagtattaccatgatcttattctgcatgaataacaaatgtatgacatttgaccatatttttgatgatagttcatgtttcttttttcataggtaagggatgagtaccgcacggactacgatcctgatatcctttggtactattgaattaccatttattacatttagagcggggttatgctggtaactcagaaacccatccgtgttagttcatactgatgaaaatgttacctgtagatccatcctaaatatggcaattcaactatctgctgattgtttcttaatagcgctcctttaaattttgtatgcctttacatgctgctatgttttttctgttgagttggctacttccttaatgaatcttacgaagaggtggctatggtaagatggttcagaaagagctagaagcacaacgtgagttagttgactatggaggtgcttttcaacctaatgcaccacctcaatgtaagtgctgaaagttttgaggactgtaccttaagcctttaactacatccttgtataattttcatttgtgttaaccttattaactgcagtaattgctttgttagagatttgcatgtgtggcctcttgatatatttttcaattggaagtattttatggtgaaacaatttgctttataactggtccgatcatatttacatgaagttagcattcatgcataatgtagcctttttttattctagtaaagcataattagacattacctttttctctggtgaccatgtgtgcctttccactattgactctgatctcacttgttaactttagctgcattttaccttgtcgtttgccaccaaaaagcgttggttgagagtttggttcactgctttatttgattcaatccttggcagcataccgtccaatcaatttactgtttatcttctgtccaaacatgttcctgattatatttcatcattttcacaaatcttggcattttttgaaatatgcagatgacagaggtgacaggaagagagggtatggagattcttaccggaacgacagaggtcgcacatctcgcatattcttgttcttttctttcccctgaactaatagctaacacaatctggtgtgctgccaccagattaccaacggaaacgttaccggaacgatgagcgatcgtcgcaaagagcacctgactctgagttcaagagagatgcgattgattcggtattagagcctgcatacgtgtcatctggcttttcctgtactaccccttcggaaaaacaatatgtttacaaaatatctcgtggttatgtttgcaggagaagaatcctaggtttcgtgagaaaggtgattctgatgaagaagacgatgattatgataagagacgccggcgctgaactgaaagaaacaattgctgataaatgcaaatgggcagttgcagtgactacactagtaaagcccgtcgagcttatgttttttaccctgttgtgtaccatatgacttatatatctgtcgtcagctcatttctatgttgcggttcatcaccacatgcttgcataggtctcgcatgcgactgggaatggattttgtgtttattgacacttcagcttatgtattgacctgttatttaggttggcaactaattgattttggtcggtaacaattaccttgcgaactatctgaaaaactgccgccttaaacttgcaaatactcgcttgttcctggtgttaagtgaaaatgttggtttagcacttgttaattgtgaaacttcggtcaaaatatatggtctaatgtgaaaattactcattatcgaacgaacaaccgcgaaccttcctgcggctttctgatacaatactacgatgttgatttcgctgacattgtgcatcgacgtttacagatagcaaagtcgatagcaaattaatatgtgaatgatcacttctctgaggccggccggcagtcatcgagatcatgaagatcgtggaggagctcctccttccggcgctggccgccgacttgaccagccggctcgtctccctgctgatccgctcctaccgcagccgcgcaaccaccggcgtggtggaggacgacgacctggagaagctccagctgctgctccttgagctgcacgctgccgtcgacgagggacagggccggcacgtcacgagccagaggctgctcctgtggctccgggagctcacgcagagcatgtaccggggctactacgtgctggacaccttccgctaccgctccgtctccatccaggcgcagcagcaagacgacgctcgcggcgctgccgccaagcggctgcgcaccagcgccggcgccgcggtgcgcctcgtgctcggcagtagcagcagggacgacgacgactcgtcccgtgccctcgcccgcgccctcgcccatctgcaagccgtcctccagaacgtgaccccgttcctccagatgctgggcacctaccggcgggtgccccggagggtcagcgtggacacggagaggtgcgtgccgatcgggcgtcacgtcgagaagcagcggatcgtcgcgttcctgctcaaggaggacgaggcggctgcgcacgtcgtcggcgtccttccgatcgtcggccctaggggcacggggaagagcaccctcatacacgatgcctcccacgacgcgagagtgcgcgcgcacttcgcggtgatcgagcgcttcggcctcgacgaagtgctgctgcccctacacgccgctggagcgggcgcagccgccgccacggacgacacgtcaagccggagcttggaagatcaccggatttacctcgacgcggtgcacaacatcgtccggcaagagcgctttgcccggaacaggtccctgctcatactagaggacgcaccggccgtcatcgaattcgccgagacagcgtgggtcctaccaatggctcacgggagcaaggtcgtcgtcacgagcgaatacgaccaaaccaaggcgggtctcggcgcgacggaggaggcaatcagaaccaagaagatgtccaaggaggagtactggtaccacttcaaggcgctcgcctttcgcggagcggcgaatgatccagcagggccggcgcacccagcgctggcggctacagctaaagagatcgcatccgtcctgaacgggtcattcctagggatgcatatattgatcgccctgatgcgatccgacccaagggagtgcttttggcgcgccgtactccagagcctcgtggatctctgccgctcctcgaactccaagaggatcaaggccgacatgggctacgtgcaggagttcgcgctgatcgggcggatcgctctcaagcttgtgcttccgatgcgtctcacgcttcgtagctgctccatcaccaagcaggggggcgatcctcaattaggacctgagcttaatcgtgtggcaggagggatagcttacagttgtcgcagtgatgactctgggtgcgtggatgtcatcctatgcagatcacgcatccctccctacgagatctacaagctctcctgcgtcatggaggaagaggtccatctagaacgtgcgtcctagaaaaatgaatttggtaccctgtataaaaccatgttaatttgcttgcttctaggtagtatatgatcttgatgaaatttacgtcttgcttgcgtatgtacggacccattctgttccattgatgtacagtgactgtgaactaaacggaaatttattttttgtatcactgatcatgcttcctagacatttgactaccgcttcagtgaatttgaaacccagttaattaaaagttatgtacaaaatccagtgaatgtcaacctgctgcaacggtctccatgttaacactagtcagagtaaccgtcgtccccgtcgtgctcctggtagtaacgccggtccagaacgagtgcttggcaatggcagcggcgcggcggcaaaagtcctccacaacggccgcgcgctccgccgggaagccggcggcagcgacggccatctcctcggcctccagcctcttgctcacttgctgaccaggaagaagtcgccgctctcgtacgtgaactggccggcgaattctgcaatatagctgtgaaacagtatagcacatatacctagctctgaaatatgatgcgccaaaacggctgtaatcacttggcagcaaaaatatggcacacactttttattgaaccaaccgatcaagttcagactttcactcattgtcagagaggcatccaagaagaacagctaagggacagcctgctacagattcaacagcagctaagtgatcaggagagcagcttggcacgagtggcaggatcttccttgctttccacccacatcatgaaaacgtagccgaggcaccagagaagaacatattggaatggaacccaacaaagcagtgccacaaggctgagcatgctgccaacatattgagggtctttgatataaccaaatggaaattctgtcacccatgggattttctttccaaatcgaacaccgtagtaggtgcctggctcaccgagcagctggtacaccctgaagagaaatcacatatatcagccacaagctaactaactgaatgatgattaccccttccgtctttgtgataaatacagaatttagtctactataaactgttgtgtactatactcatattaccaaatgctcaaataatatgtgttgccgaagtggccgtttcaagattataggaaagtgtttttattctgttaaagagacgttaaaatcagaataaaaacaaattttggagcttgagtgcctcctcgactacctcagactatttcctactggtgtaaagagttgctagaagtccaacatagaatgcataggaattagcataaaaataagttagcagtgactaatccccagggtagtggcttcacaggtatcaaactcaatgagtcatggattagcactgttaagtctatgacacttaacttacttttgcatcactaagtgtctaaatcgctaacaattgtaaacaattctaaatgtttataactaatattgaaggccctatcttatttcaaggtatggcaatcatttaaggaagatagggctttaggacaaaaactatagcaaaaatgatattgttaaaatgcaaaacaaatactgaacgagaacgggacaactacaatagatgcatcagtccattatagagcattatgagtacacatcaacttaagatgaaatttggccccttttttttcatattagatgagagcattgcttgtgcttttaaaattatactccagctataagtttttttttttttgtgtgtgtgtgtgtattgtagatgccattctggcaaatcatggagaaaattcataaatcagtaataattggtaaatagaagcagatgatcgttgttcctgcttgaaaatcgtcccatcccttactcatcccttgtccctacagcaaactgttgattctgcagcactaaatcgacaaacgaccaacacagatttatacaatcgcaaatttttggtgctgaactgcaattagtggattattgatcatggaaagatcacagatgggaacagataaattacaccgaaaacctagcacaacacacatagaaactagaaagtcgcagacgatccgaacgcgaggggatagcatcgcgtccgactgtcggaagaggggtttaggggatatatctcgcttacttgaaattgaggtactggccgacggcgaggagggcgacggagtagagcggcggcggccaggagaaggaggcgacggaggcgagggcgaggagctgcagcgccttgaggacgtgggacacctgcgccatccggcggcacgggtccacgccgccgccgcctccgccgcacaggtcgacccaccgctgcgggtggttccagagcgcccagtagaacgggaacggcagcagcacgccgacggccgccgccgccatttccatctcgttgtcgaaggcagagcggtcacgaggggctcgtggaattttcgtgtcgtcgcgacggcacactacttgggtcacctggggcgactcacactagacatcctggggtcacgagcctcgtgacatactgacatgtgtaaagtctactagtagtaatgccatgtattcttcaccgtcacttggttgctaactactatatactcagcaaatgatgcctttgtttcaagagatttctcaacagatttaaaacttaaacgctgcggcaagcatgtcacttgctacaactctgctaatgatgcctttgtttcaagacagggcgccatcgttttgcagacgctgttgcttttcagcagtacctgatgcttataaacatcagcaattccattgttttgcttatagctgattaatggatcttctgtaaactgatgcattgcctctgcttgtctgcctgtgtgtgttgtgtgctcgtcagcactgactccagatgcgtggccgtagatagattccgacatgtatagggcccactaccaataacggttcgcatttaggctgtaacagcgaaccgatacgcttctactgcaa

SEQ ID NO: 46872 - DNA, 2782 bp, Oryza sativa
gggaaatttctagatggtgatcgagtgaccggtagtccacaagaccacaagcacacaaggcaccaggcacgctttaggggttaaccagaagatagacaaggaaacgtattttgcatcgagtgactggtagtccacaagcacacaaggcaccaggcacgctctagtggttaaccagaagataagacaaggaaacgtaaggcgtgtttactttgggctggtttggtttgaggcataaattggtattatcaatatttgataattttaatagtgtttactgtttatttggtttgaagccaaattttggcatgtctaagaaaatatgtcatttcaatagttaacttagtctattttggtttcaatccaaacacaactttgccttgccaaaattagtcatgccaaaacttgtcaaaatttagcattgacaaatattggtaagaccaatttaggtcacaaaccaaaccagccctttgatgctattttcaaccataccatcttttttaagttattaaaaaaatgtctacgttcagtttgttgctagatttgctaaatacataagaaatcctaccaaaattttgataatattgtcatcctgccaaaattttaacaatattaccatcctgccaaaattttggcattgccaaaatatcataaggtttattttggttaaaatccgtacaggcccgtattttgcagcgaaatgttggaaacaagaaaaaacaaaagagcaaatattggaaacaagaaaaaacaaaagagctgatcgaattctctactactgttgttttacatgatctccaatactcccaaccgatcaaaaaccaatttacctctgcttatcattgcaactgctcgatgaacggagaaaatttcctaaccataacaattgaccacacgcggaggaaacagaaattttgaggcaatatcaacactcagcgtcaacagcaggaagggggaaattttgagtaaatttctaactctatcctattacctgcttgacacattccacgaaaaacatcaaaatttctggacttttcctgtgaaataaaaaacgcgccccatcactcagcattatcatcatcaaaaccatcatcttcagcctccttgaccttttgaggtgctacactatcttcaaccatcgcaggatcgtcatacacgggtttttcagggcctggtcctgcagacaccttgaccatagcagggcgcaataatctctccccaagtttaaaacccttacgaaattcctgaaggatgaccccttcttcatactccactgattcttctctcataatagcctcatgaagctgaaacagaaggtgcacaaacaattcttattaagaaaagtaacaccctttgaaaacccaagaaattttggaaaataaaatagattcctacacatatccagccctttatagtagacttatcacccaaaaccatggaaggcacaaaatttaaaagagacatggaaatttcaatatttgagtaaataagtgtttgattcaaaagttaactggattagtatgtcatgtgctgctaacaatgcttaccataggatcaaatggtttgccaacagtctccacatcttcaactcctagtgagttcagaatatcaataaattgcttataaatgctctgatagctgtcgtttatttttgtttcttgctcagtttccacctttatttgtgtttttgctctttcaaagttgtcgaggacaggcagcaagctctctataacttccccttgcacatttgtcatcaacgaaagcttctctctttctacccttttcctgtagttatcaaagtcagcacttatcctcaagatacggtctcgctcagttgtcaattctgcacctaaggtactgattttgctcaaaagagaatttttctcctcctcaatagagaataaaaagtcctctatctcagcgacttttgtttcatcatcattaatcaaagcttccttgtatgattgcaatgctgtgacaataacagagggagtttcttctgtggctgcagcggcatcatctgcaccagtttctccagtttcagaatcctcctgtgacatcaaaaaagatgtctaaatgagaagccaagtgtttctattgacaagggtcaacttcttttgcttttatattagcagtggaagtgaaataacatactgctactgtgctacatgccacctcaacaactgtcagtattacatttatacgactcttcagcagaatgcagtttcttacctcaaatattgacaaagagatgcactacactcttgtgctataaacctataatataatctgcacaggccctcgcgttaaaaactggaaaatgaaatggtcgcattactgacctactatataatctagccttgctcttacagaatctaaggaaatagaacaggatagctaaatgtgactagtaaagagtcagagaaaagatttttgcaacaatgcaataactccatgttatcaagtaactcgattgcaaaatacacatgggccaaagataggaaacattgagaaaataaaatagcatcttcacacgtgtaagcacagggaagtgtggaaggcacagctaaaatgcattcataatactgaagttacacaacaactatggcaaacacttacaagtactgatgtacaagttcctaaaagaggacctatgccaaatgtgttccccaatagatcaatgacatgcaaaatagattggaaataatcccatatcagcaaaactttgctatttccagccttagtcatgaaaaagaacagatccttccaactttcatactccctc

SEQ ID NO: 46873 - DNA, 821 bp, Oryza sativa
agtcgccgtctgcgcggcctcgtcagcctcggtggctcctacccgcggccgccgccgcagcagcgggcccgcgacgaagccagggactcgccgagccgcgggcggcaggagcggctgcgcccggagcggccgcgccgccgcgcgcctggcgaaggcgagcgacgaggcggcggaggacggccggcgcggatcccgggcgggagacggcggcggcgcgagcgcggcggccgtgcggaggagagcagccatgggtgaggggggattggagggaggggggcggagtttggctttggccgctgcacgctgtcgctcgctggctatcgtcgagtcgagcagcgcgcacggcacggggataactcgcgcggcgccggctcggacggacgaacggacggacgggatggatgggtcgagaatagagatgggcgcttctggaaggaggcaggggttggccggttcggttgttagcctgcttgatgggtccggtctatggagaagtggatgggccctgttctggaggcttagccggtgaggagaaaaaggacaatatgccacttcatacggtggatttcgataaaatgccacctaatatattggaaaggataaaatgtcactcaatcagtgtgtttggataatggaaaatgggggtgagattgagattgagaaatgaatgaagggttagcattaaatgaaagagggagaatgaatggctaggatttaaagatgcattttaatggatgggaaatcatttccctataccattagccaaatagggctaataggttatctttgggatattttgccactttgaagaggtttaagac

SEQ ID NO: 46874 - DNA, 1116 bp, Oryza sativa
  unsure (1)..(1116): unsure at all n locations
tctcccacccccctccacctccggccggcgcgccctcccgcccgcccgccttgcatatgcccntgcgngcngcggccaccgcaccggccggccggccgccggcatgcatgccgcgtccgggtgctcttatcatcgtatgccccaggtactcctcgggctcgatccgtgatcctgcaaaattttttgggcggttgccgtacgcggccggatctacaacgacggtgagtcggtgacgcacgcacgcgcgtgtgtacttgctgtacggattccctcttgctttgtacgaagagtcctttgatttgtcctgctaattttgttcgtcttttccaagggatcccaactcccaactgccttttcctttcttgggattacaaaatactaactgtatttactgtgacattgactgattttgattggttccaagagatggatcttggaaataaccgacataaaatttgcatggatctactgatttcccctcagatctgcgcgcatctctcgttcaattccttttcttactgtagctctcaagattggaatgttcgttgcatcagcttaattagaggaggtgacgggaagaggaaagaaatttccctcagatctgctaattactccttccatctcactaaccaccagatcgatcaggtcagtagctagctattgctgccacagatttcttgtgtgtcctctacttgttcagttctacacgtgtcgctgctgcttgaagtaattgcgtgatagaacccctgtctcctgaatcctgatagctccagaaatagtagggactaggtcactgtccacttactgttctattggtgacgtctcgtacttatctctacaatgcaagccgccgtacttatctgcagtgccactgtccccccccccccctccctctctctctctctctctctcaaaggaaaacttcccaaatcaaaacaaattttgcgcaaacctgcaactatgtacatacattagcttcaaccattttggtttaggggagatctagctggatgtggaatcttgttagtcttaatcttttaagaaaaaaagaactctcttcggtttttgtttcattttcagcttactagaaacaaatggtccggttgtttctcttat

SEQ ID NO: 46875 - DNA, 1602 bp, Oryza sativa
aaagaaaataacttaccttatcttgtattgtcacaggctcagaatttatctatttccccccttgatagtaataataataccatctttggcagagaaacccagattcttaccttctgaagtcccctcattcctgatttggagtaaatatttgagtagcatctgaatgtgatgccctagctagtgaccatatattaacattcagttcttttagataatggattaaaacctggcctctatatccaaactcggatgtacatggccaaattaacatccagttcttcatccaccttcatatcagaacattccagaatacagattgcaatggcatccattggcaccacatgttttgactgattctttcactgtttcttgatatatttgttgatttttaatggtaaatagctcatctgtccaatcctggcaccacataatttcccctgttaaaacagtgccaacacaaatttactcatgtccactgaaaatccccagaggataacgttctggcactgccatatcaggaccggaccatacgcggcgcgccacgtggcgcgccggcggtcacacctgtgctggtgcaccctggcattatccccatccaccatcctgtgggtgactggccaccaaaggtttttggcgccacaattatattgagctgccattgcttctcacctctgctttgcatccatccatccatcagagatcaggtagaacagtgagagtgaggtgcagaaaaatttgagctgaagctgaggatggcaacatccatgatcacctcgccgctggtggcgccggcccgggccaagggccttccgtccatctcccgccggggatcctccttcgccatcgtctgcagcggtgggaagaagatcaagaccgacaagccctacggtctgaaactgaaactttcttcagaattcagacttcggaatgttttgctgattattgttgagtgggtttcagtggctgaatttgtgtggtttatcatttttctttttttttttttatctttgcagggattggaggtggcatgtcagtcgatattgatgcatctggcaggaagagcacggtcaggacttgtccccagctcctaaatttctcaatgtcagtcgaagtttttgctagttattcttcatggtggtggctagattttaaaaagaaagcaccataggtttcaaactttaaaacttgcaagaataattgccccatatttgtccaagtttcagtgacaatttcgcaggttttgttcattcaaagattccatctgtcagactatgcactgaataaactgacagatttttgtgatggatgcaggggaagggtgtgtaccaattcgttgacaagtacggcgcaaacgtcgacggctacaggtaaccaagatgagatataaaattaatattaaaagagtacttttacggtggtatctacttgttttagcaaaaattgtttggctcaatctgacaaactcctcgacgatttgcagcccaatctactcgccggaggaatggtctcccaccggtgacacctacgttggtggtaagtaaaccattcttttacagtccatttactatatatatgaaatactactatcataccagcaaagaa

SEQ ID NO: 46876 - DNA, 1959 bp, Oryza sativa
ctgcacccctcttcactaacattatctttccatccaatcacaatcctccaccattcaccacaacttgcaccatttaattatatatactttcttaataattgtgtcttaactctaaaacttcttatattctgggacggaaatagtagtaggtacaaaatctgatagggtcttgtcagcaacctgtgatgtgatggagagttcttacaccctagaaatcataaaggcaaaatcttatcttgatcaatattattaagaaacttataattcttttgtatggtcaatcttatctgcctatatgcttgtacggttaattaattatatatctctgtattgtggtaattaatctgcaggaaccaccgggcttctgatctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatacttgaatttggagattaattgttgatactaaatacatagattacataaggttatcttgcattattgggccttctctctagtgcatatagttagctcaatgaacatgcaaattaaagtgagaagagtaaaatatccaatagctagttgactctcttacttattacggatcccaatttaaagctaaggactgaatttatttggattggtttatgtatggtccagtcaagtactcctacttcactccagatatgccaagggacaatacaggcatacagtgtgtggttcagtctatgtctagctatcttaggtgaaaacgatactactaccacatgaaattctaccagcagaggccgtagtacagagctgacgaaaatatgtggaccttcttgtcccgtgaatagttggatatttacgtggacggacaacccctgtcaaaacagttttcacaggcaaagtgagataaaagattgcctccaagtctacatgtcggtgagagatgaatatttttgagacaacatatagttgaaatcatgggctatattacataaaagttaaccatagattttcagcacaaaagataacaaccaaaagtaataattaactagttgggcctactacaacaaaaattagcaattagctacctataaaaaactacttccgatgaatctaagtgttttcatggggtcttaagatgcccgactaggtaaatattcatccccaggcgctgttcttaattgcctgcgtgtgacttgtttattgtctgctcattccactacttccactacatgtagttctatcatgatcatgcgggctcctctaaagtccaaccgctggactctagtcacgttctccattaccacgccgtgcctcatcatatctcactctccatctattttccagtaaaaagagggcaatgtgggttttcttagcactcttcctctctctgcattctcctttatctctgaccatgttgggctcgccacgccaaccgcagtacatgaccattggcgaagaggaaaaggtcatgttgaacaccgacgaggagcaaatctcctcaacgccgccaccgtcacttagtaatgtgtaggatagagatgatgagtggtggtagaacgggtcgtcgctaaaggtggattctccttagctatcatgctggtagctggcaaagctacagagaacacgctagtggtgcctcttctagatctctgtctttgcctctagctccgatggtgcctcctctgtgttgtccgccagctcaacctccgccaagtcacttgcctctcgtttatccatgctaggggccaggtaccttctccgtgttagccatcggctcgg

SEQ ID NO: 46877 - DNA, 1126 bp, Oryza sativa
ggcgcggcgagcccaacatggccaaagataaagcagtacgcaaagagagtaagagtgcagtgataaaacccacattacctactttttactggaaaatagatggagagtgagaggtgatgaggcgcagtgtggccagaggatgtaaccggagtccggcgcttagacttcagaggagcccgcatgatcaccaaaggaactacaggtagtggaagtagtgacacaatgaagatgaagagataagtcataggcaagcaattaagagctctacctcggagatgcacatttacccagacgggcttaacgccaccgaatgtgaaaatacttcaattttcttagatgttaccttatgtggtccgcctatattgttagacattaatgcgggcaattgcctaagacgagtgcttgtgtaaatcattgtatttatgtaggcggccatcatatcccgccgcctatgataattggtttacacaaacccgtgaccctctctccccttggtagatataatgcatagagagagagatagagagtgagagagagagagagagatctacaatactaagcttcaatcttctcctatatccttacttcaaacttcctctatccttgtgcagcaacaacctttaaatcgctagtctaagtagaatcttttgatgttaattttttttaccaggaaatggttatatgctgctttgaccttatttattctccagaatgctagcaagtctaatagtctccatttgttcttcttaatttaagaatgatgaccaccatacttcttattcaataaccctttgtttgaggagggcatacatccctgaggaggggagtgtggccgagcggtcaaaagcgacatgccgtaaatctggtgaagattttatacgcaggttcaaatcatgcctatcccacttgttgtagacttaagagttaagagaagagaaataggaagaagcccaggagggccaatcaagcgaggttttttctccctttttttcccgtgccatgaagtgtaattttattatatgcgttttagagaggtttgtcaaaaaagatgatctataaagattcctcatctatatttgatcatgaatagtccacttgtattgtgtgaatcatttacaaagtttta

SEQ ID NO: 46878 - DNA, 9582 bp, Oryza sativa
actaccaaaatgcatgtgccttgcattgagtgaagccaaaaagagtagtagtgagtgtgtggggagtataaagccaccaagtttaattgagttccttataagcaaatagaatcttcccggtgtaagaaagacgctcacatgatgtaattattttttctctaaatccattggcatgggtgattataagaaaactattaataccaccttaaaatgaaattatgtattacagactaaagtttgaaaccataatatgtacttttgtcatgtattattagagtcgattgcaatgcatggttattttttgagtaaattccctatgtacccctaaaaactcactcaactctttcatacccccgaaatttacccgattccttctatactcctgaaatttcaacatgattcattccatgcccctaccgttatattttctttcatttcactattacatttggttgcaaatgtctttttgcctttgatgctttaagtttgaatataagcttgaaaaataattgaaaattttgtttgagtgcacagtatgtgcattttatgaaactaataagactaaataattagtgcagaaaattttgacataaattttgaaaataaaacaaatgtaataaattaaaaaaatttatttgaaattttaataggacaatggattttttttatcgggagcattcaaaaaaaattattttcagcattggtagtcatatctttgtatggatgctcctaattttttatgaatttttttaaaaaataaatacatttttttatttcattatctaaagataaattttgtggtagataatgcatcacataacaaactcataactataatagtctcatgcaataaacttttatatttttaataatgtagttcataaatttatatgttcatccaaggagtaaaatggtcatttttatagaaattagatggtcaactgacgagagagataaggaagggatccgaatcatatttagggggtatacaaggaagtaagtaaaattcagggacatataagggattagctaaaattttaggggtatataagggattttctcttatttttttagtacttgatgttgataaaaaaattatatttttcatattgtaaagagtagccttagtagaataaatgttttgggctatatatcggatcaagctcactgcactccaatctagaattgatttcactctaaaaaaatcagaaagaaatcatacagtgaatggaaagaaagaaaaggaagtgatgtggtgtcctgttgagaaattgagagaaccgattgcgaaggaaaaaaatgagaactttttggtacaatatactgtaagtatatactagcagtataaatcatcgaacgatatagattgtagctgcaatggcttcaacggcgagcttcttagcctcatggctatgcgctcagctcgctgccagcagcagcacgtgctatgccgcccacctgttggccaacacgcccaccaccgcagccgcgcctcctgttgtacctggcctccctactatgccgtcgttgcctacacaccgtcaccgatgtttatcgttcagtcaatgccatgggtcgtctctccgctccggattgatagggatgacgttatctttgtcgggcctaagtgaaaacccgccaccaacaacattcatcggtgacgggcctaatagttatctcaatcaggtctcaagttggagctcgtcacggatgatggacatcggtgacaggtttctgttagggctcggtcaagatatcatcggttatctttgttgggcctgaagttagggcccgttactgataggtgtcattcgtgatgagctcgatttttatgcacatctaatatgtctgtgcgagtatatttttatcagcctctttttagatccgtttgagatgactttgttgtgacggactgtaaaacccaggcatgtgaggggccgtcatagatgagaggatctgtactagtgatgcatgcatgtacattttacgttggttatgttctgtccctagaaattcggagaccatgtgcgagccttaaatttatgtgacaaaatgttcaattgaaaattaattcagtagatattggactgcaaaacaaaattggtagacaagaataattattgaaaagatgggcttggtagaatgcttgatgggcaatggcgtgtatggtgtgccatgctttgatctgtgctggattgcgacacaacttataagtcgaaaagtctaattctaaacaaccaaacaactttttcttttcttttttaagtcatatataagtcactataacaataataagccgaaaactagatcaaagaagctttttttgtcttatgtaaagaagatatatgacttcatcactaaacttaaaatattaaatccaccgacttataaatcatacaagctaataaattgacttaaaagtctaaaccaataaccctcggggggcaaagtccgagagggattagagcgcattggcacacgcgatgattatttagcaagcagtggacatgaatgtagaatgtgttagcattatagggggcaattaataaagcggcaactggatcgatcgagacgacaaaccaaacactatccacgaaatctatcagggtgatatcgatgaagctcacctagctaattgaacatgttggcatggcgtgtatatacctaactgtacacggggccccatagaatttaggaaaatgtatactttgactcctcaactattgatcaaatctaattcgtacactttaacgtaaaactggatatgttgactcccacaacaatcaaaaccggtgcaaactatacgcctcggtaatttagaaagcggtttggcttatatgataacttggctagtatttatccaacatgggacccacatgtaaatctcatagaaaaaatagaaggcctcgctagcacctaagcgacgagggtgagctagcggtggtagtgtcttgggctgaggtggttggtagcggtgacacaccgtgtggctggcaactgccaagataggcccgagctgagcaggcagcgctgaggcatcaccggcgagcttctacggcagaacttcaagtaactcgaccacacctttaatttgggacagcgcctgggcttagagcatcttgaccactactagcactgctgttggcgagtgctagggctcttgatgagcttctctcggcatctgctctcttgctgccatgaaccacccccacttcccccttctcctctccaattcgctccccctgcagaagcccctctctcgcgtgctccaagccaccgcatggcgcgcattgtcatcgtcgtaggtggatctccagttggactctaagaaaacgccggtgctatccatcgagctctacaggctcgcggtgccgtgcgccatagggaaggaggagagggaactacaacaaatgagcttgctccgtccaaggccatagggcggcgcaccacccagctcctcactggacggcgccaaaagaataacagtgttgctactcccaacgttgactgagacatgtgaatgggataaattagaagaaaaattatgtttggcagcaggtatacagaaatagctaacttttatggtttataagaaaaaaaaaggaaacttatgatagcagataatgacttctaatgtaaacaagatatacatcgaacattagatgatgatggatggcttggatgtctactcgctgattgcgaagttgtacatttggagtcttacatgtttcaaaagactcacgtggctatgaaattaacagtattataacttactcgatcattctctttttaatatcctgttttggttgccaaaacatacatattgtccttattgtttaatatcattactaaatactactgtaacgttagtacggataaattactagtcatacactagtacaataacttggctagtacgtgcgaacttttgtcaaaaccttccatgcaggaaaaaattatctaacatggcatggcacacactgatgtataattattattaaccatcaaatttttcagtgacaaaatatgtaattattacttttagtatgtttctgagatatagacaaaagaaaaagcaatacagtttaaaatatcttattataaaaatagctttttttaaaaaaaaatctcaacgaatgatcccttgtcccttttcttcttactataacctcgtgtatactttaataccaatttgatcctaatactctactaatatcgttgtcaggtataatcttcgataacattatagattggttttgcttgcacgggtagtttttttttttctgcttgcatggatagtttgggcccaggtacggaataagcaacttgcatccactcttagttcatgtataccatgagcttaatttaaattaattaaacattactatatattttcttccacaccgaactgtttattatttcacattttaagagatttttttattacacggtaagcacatacgtgggcacacttctacacatgcacaccacactcactcacccgtgagtacgtacgctaacacatgcttacaattccgattgaaaacccatttacgtgtgtatatagtgtttttgagtaaatactgatgggtaaagtaatgcacccatccacgacttcaccatttgctccaactgtggctattttgccattcaaatattaagttagtatgtatgtaattcatgtacttacagaagcgctatacaatttattgatagttgaatgctacttaaaaactaatattatgggacgaaggtaataattaaactgtcctcgaaggcaccaataaaactacagcaacacaagtactatggttagcatccatgtaagattgctaacaatccatatagataaatacagttgtgaacatttggaacacgatttcatcaaactttaaaaaaaaaaacagtagatgaacaaccttactaggaacattacatcatttgattttatttagtttgaggtagataaatacaatgaacacaactttgggtaacacacaccaaaccactacaaccagaagctcaatacccaccatataattagcacaaaacaaagtaattaattagggcagcatgagatccacgggcttatcaaagatccagctaaatggaatggccgtgggccttttcctcatctgggccgctctgtcatgggccttctcctccatcctccggatcttctgcggcagcgcgcacacgtagtcccgcgcgcgccgcccctcgccggagagccccgcctccagctccgccacgcgccaccgccgtatcaggtgctcgaggattccccggtagtccgacgcggtgtacgtcccggcctgctgcgccgccgcggcgtagtgggcgaacaggtcggcgtcgcggccgtcgtccatgagcgcggcgggcatggtgatccggcggcgcatcatgtacgccagcgcgcgcacggtggtgtccgggtcggcctcgaggagcctctcgacgacgcgggtgtaggcggcctcatgacgcttctcgtcggaggcgatggcgccgcagatgcgggcgagcgcgtcgtcgccgtgggcgcggacgttgcgcgccgtgttgccgtgggagatggcggtggcgcgctcctggaacgcgacgtagatgaagccgtggtaggggctcgccggcgcgtgcatcgccatgccggagccgatcagccggtgcaccgtgcgctccacctggcgcatgtcgaggcggccggagaggtacatgtagcggttgagcacgtcgccgtggcggttctcctcggcggaccacccgcggatccaccgcgcccacgccgtcgcgtcggcgccggtgacgtcgcgcgccgactcgaaccggttcgccatgctctggtacgtggggagcgcctcctccgtcaccatgttccccaccaggcacaccaggtgcgcgtcgggcacgccggcggcgcgcccccggagctcgacgcacgccgcgtggaacccgtcggcgccgagcgccgccgcgtcgggcaccaggtccgccggctgccacgcctcctccgccggcttcagcagcggcagcacgtgcgcctccacccacggctccatctgctccagcacctcaagcctcgccggcgccaggcacctcctcacctcgtccgcctcctccgcctccgcctcccgccgtgacgtcgccaccgccgccgccgccgcgctccgcctgcaccgacactgccacgtcagcacacgtacagagagctcagcgaccagtggcggttaaaagcttaccagaatcggagagtggcagttgccggcggcttgaggtgacagttgcggtttggatacccaaacatggttactgctaaggtggaggtcgttgccgatgccgccatgatcgagcagtacgtggatctgatcggaggagggaggaagacgacggcgatggcgacggcggcggcggcggcggcggcggcgagaaggcttggaatatgagtggatgcgactacttagcgagctacccttgcagatgtacgtgtgggtatatatatgctacgatcgatgtgtgtagagcttgtgttaatttgattaattaattaattatatatactgttgcttaattaaaatgttttaattggttggtggctgctagctagctgactgcatgcctggctcgcggtatcgtgcgatgaccgtttttgcatgcagaatctgtaccttaaataagtatagtattaactaaatcaaatttagattacaaatatgttaaaagaatattatgcccttccttaaggaacagaagaaagtatttattcaattaccaaaaatgaggaaaaaatacaataatattggaaaagtatacgtaccgtcgactactctaaaactacactattttagcaatgaaattttaaagtaaagctgcaattttttaggtagggaattctagtgttgaaagttcaggttatatttttcttccgtttcgggagctaggatgctcggctaacatttggaaacgtggggttaaggttaccatccaaattaaggttttccaagaaggttaactattagtagcatcgacgtcaaattaatcaaccgggtcaaatccttggcgtacgtcttattcgagctttttttttatttagtgtgtactataagccaaattaaagagacatgtgcatgactcaattaattaagcaaccaaaaataacttttagctagggaaaaaaaaccatgccacgttgaaccaaccaggtgcaaaacggtatagattatcacccagcttaaaattgaaaagctgtattaatcaagcaccatatagaaacataatgttgatactcgtgattcgcccatgatactcaatgatactcctacatttttatatgatatcgatgatggatagaaatagcttacatgcatgatatcttgaggtctaattgtagtaccttagagatactcgaattaaatttaaaaatatactgttcattcaattttttttgaaatattcgggatgtaaattttttttaagaaatatattgtcaatctcgcgtaaccgttgcgcaaaaaaaacatgatgtcatgggcgatatcgcgcgaagaaagtgcgagaccgcgcggcaacggcatgagaccacgcgatctcgtggaatggaagagggagaccgaacggtaaccaatcagcgacaccgtcccaacggcttcatttgattagtgattaattacctaattaactattaactaataataaatagtgattaattatcttgattagcgattattaattaatcaataattaataactaattaaccattttgaaatccagtatcgctctctggctcaatgagaccattcggtttcgctcttccgttccacgagatagcgcacggtcttgcactttcccagtgcgataccgcccacgatgtcacgcccacatcatttttgtgcaacggttatgcgagatcgacgatatatttgtgcaaaaaaaatttgcatcctaaatattactgaaaaaaaattgaatgtacggtagatttttagatttaattaagagatactctttgatgtacgttgttactcgtgattcatccctgatacccaacaatactttttttataatggatactgagaagacttttaagtgaaactagctaaatgcttgtgctttgttgtggctaaaaaaatcatattattatctaaaataaataaaatcatatcttttcctaaaatatgtttcctacctttttattatagagaatactcacttttgtttaattttatatgtagttgtccatttggatttaattattattcaatatatcctaaaatataaggcacaaacatcattaacataaggattaagaaataattattaccacttacttgtttcaatcactcaatagatacaatgtatgcatccaatggaattggagatgttgagggtggaggatatttaaaaaccgaatttaagaaagaggaaagtactaattaattccatgcatgtatacacgccttatattataaaactattaagaaactacgggtgatctcatccacccaaggaaataggaccaacggttgctaatctaaccgatagagaagaggagatcgcccctctctctccctttggcgtccctctcgacaaccgatgcgatgttcccaaacatcgcatcccctgcggttggcaccgcttcacattgtataaatgtactgttgatcaatgagaaaatcatccattcgctctattgtgttcaattctctctctcgctcaatctctctcgctccaatcaattcatccactttcaacacgttagtcgtgccttatattttagcatgaagagagtatgtcatattaataagtttaagagataatatttaaaaactgtaatagtaacatgtgggctggcagattcactgccaacatcattagagtccttttaaggaagtataaatcaatgatacattaaagaatcatatactacctcagtctcaaaatggattttgacaatatatcgataaaatcctttaaagtcagagatatcattgtagtatccttgactttcggaatgcaattctaaagatagcataaataagtgatagagaattttttttttgtttgcaagggacaaaagagttcattgatcagaagataaatccttccccataggatgtgagatgaggttataagagttaccacatcaaaattctgagcttgcttcacaatgagcataatttgcaggctcgtagagagttgcaaacatgacaaactttttttttccttagaaagcgtggcacgccatatatatttttcgtggccgaaatttagcgttaatttacatgaattgttgagttgtattttccatatctgaatgatcgtatagctgctaaacgtaataaatcttcctttttttcccgaataattgacactgttccaactgaatcttggtccttcagagatattggttccccggcctatctctgtttagccatgtgttactaccaaaaaatcagtcataaatgctacatgtgcagtcaaaagtgacgatatttagaccagttgctcgagacgtgccctaacattaccacaaaattaaccaaacacatcgtaagtttactacagacacatctgacgagttt

SEQ ID NO: 46879 - DNA, 14669 bp, Oryza sativa
  unsure (1)..(14669): unsure at all n locations
tcctgcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttagcaggtcctttagcctgccaaagcagaccagtgcaagtgaaaggagtgctggatggcctaggaagaagcctggtagaccgagcgagccgagtaatactgatcacttgtccaactttagacaagacgctcctttgtgcgactgtgctcgaagagagctggacaggaagtaccgtattccagaccatccgaaattgggagatgacagggaccgtgagagtgccatggatatccctaacccatcttgacagtatcaaatttacatgtaagtaagatcacatcaagacgttcgatcaaatggggaaaaaatacaattctgatggaatttttgcttacgttgtttgacagtgttacatcgaggcataatgagacgagtttattcaagtggacacatcaacttgtgatggttagtatgtacctagctagacctacttcccagctactagtatgtgatctctgatcaactgctgactttgaccagctcttaatttagcaagcaactagctagcacaattggaatactaaacctgtctcgttctagctagtttatttaattgctgggttttcagctggaagaatgaactccccattgttttcaaggtaatttaatgtagctaattaattatgtagtggtagtttttttgtttagtctgatactgtgtcaacatctgttatctgcacaataatctccaatagtagcaactttaagacaagatatttgtcatgtcaagatctgcctactgttcatgcaagcatccgtacgtcgtctcaccctcaaaatatattttagcagtatcgaaagggaaagagaagttcatatatgtattattaccagtttattagttaattaattagcctttttttactaaccgattggaataatgcagatgtcagatgaaagcgatactccaatacatatccattattcccatataatctcatcctttcagagaatcatatacatgcagtacatgaattaagtatgtaaagcatcgaactcggtggaattgttccgacaacgactaggcatgcatgcagtgcacctaatcatcagaacccaacaaacaattgctgcatgcttttttcaccatcatcatgcatgcatatatacttgcacggctgcaatgatatctagctaactagtgagacaaagtacaattagtagtactagtaacaactagtcaaaccaagtaggattagtactagtaactaatttctaattagagtaaagtacatggctggtctttaaagttggagcgaggcgtcacttaggtatatgatcttgaaaaatcaacattaggatctgcgatcttatttaagtgactcattaagatccaaaggacctctgaccgggctaatcactggctccgatagtcgtctaacttagggaggactagtggacgaagaggtcctcgccgccgttgtccgaacccgttggtggcgtcaaaccccttcatcgtccccttcaccctctccgacaccatctcgcccttgccaccgcaagttgaaccctccaaaatcctagaagccgcccgccgccccactctgcaggccagccgccgccactacccttctcgcccttcccgctccccttcacctggggcgacctcgactcggccaactccgagtactcgaggtggcctgcccagcgcttgcaggtcctgctgcggccgccacaagcaacggcgagaagggctggccgccatcccttgcccttctccccctggtcgccgcccttcaccctctttgcgcatgctcgccaacccgccgctgtacccgcctccctcctcatcatcattgtcatcgtcactgccgccgtcgcgtctccactgcaacccaaattgcccgtgcaaccgcaaaccatagaaatcacaatgaaagaagagttggggaataagggttggatcggatgcagggggcaaaatgcaaatatgctaccactctggacggccacgtaagccagtcaacccggttagaggtcctttagacctcaatgagtcacttaaacaagatcacggatcctaatgtcgatttttcaagatcatgtgtgtcgaatatgtgtacgtagtcggttacagtttaggacttggagttgtactaggtataggactagagtaagagttggactctgtcctaggatctctcataaatagaggggcgtgcctgttgtaaccgcatggcgacatagcatagcgagagggagcggctgccggcggcgacctgccgtgagtcgttgtaactctgatacgttgtaatatgctggatcggggaggagcgcccgtaatcggtgccccagagatgtaggcctcggttgaactccgttatcaaatatcgtgcatcggtgtcgtcatcgtgtttggatcttctatggtgtttcttccacgtttggtttccgatatgatttcggggccggttttataacatcatgaacctaagtgacaactcgctccaactttaaggaccggtcgtgtactttactattccaattacctacattaactccttacaacctgatactacattagaattttgtgacctttctaaaatttcgccatttagcatgtatatggaaataattatatgtatgtgcgtaaatttttttttccaatatgcatgcatgagatttatgtgtcattcaatcaaacattgagctaatgtttggagtagatccaaatatatacgtgaatatatattcttttgtcttttagattacacgaaagacacatacgcacacaccacacccactagccttgatcccggccgtacccacgagtaaatccttaacacacactttaattatctgataattaagctcgagtagcaacaccgtaacaaggcctttatttccaatagtacatggttactcccctgtactaaaatataaatatttctacaactcataatttgtaccacaaagtatttttggcatttattttattaatgcatagaaattcatatatttttggacaatcaggtacttgggaatagaatctaagcaattcaaaattcgaccattgaggcgactgaaagagaggttttttttcttaatctttgtattttgctaaacaacaataaaaaagaaatacttatattttaggataaagagtagctataatccatcatttgctctacgactaacaagccatggaaaaaaatgtcgcaattaacaaaaaaaatatttagacaaaaaacttttatacatgtgttgttagcgaattaaaagttaatattgaaaaataaactataataaaaaaactctcaaaatcaactccaataataatttcctaaatttaaattttaactacgactaataagccaataagaaagctgtaggtaaaattaagatagcatctccatccatccatccatccatccatatcgatctgtcttgtcccatctcgtcgatgtctcacatctgctcatctcatcatctttcatctcatctcatctcatctcatgtgcaagtgcagccaataatgggagccaataagcactaggagttggtttcagataaaagacgaggcccctttcgtccagtatttaataatctcagcaccagcattgccggggccctcgacggcgaccggccgtcgatgtcccggccgtcggcggccgatcgggcggccacggcggcaacacgccgcccgccgggcacgtgacatgccacgtgaagagagggccggccggccggcggtcagtttccggccggtgtcgccgtcgccgtcgtcgtcgtttatcttgcgagataagatgagtacgtcgttgatcgatcgagtagtggtgatcaatgttgaagctaaagctttggaaaaaaagagttaattaaattaattaattaattaattaattaattaattaattaattaattatgtgcgtgattagacttctgtgagtgctgaccagctaataatgcatgattcctgctgatctctcttttattggcatatgtatgttaggacagaagtggtaattaattagatggcttaatcacacatactcccaaaaggtctccaaacgaggctgcaccagagagagagcagagacgatcctccttgcagatggatcccataaccatcgagatcggcgaaagcaaaaatcgaaaaccctagcattccgctccttccaaagctgctaggacattagaaggaccaacgagtcaaaacccttgcgaagatgcgcaggcatgcaggcaaactttagctgtcggccaccagacctaaatagaatcgccacgggtgagggagataggatgcaatgccagacttggcaaacgaacaaacagtcgagcaggatatagctcgctgtttcaagctcctgagtgcagaaggggcaagccaagtggttgtcaatgccgcgtttatgcagaagatctgtcatccagcaacactgctggaacgcaagccaaaggaaaatcttgcacttgacaggacccttagcctaccaaagcagatcgacacaagggaaaaagtgatgccccacgaagaaggtgtggtaaggtgaggcgggggagtaacgctagttgcttgtccagcgccagacaagacaatcctcagtgctcggagtgagatggacgagttgcaccgcatcccatactaacagaaattgggagatgacggggactgtgagggggccacagatgtgacccacccaagagttgtcaacaagagcggaggctaccgtgtgcgtcgcctagaggcgagggggtagctaggatgagatccagagccagggatatcacagagcggccctgaatccactggtccaaccataagagggtcgactcgccatcactcagcatgaggaaggtggaagccacaaacatgtcaaagacggtccgctcaaggggtgacttgaggtcggctcagtaggggtggatagagcgcagaagccagagccagcgcatgcggagagcgaaaaccgccgtccgcaagtccgagatgcccaggctaccgacgactttagggcggctgacattcgtccaagacacaaggcaacgctcaccctgaaccgaatctgtccccgactacaggaaagcacagcgcttcttatcaaaggccttgatgacccaggttggtagtccgattgccatggagacatggatcggaatagaacaaagcatggactgtataagcacataacggctggctaagttggtgagctgacccttccatgaagggaggcgatgggagaacttgtccaccagaggttgcatgtctatattacaccaattcatgagaatatttgcacatggaacacgcgttttatgatagttgtcatgctcttttttaaaaaaaaagaataaatgatacttttatatatttttttagatttttacatgattcttggtatttttattaattgactgtcaataaccaacttttgacttagtggagcggcaaagggacaaggatgcaaatagtgtaacggagagagagagaatgacatttctcgagtgtctgaaaagggatatatatcaacaagttccacaccaaccatagaaaattttctgccatttcatttggcgacaaatttgactataacaatttattacttgtttgtcgacatgctccatatatatataacgacctatttaattaagaccagaaaattgtgccaccaatttaaattaatatccacctcaataaatgtggtacgtgcggtataaattcagctctatcaataatgcacaacatgcatgtctttttcccctatcttttgcactactatgacgtccaaattaacctctgccgcaaacatttttgctgctaaaaattattgatgatatatatatcgttcccatcgaatttccgatggatatgatatatcgatatcgagcagttgggccgagttgatctgatggcatgataaagagagaggcttgcagcgaactgaactgaactgaatactgatatgatccgagagagacgacgacgattaaataccgtattccggacggcacggcacggcacgctccccaaacaagcgtatactacacatgtacgcatacatacgcattgcgtatgggtgtgtttagttcacgctaaaattgaaagtttggttgaatttagaacgatgtgacggaaaagattttggaactaaactcggcctatatatacaaagtaacatttagacatatatatgtttaatcatttgttttatttaaagttttgtgctaataaaaaatgcacaagtcataaaagtgtctttataatatagtaaaacggaccacaacaaaataaataataattatgtaatttttttagtgagatgaatggtcaaatgtatgtgtaaaaatcaacgacgtatagtttattaaaaacagatggtgtatgtaatagtttacaacattgtacatatgaataattaattaattagtacgcatgcatatcaatctgcatctgcgtgccgcaggattttcagtacaaatttgctatatacatataagtatctatatgtagatcccaattgcagcttaactagttgaatttatatattcatgtacatatacaaccacctcaaatttagttcagttgattaattgtagttaaccccttgctgtgccaaggcagctattttagttggtctatactaggctggttggatgagagtatacagcttcttgaatcattcaattgtctctcgtaggctggttctcatgtactaattatattgttctctcctataggttaatgaaagctctggaattctcctaaaagaaaatttaaggtgtgactgagtaatatccatactatttcaatttcaacttttaattaggtggttttacgatcggtgaagatgcatgcatctccacgtacgcataaggctccatctgtttgatctggccaacactacctaattttgacaagaacaggtatagcgcagtttacttcattcctagctggtgactttatcttcttttgttacttctctttatttcttactatatttagtattcaccagcactttctgtcatttgcttttcagcttgtaagtcgcggccaaaatctaaatattaaaactaattttttgagttgattttggaatcttttttagcttagtttatttttaagcattgacttttaaattacataaaataaatataaaatttttgttcacaaattatttttttagcttatatataacatttttttggcttatcagctagaaacaaaacgatcatgcgaggaaccgaaatatattaattggtatgtatgtgaggaattgaaatatgttgttttttcatcttgattattaatatagtaaaaataatataattgtgtaaattaataaataatcatgtagaaaaaaaataagaacttggtagttcatttattagaataaaaaaagaagacataggcgtccaaagtcgtcaagtacaagtgtactcaaacttgtgcgtggacacgtgaggataatgtacaattcaactcccctcgagcttgaaaggtcataatgtgaataaaatatatatcttcatttttttacgagaatatatattcatttcgaaggatgatttagaacaattaattgttccttatcagaatatttgaaattttatactatatagattgactagctctttattaattatggccagctccatcgatcacacaccccttcagctaaccgatctatgcttactattcttccacccaaatctaatcttaatgtagctataggccatagcttgaccaatctatatgcatgcatgtgttgcggccctcacgcattagtagccaaaattgtaatgataatatggaatcttgtactctctgtctgttctaaaatatactctctccacgccgaaatataagaatctagaattggagagaacatattctaatactgtaaatttagactagacagacttcttagcaagattcgtacatatacttgtatatacgtgtcccatctgatatatatattttaggatggaggtagtagtaaattttaatctttgacaccaatagtaagaagagtagtaaaacaaattggttgccttgttgggatgagtgaggtatagatccagattaattagggctataatataaccatgcggtagtgtgggtagtttaatagtacaagttttttaataatggaatttattttgatctttgctttaccttttgcaagtattaactaaggtgttattttagaacaaattttgaattttaaattgttgttatatttttagggcagatgaattatatatctttagagaaaaagaggaaaatatgtactacctccgtcctaaaatataagtattagagttagacacggttactaagaaagtatgtaaaaagaaattgtggaagattatcattggttgagaagtggagattggtgaggaaattgaatggtggagggttgtgattggttgagaatagaatgttggtggagaaattgttatattttgaaacaaattctaaaggctaaagttgttatattttaggacggagggagtactatatcatagtcattaatgattaggacatattattaagagagaatccactcagtgccattgagttttcactacttctacaatataccactgactttgtcaagttgaataatatgccatcgtgttttcccgaacgtctactgcgtgccatcacagtccagaagctgttagttgggcatctgttagagctgtaaaaagacctatttgcccctaactcattgtacatgtttttttttttgccgagggacatatgtattatatgaatacatatagagaaactgattgaatcatataacagcctatgattgctagcttcacgcgttggtagagacgtagtgaactagtgatctgttgactttgaaatgggacatatcggaaaaaaataaatgtacataatgaaaaaaaaaatcaaccccatacagttagatataaaacaagtttgaacatggtgcatggcactgagctcatatagatatagaaatgaataccaaaatattttactaaaacaggtgctagggtttattagtcatgggcattttagtcattaagaaaaaattcaatacaccaaacggatgcaccctaacggcttgtggacggcgatggcacgcagtagacgtttgggaaaactcgatggcatattattcaatttgacaaagtcagtggtatattgtagaagtggtagaaactcagtggcactgagtggattctctctattattaattaccatcatgtaaaatataaaaatggattgtgacatacgcacattccattctgacctgactgagctatagctactaattaacagctccagctcatgcaatgcaatgcaatgcaaccctgaaacaacaagcaatatatattgaaaaccatttagaccggtttatatattcagcaacagaatcgtactagtagcatataattagctcacatccaaatccttaatccgtaagcacactcccaaattaaacccggcaagttgcatattatccatgaaaaacccatcagttgctattgctatatactagcctctagctctagttgaccggcgagagtagtattaataccgctaccacgcgtagccgccgagctcgccattagcttgctattctctcttcttcttcttcttcttcttcttcttcttcttcttcttcttggtgtgattgaggtggaggaggagatgagtttcataggcatggtggaggcgagaatgccgccggggttcaggttccacccgagggacgacgagctggtgctggactacctcctgcacaagctcgccgccggcggccggggaggaggggtgtacggcggcggcggcggcgtcgccatcgtcgacgtcgacctcaacaagtgcgagccatgggaccttccaggtttgtatatgcttatatgcgttttgatcgatcgattgattattgattttcttggagaaagaaagagggggggaaggaatattttcttgtgttgggatgttgttggttgattcgtttcgagaaagaagatttaaattccattattggtattgttgattggtccctgttcttaggtttttgggggtaattattggtggtgtttgtttggttcgtgttgtttatctagcttctttctgggaaatggaatcttttccttcacatgacatttgtcattttgaagaaaaaaaagagatggactctttccgaagaaaaagatggcaaaaaattgtaagatttggttttttatcttcaaaagttggaaataaagaagaatttccatcaaagtgaagcagagtggcttctcacaggttttgaagaaaatgatgaaaaaggtaacacaaaagtggcctctcacagattttgatgaaaaaagatgataaaattgtaacagaaaagaatttctcatgtattttaaattgaagagaagagataaaaaattgaaaatgatgaataaaatcatatattttgaattgaagatacgagataaaagaaaaatgaaatgatgaataaaatcatatattttgaattgaagagaagagataaattaaaaatgaaaatgatgaataaaacataaacacagattcagattttgatgaaaaagatggaacaaaacataagaagagataaattaaaaatgaaaatgatgaataaaacataaacacagattcagattttgatgaaaaagatggaataaaacataacacgaagatttatacttcaatgaaacaaaaaataaaatggcgtcgcccggactcgaaccggagaccttcagtgtgttagactgacgtgataaccaactacaccacgacaccgagctgttcaatcatctcctcttcccaattcgatcttcgtctgatgagttcatgatcatcttctcttgtcttttccaatcgatctttcaattctctgccgccattgtttgcagacgcggcgtgcgtgggaggcaaggagtggtacttcttcagcctccgcgaccgcaagtacgccaccggccaccgcaccaaccgcgccacccgctccggctactggaaggccaccggcaaggaccgctccatcacccgccgctcctccatctcctccggcgagccctcctcctccgccgccgccgccgccgtcggcatgcgcaagacgctcgtcttctaccgcggccgcgcccccaagggccgcaagaccgagtgggtcatgcacgagttccggctcgaaccgcagcctctccacctcaaggtgaagacagattctgaatttcttcttctctcttcttctgtttttcttttttttttgttgttgttcttcgttcggattgcgtggatccgacaagatcagagcacgccgttttcgtgttcatgttcggaggaagaagattgatgctgagttttcttttttttttctgaagaaaaaaagatgatgctgagttttattaaaatgataggggcgaaatgaaaagattggttgctgtttgctacagttagaatacctgtcaaagaactcactgtcagattatacatgttcagaaagctctgttacaaataggggggaaaaatcagcttttagggaaaaaaaatgatgctgagtttcttttctttttctgttttgttttcacacactatcatgaattttattaaaagatagggggaaatgaaaagattgattggttgctgtagatgtttctgtttgctacagtgagaatgcctgtcaaagaattcactgtcagattatacatgttcagaaagctctgttacaaatagaaaaaaaaacagcttttaggggaaaaaagatgatgctgagtttcttttcttttttctgttttgttttcacaaactgtcatgaactttattaaaagatagggggaaatgaaaagattgattggttgctgtagatgtttctgtttgctacagtgagaatacctgtctcactgtcagattatacatgtttagaaagctctgttacaaatagaaaaaaaaatcagcttttaggggaaaaaattagactttttttattgtcatgttgctacctccagtgagctcatcatcatctgttgtgtcatcatatgcgtgttgccgtcacctaccatggcaattggcaaagcctgaattttgtaacaatatggtctctaactgttcgttttcaggctaactcgatgcttctctcaacattctttcctgataaactagctgcaagttgccagggctctagttttagttggatgaccctacaaaaagtttagtcttcttttgatccagtccatagttgttcagctggctccatcagattactgagctagattaatgtcataaacattccctccaaaaggatttgactgtcttatcgtggttgtttactccaagttgacacttaaaacattcaggcttccatgattgctaactcatcaagcaactatataacttgccaacaatgatttcctcatgcaacttgctgcagagtctgttatgttggttgcatcagcattatccatcgtgctaataagttaatgaaatttgaagtcttcttgtccttaaccactacatatgacctgaaaatgatttgattctctacagaataatgttcagttacagttattacttattacaattttaacctttcatagatcatttgcacttaataccatgttaaacatgaacatcacctaattacacgaaaacaaaatacaggaggactgggtgctatgcagggtgttctacaagaccagacaaacaattccaagcccatcatctgaagaggccgtcacactgcccaatgagctagacctgcctgccacgccttcgctcccgcccctcatcgatgcctacatcgccttcgatagcgcaccgacgacgacgccatcgatggtcgggagctacgagcaagtgtcctgcttctccggcctgccggcattgccaatgaagggctccatcagctttggggacctgctggccatggacacctctgcagagaagaaggccatcagggtactgcacaacagcaacactgcaaagctggagctctccccagattggggacaggagagtggcctgtcacagatgtggaacccccaataatgatcttgatcttgatattgatattgatattgatattgatattgatattgatgatgtttgtgttgctacttgctagatagcgattactactgaatgcagtgtggcaaataacttgtaaagaggtgacatattctttcctctgctggagtagtagctgtgcatacattttgtatttgattggaaaatttgattaggggtgtgacatacacagtagagtagtgaaaatggcttggtgtagaatctgtacataggattgcagaaaagggttatccctttctctttactctctagatgtatttgtcattgcagatgaataaagatttcagagacaggcattgtgtggataaaccattcaacaccatttgacttccatttactgttccatttccattttttgtgggcttgaccatttgttgtgggcctttagtgcaaacaagctaataataatgtatggtctgtttggctggggaaaagatttggcctaggaaaaagaacagggaatttataattttactgaatttcagattagagattggtgtgggatgtataattgaactttatatttgttttgaggattgggattagaattttagatttgaactggactaagattaagatccatgtaacaccaaaagaatcacttttttaaaattacatactccgattttaattcaggttcattgcaacagcacactaactctgcagccacaaaattatggtgcaccatgtgcctgcagaaggtttatgtttgacaaccttcaagtcatcgattcaagctgtgtgttcttgggagtgttcttgagtgctcatcatctgttttgtcaacctgcacatttcagtgacccaccatgacgatttgcaagcctgaatttgatttctaactgttcctgttgcctgaaatgatcttcaggctaacgatgcttctctgaacattctttcctgataaactacctgcaagttgccagggctctctagttgcatgacctagaaaaaatactcttgttttgatccataccagagtttttgatccattctagagttgttcagatggctccatcagattactgaagtagtagattaatgtcgtaaacattccctcgaaaaggatgtgattgtccaagagtatttgtttactccaagttgccacttaaacattcaggtttctatgattgccaacttttcaagttgttgagttgtgatccaaatttatttacacttaataaaggccagcttctgccgtagcggagcgaaggctgaagttggcccattgggctgtgcgcctggggatgcccgggggtgc

SEQ ID NO: 46880 - DNA, 9299 bp, Oryza sativa
tgggtaagtcgttggcgaagtcacaaggccctccacttttcattttaaaaccgataaacgagaaaaagatggattgttttgcgaaagaatctttggacccataaaaagcagattttgtgcttgtggaaattctcgagcgagcggagctgaaaacggagatgaaagattttgccaaaaatgcggaatagaatttgttgattctcggatacaaagatatcaaatgggatgcgtcaaactcacattagtttctaatgcaaccatttcatggatcatttacccaaaatatgtactccctctggttctatattaattgacgttttggacaagattgagattaaacttttataactttgaccatcaataactttaaaaatatttagtttaaagaaactagaaaaacatatatagatttgtctttcaaaacactataataaaaataaacatgtatttatttattgtatatattataatagaaaaataaggtcaaagatatatcttgtagagcgtgtcattatccaaagcgtcaattaaaatgaaaccggagggagtataaaatataaattattgaacactgttccaattccaattttcctaggcttgggctgggccaggaaaaaggcagtgggcctctggctggaaagcaaatttttttttaaaaaaaaaggatggatgggctgcttggcttgggaaaagattcagcccaagaagaagaacagggaatttagaactttacagaatttcagattggagattgatttggaatgtgcaattgaattcaatatttgatctgaggattgcgtttagaatcctatatttggactgtatatggagataaagatccagaagaacacacagaaaaaagattttttttaattacatattttgaatttaaagtttccgaaaaagacaaaactgtgttaaattgctcttccaattcgcgtctcctgcctcatatatgccctggcctctggtttggtgggtagggtcaaattcctctcgagaggtcacacttttgacatttcaataattcctgaaaagtcatcttctagcactgcaatgtgaaagctgttttacgtgctatccttttgctttgctttttgtttgttaaactacttagcattgaaggccacattttgacttattttagtctgtctacactcctttttttttccccttaaacgctactccttcgtccaaaaaaaaaaaaaaacccaaccttggtaaggatgggacgtaacctatgacaacgaatctgaacaaattcgttatcctaggtaatgtcccatcctcatcaagattggacggagggagtacaagtgagagccaaagtagcactgatggaaaatgttagtcaattctgtttcacataatatagcacatagaaactactatgggaagcacctgatgcctggtgccacgaatattacgcgcacacacgagtgcgttttgactagttatattccagtacagtacatggcatttgactagtttacatatgatgaaagaacaaaagaacaaaaaaaaaagaataatgcaaaatcgctattggctgtggcatttccatagatatagaaaaatgccaaattttcaccactgcggcatccatcagcccagcacaaacctctcatcttttcagataaggaagatcaaattacatctctggcctgtgcatcataacagcctctttctctatctagcataacaatttacaaatggaataagttggttgatacaaagttctttttttttcttttcatagcgatgatcgtgtagtcgtgtctgatgatgtggatgggtcagtggtggcaaaggatctcatcaggagagactgtggatcaattggtctctgctggctgctacctctcaggtctcccaggtcaccaacaacagagggcttggtgatcctttctgtgttgacatccttctctccggtcagcatctggacgatgttgatcatgttgggacggagtttcatcgcatcttgagtgcatagtagtccaaccttcaagaaccggcatgcctcctcgacatccacatcatcttctatatctgcatctatgatctcctctaaatgcccttgctcataacatgtccatgtctgcaagagcaccggcaaacctttacaggttagtctggagtccggacgtcaatgcataaacataataattgtcagtattctttagtatggtattatggtagagcttaccctctcaagcagaaattgttcttcataaggcaacctagaattatagttgcatctgccgctgacaatttccaagatcaaaacaccgaaactgtagatatctgacttcttagtcacttgtcctctgagtgctattcaggagctaggtaccctctgataaaataaaaggacagagtaagacaacatggggaatatctatgcaggaatttccaaaagaccccctaaacacagttaaacttacattgttcctgcaactcgggtgctcacatgagtcgcatttggtgggaggagcctggccaacccaaaatcagatattttgggggtcatatccttgtcgagaagaatattgcttgcctttatgtcccggtgtattatgtgaggacgaacttcttcgtgaagaaatgcaagcccacgggcaacacctacagtgattttgacacgagctctccaattgaattggatgttgctacggcctgaccctgcattgccatgtgagtgaggttactgttaaagagtgtcttgattaagcaaggacagactaggtagaccagtatgttacctagtagtgtatgttgaaggctgttgttctcaagataattgtatacaaggatcctatgagacccttcagcacagcagccgactaacgtaattaggttttcatgcatcacatcggaaattgctgtcagttcattaatgaactcacggacgccttgccttgaagtagcagagagcacctttactgcaactattgtcccatctctgagccttccctgatcaaccaaaatgaattttaagcaagtgaggtcgatgtaatatagaatggatattagacttagttgaagcgaccaaaggctttggtacattaccctgaacacagaaccgaagccgccctcaccaatcttgttcgccccactaaaatcatgtgtagctcttctcagctcattgtaagaaaaaatcctgaccgctttttctcctgaaaccgccagaaacaagttgcaagtcaacaaatgtatcagaatgaggagcattctgtatacagaagagactatagaactaaatgaagacatgcccaccttgttcaccttcactagtttgttttgtatcattcccaaacataaagcagcaagccatttttgcaaatcaaacagaggaagtgccttctgctgaatatctgcagaagaaagaggaacatcaaaacggttttttttttttttggtgatgaggaacaaccagtcagagactcagagttactgtaataagtagtctcatgtcacaaccattgttgtgtaaacaaatatatgtccgtttaccagtaccacttgaccatgaaaacaaattggttgaccacacaataagaaactggcatcagcattagtaatataaaattctttagttagtgagttctacactatctaatcaacttgctgcatcactagtttactgcattaaagtatgtccagtggagtacagggaaaaaaacataatggtgaaaccagtcaatgcaattcatcggcgcacccaaccgacatcacaccaccaagtgaagggtcagaccctcctccacaccctgcgtggcagccaaacaaagggagcaatttacaaatcaattccagcaattgccacagctggcaaaatttatatctatttcaaagtcaaaggggattggatccagttgacaggcacaaggtgggcactccttcagatccataccgaacaaatgtgtatatttctcatcaaagcacacgttgtactaatctgaatcttatcagacccatataccgaaaatacagagtgagcttttctgaaagttgcagtttctttctttttctcttaacattgcaagaagtactccattcatttcaggcaatcactcaatcagggggagaacaccgagttaaatggttcatacttcctgttacttatccattaataactctgtactaatctgaatcttatcagacccatgtactgaaaatacagagtgagtttttttttctgaaagttacagtttttttttccttaacattgcaagaattactcccattcgtttcaggcaattactcaatcagggggtaaacaccgagttaaatggttcatactgcatgctactaatccactaatcatgtttctaaggtgaaaaatcattttatacatccagcattccagctcctacgcaacttgagcgtttgcagaacaatcaccgaccaaaaattcagcaaaaatggcaaaacagcacacaataatgattcaagaatcaagattacttcaaaccctttttttccccctgaggccgacaaattctgcggagagaacccaagaaacgaaaccccgacgggaggcgaattcaatccgaatcacaaagccaggcagcctcaaacacagattctcgaacaaacagaggactgcatcagcatcaatggtggtcgtcagagatcatccccgcagcaacaaacagagagacccgcattcttccaccgagatgctatataaaaagattcgatctcgaaccaactaggtcgccccttttctcatcccactaactaaaaattcgcggatgccaagaaatagaaacccaaccacaccctctcaaatcaagaagaatcacctggcgtctccgtcggcgcgccgcccgccaccacccctctaatgccgacgctgcccgcgcggcgcacgcactggctgcctcagcggaggaggcaagaggaggaggaggaggaggaggtcggcgagagggcgtggcgacgttggtgagctccgcgagtcatccagctatagtggggtactggggtgtgggtgtgtaggcaatggttgacttttactcctctgccggtctcctcccctatgagtctctctctctctctctctctcttttggatagtgactttctctctctagcaaatgggagcccatcagcagttgtaatccgtagttcttttcgctcgtacaaattttatctccatctttgttagcgcgttttttaaattgcttagcgcccctttaaattaaagtattttatgtacgaattttataggattcagattttatagaaatttttgctatatggtcatttgattaaaagatttaagctttccgaatcatatgaaatttatcgatatcgtttccgtaaaattaatatgataataatatttttactgatggttacccttttaaaatttagtttttccaatttatgtctgcatggcattggtaaatatggaaatttcccaaccatttttgtctgttttaaaaaattataaaataatgataccgtttgtgaccatttccgaccgtttttaccctaaaaattcatatgaaatggctcattgtatatagattttagagaaaacttagtaaaagcttaaatctcttggaaaattttctttggatctatctctctcatacgcttccatgtgtgttttcctatgtttttacaattctctattttacacttggattcctattctgtgtttttttctattactccatttttccaatgctatgattcaaaggagctcttaatggtacggaaacattttagatagacgctacttcaaaaatattagataaactaatttttcaagtttaaaataattaaatttaattacttatgtactaatagttttctcgttttatgtactaatagttttctcgttttatgtgtctgtatttaatcctaatatttagtgtactcaaacgggcctaatactagtgataaaaaatggttggattagggtattttcgcgcgtggccgacgtgtaattatcacgtggccatagggcagatcacagatggttgctgcaaattaaaacaagaataatgacagttaagaaaatacgggtatgatgaatgggagcatatagtattataggcttcaggttgtttgtcttttgtggactgtgatcgatgataggagtagtattatactgtatcccatattgctgaacttttgtatgtgatccatgtagcacacaagggcaaataggagggtcgacagtaacgtggtctcatgacttcattccaagttgttttgtacttttgaagattttaatctcttcgaagttgcagaggccaaaacttgttgcatttttatatataattaacaccatttattttttttgctttacgcaagttgctgttaaaacctgtaataagtttggcctgtagaggctggagtgcttctttgatgcgatcttgtgtttcgaaaaaattggtttggggttacacatatcttataggtaaaaactaggttatctagctttttttggcaatactccctccgttttaggttataagacgttttgatttgatcaaagtcaagtttgaccacatttatagaaaaaaatagcaatattttcgacacaagattaatttattataaaaatatatctaattattaatttaataaaactaatttgataatgtaaatattactacatttgtctataaacttagttaaacttgaagtaatttgattttgactatcctgtaacctaaaacgaagagtgtatattataatacgtccatttgaagtatggacgattatttgagaggttctcaccgtattgcaagatttatatccacgaaataaacaactgtccaaaatccaagaagatatatggggacattgtgattctagaggactaggggcttctttggatcgaatggcttccgcgtgcaatcctagccttgtcattttctttttggcgattgtaagaatttgccaattttaacattcaaccaaaagacaattaatgaataatttggcaatgtcaatttttctttacaaaccaaacagatgtggcattatcaatcattttggcgtggctgagtttggttacaaaccaaacaagccctagaattaattatcttctttcatgtaaagactttctaaagatcactcatgtgtatatatatatacacagtatatttctactaggttctggcgtcctgccatctttctcatgaggtgatacattcacttattcaccaatagatcaatcattttatcatttccccctaatatagggaatgtgaaaataaatatgcacatgcatcaacagagcgtagtcatgttggggccctgatttccctcgtattgaattgtccaactgtcggagtcatagaagaagtcatataagaaaatgactgtagagaaaaagaaagtcttctctcctcacgtccaccctaggattttcttttgaacgcattataatttcttctgatttttttaaaaataaaactaattcatatgaaaatcccaatcgaattctataaagttattgcgtttgattgaaggcctaagatcatgtgagtacaattccagtcttgagattgggaatcacatcactggtgtagcagtggcaggggacgctggcatgcaccccaccagcttgggttcgacccttgtcgagcgcgctcaccaggggaaatatttacctctcttaaaatcattgactcaagttcttccttgggtccaaccttattttttttcacatcactagtgtacaaaactgggaatcacatacaagatctctccttgactcctttattggtccatagcaaaatttaactctgtttctttctatctcattttcttttccctctttttatgaaaattttagaagggagcattttatctttccttgtttaacgtttatgattgtacttcacttgtaatcatacacatgcgatgcacgttatggcaatatatgttatgaaatataaaaccgatgcaagatatttgaaaatcatatgcaaatccactacttattatccaaaagactttacaatacaagtcataatcgaaagacttacaaactaatacaaaccattggaaaatcatgctagaaatcatatacagtaacattaacattaaaatttacatgtagttccggcgacttgggataaattcggaaaccaatagaaacctagtactcccttcgtctagttttgatagtcatatttcatcttggcacgcagaccaaggataagtgattctacttatcatccttttaaacatgctactagtcattactcgtaaacatgcgattcattaatatttacatttctcgatgcccatgtagccaatcttgtgtggaagaaaggagagtcacacattaaatacaagaaagtcattaagatgataagttgttggattgaaatatgcctatcaaaaataaatttttcatatttggaaatatgactatcaaaagtagatggagggagtatcaattattgcctttcgttcttcattgcaagactaattgaggggttgatctgatgggcatgtgattacgcacatcgcgagcacgcggtgaaaaagacaaaacagtgtacgtgcgattgcaaattttctctcttgcttggaccttgagcagattcgtagtattagaatatatcacattcgtagtattagatttgtaggttagatttttatggaatggtgggaggatgttttctcctagtcggcatttgagcccacgaacagagtgcgggcaatcaaaagaattatagacatagactttatagataaaatatttatacataaaactttatacaccgatattttatacttgcatagagacttttatacgtataaactttgaatatactaaattcccgtgtataaatttgttagcagatattcggcaaaatgaaaatcaatactaaaatagttcttgaaccacacactgaaacactcctaaaaataattaattaccgtggagggaattggatataaaaaatgcagaggaatagataacaaaccttaaacatgctaagaataatttattcatgtatccatcgaacattgacggcacctttgtcagctaactcagttggtgagaatagtgccgcgaccacatcaccagctctaaagggtcttgatcatcatgacagcataaatctctactactaaaagacaacataaaaacattaaccgccacaataatttgacaatatgcctaattacaaagcttagtcctagatgggtctaagcttttgcgttgtcaattccaatgcctttgtcgtagcctagctagttactccctccgtttcataatataaatcattctagcattttccacatttatattga

SEQ ID NO: 46881 - DNA, 2804 bp, Oryza sativa
cgtaaagacaataagaacactgaaattagtataactagttgataccccgtgctttgccgcgggatatgtaggtgaatacattttatatattatagaaatgtgtggagattatggatatcccatatctacacggcgatactatttgggctggacataggataccgaatatgtatagaatatcttatttgtatctcgggtttgtttcttaacttgtacaacaaggaaacaccttgagacttagttggttacgactgtattttgtctgtgtttgcatattccgttagggatatgtattctcttttgtaatacggactccttcccatatatataaggggggtctaggtgcctctaggggcaggggttgaattttctccaaatcatacaatcaataacacactcggcggattcatccccggacaggagtagggtattacttcttttataagaaggcctgaacctgtataaatcctttgtctccaaacccatacactttcctagcttgatagccacccccttttattattgtcgaaatctagtttcgacagttggcgcgccaggtaggggttgcgtcaagcttttcgccgatcagtgcaatgggttccgtctccggcatcgacgacctcgtcttccctcccgggcagacgtttcggttcggcagcctcgacttcatcaccaacaacttcggcaagatttctctcctcgactcggaatcagaccagtcgggagagaaccggatttcggtcccgtttggattcccgaacgcggctgaaagctacttcaagaccatctcaaccgagccggcttcaaaccactcggccgagatcgcatcttctccaacgacaccagatcaagatgatggggcttacccaccagtcctgatgaagctccccgacgatttagcggccgtctccaccatgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacattgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggtgtgagcagcaggaccgtgagcggaccgcgaaggaggctgaggatcgacgtcagcgagctttggaagcagggcgccgagtgcgtgatctcatcggccagcaagatgtcgaagggacaccggtcttccgcacccctcaacagaatgcggttgccgcgatcacccttctcgacaccctcctcaaccaaaacgagctcaatcgatccgaccacgtcgtcaacatcttgaaccagactaagaccatgattgcggcttcggtcctagttaactccgaaagcgtccacacgccgactggcagccgagttccccacttccgatctcatgactaccgtcatccaagcctcagcatcaccgccgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggaccgccacgacgacgaccttgacggagtagcagccttcaccgacgacctgcgtcgagtggattggccagccggcttcaagccgactggaatagagaagtacgacggtaccactaaccccgaatcgtggcttaccgtctacggtctcgcaatccgcgcagcaggaggagacagcaaagccatggcgaactatttaccagtggctttagcggattccgcccgatcttggctccatggattgccccgtggtacaattggatcttgggccgaactacgcgaccacttcatcgccaacttccaaggtaccttcgagcgtcccggcacacaatacgacctctacaacgttattcagaagtccggagaatcccttcgagattacatccggcgattttctgaacaacgtaacaagatctccgacatcaccgacgacgttatcatcgccgcgtttaccaaagggattcgccacgaagaattggtcggcaagttcgggcgtaagccccccaggacagtcaagcttatgtttgaaaaagccaacgagtacgccaaagctgaagacgccgtcaccgcatcaaagcagttgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcgaggaagaaggacgacggcgacaccccggcaggttttcaagatcaccgcaaggagctcaatcatatcttcggcggccccctggcttacgagtctaaacggaagcagaagttgactgaacgggagggg

SEQ ID NO: 46882 - DNA, 1845 bp, Oryza sativa
atatcctcttcgccaagaccctggatgatatgcagatccctcgctccgagttaaaaccaagcaatgcgccttttcacggagtgattccaggattatccgcaactccactcggccagatcaccctcccggtcacttttggcacgcgggaaaactttcgcacagagaatatcagctttgaagtcgccgacttcgagacagcataccatgccatactcggacgcccggcgttagccaagttcatggccgtcccgcactacacttacatgatgatgaagatgcctggtccccgaggagtcctatccctacggagtgacatcaagcaagccgtcacatgcgacaaggagagttgcgacatggctcaaacccgcgagatgacgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcatggaaaccatctgatatgcccggtattcctagagaggtgattgagcattccttacatgtcaaagaagatgccaagcctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaagtcctgtcctaaagatccttttgggttgcctcgcattgaccaggtagtcgactcgaccgccggctgtgagcttctcagtttattggattgctactcggggtatcatcagatccgactgaaggaatccgactgcttgaagacttcattcatcacgccttttggggcatactgctacgtcaccatgccgttcggactaaaaaacgcaggagcaacttatcaacgtatgatccaaagatgcttctcaacgcagatcgaccgcaacgttgaagcctatgtggatgatgtagtcgtcaagaccaagcaaaaggatgatttgatctcggatctagaagaaacctttgcgagcatccgtgctttcaggatgaaattgaatcctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgggggatacccttctttaagctgctgaagaaaacagataacttccagtggggacccgaagcacagaaggccttcgaagattttaagaaactcctcaccgagccaccaatcttagcctcaccacacccgcaggagccgttgttgctgtatgtatcagccacctcccaggttgtgagcacagtcttggtcgttgaacgcgaggaagaaggccatgtccaaaaagtccaacgaccgatttattttgtcagcgaggtcctaaccgactccaaaacgaggtaccctcaggttcagaagctgttatatggtattctaattactaccaggaagctatctcactactttcaaggtcactcggtaacggtggtcacatctttgccactcggtgatatactgcacaaccgtgaagcaagggctgcaggaa

SEQ ID NO: 46883 - DNA, 2049 bp, Oryza sativa
tcccacaacgtcgccgagtatgaggccctccttcatggactgcggatcgcaatttccctagggataaagcgtctaatagttcgaggcgattcacagctggttgtcaaccaagttatgaaagagtggtcctgccttgatgacaatatgatggcatatcgacaagaggtacgcaagttggaagacaagttcgatggactcgagctcagtcacgttcttcgaaacaacaatgaagccgccgacagacttgccaactttgggtccaagcgtgaggcggcaccttctgatgttttcgtcgaacacctttatacgccgacagtacctcacaaagatactactcaagttgcgggcactcatgacgcagctatggttgaagtagactggcgagagcccctcatacgatttttgacttctcaagaactcccccaagacaaagatgaagccgagcggatttcaagacggagcaaactttatgttatgcatgaagctgagttatacaagaaaagcccttcaggaattctgcaacgctgcgtatctttagaggaagggagacaattgctgcaggacatacattctgggatatgcggaaaccatgccgctgcacgcaccattgtcggcaaagcttaccggcagggttttttctggcctactgcagtgtccgacgccgacaagattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggctattgataaattttccaagtggattgaagctaaaccggttgtcacaatcacagcagataatgctcgagacttcttcatcaacattgtgcatagatttggagtgcccaatcagataatcactgataatggcacacaattcactggcggagtttttaaagacttttgtgaggactttggaattaagatttgctacgcctcagtcgcacaccccatgagcaatggacaggtggagcgagctaatggcatgatacttcaagggattaaagcgcgtgtctttgaccggctaaaaccctatgccggcaaatgggtgcaacaactgccatcggtactttggtctttgcgaactacacccagtcgggccacaggccagtcaccttttttccttgtctatggggcagaggcaatgttgccgagtgaagtcgaatttgagtctttgcgctttcgtaatttccgtgaagaacgctacgaagaagaccgattggatgacttgcaccgattggaagaagcccgcgaagcagctttgattcggtcggctcgatatttacaagggttgcggcgctatcataatcgcaatgttcgatctcgtgcctttttagtcggtgacctggttttgaggaaaattcaaactacacgggatcggcacaagttatctcctttatgggaggggccatttatcatctctgaagtcacccgaccaggttcctaccgactcaagcgcgaagacggtactctcgtcgacaactcttggaacattgaacatcttcgtcgtttctatgcttaagcttatcattgtatttccctatcttgactgtcaacatcaagttttcttcttgccgttgtcagtcgggggctatcatcataataatggagtgtgattttttatcaatttaatttgcttacttggtttatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattaagcctccatttgctacatttacactcagtcagaatcagtcctttcatcatcagagttattattgctcggctgaaggtcgttgttgcggaattgctctacaacatcacttgcaatcttgtcagccgcactctgagcattactga

SEQ ID NO: 46884 - DNA, 4448 bp, Oryza sativa
ttcaaattgtcagctggcagtaccttcaacctccttcaaggctgagtccctttccgcagccagttctaccttgtctcttttcaaggcttcaatttgtttctccatctgagccattctggtggcttgcactgtttgaaatccaaatgtttgaggatacagttatgacagcataaatcaatggaatagatctggaaggttaccttttgatgaaccacttagctcgaagtttgaatcctggagctgggcaattcggtcccttaactccttctctgtctttttagcatactccttggcctcatgcagctggtccctaacttcttcaagagttcccaaatgaggaaccagcttttccaaagttgtagtcttggcctcattgcgaagatggattctctgcatgatggatcatggttcagttctgctaaagagagaacaaagttattaaagacagtcacccggaagatttacattcacaatgcgagtggcttctccaagtgctttcttcagctggcacacttcctcatcttctttttgacgatttataacgatgccggcaacttgcgagttctcgtcccaccatttgagcaagataggaggacgggagtcatcagccgcctttatgcgaggaattgtttcttcgtcatcgcctagtgttcctgatgtatttccaagacattagacgagtaagctgaagttatttaaatcggcatcacttgagaagatgtgttacctgaggatgttcctggctgaacatgaggtggtccttgttctttatttagagacccaatcattgagtctttaccagcctctggtccttgggaagttgtcgtttgcgcttcaacttcagggatttcttcatcgggacctacatccgactggtttccagtcgggggctctctggttgttgcagtttcagttgttgccgactggtttccagtcggcggctggtccctcggattggccttgtcatccgaagcatgggcgccagtcggctgactttcggcagtcgactggctttcagcagtcggctcagcatccttggatatatttggttctgtcacagctggatcaggatctttcccggttggatctatgtcggatggtttcctgcaaagtgttctctcgatattcagcgtaatctctatgagagaagcatgtcaaagggagatggcaccgagaagtttttacctggaggatgttctaatctttggcatttgacggccagccagtttcttcttgggcatgctacgctttgggagtttgtgaggcgagcccttgtccccagatttgtcgccgtcgtcaccttcgtcgtcatttagcaccagttttctcttgcgagaacctgtctgcccagtcggttgggaagtttgaggttgcggatctggtctgatcgctggccctccacctccctggacggtgtgctggcgaggcgatcggcgctgagtgactggggggtcagacttcatcaaagtatattcctaaatgagatgcttccacagttatccaactcaacatggagatgaaattatgttttgaccttgggttgaagattttcagatacatacctgcggaggcggattgaatgcattatatggcacaactggcagctggtgtgagtagctaacgacaatggcattttagaagattttatacattctctccttcatgattttgaaatccagagagtctggttcttcacggttgggatcatgcttgccgtcgaactcgaatgctgtacgagatctttctttgattggcgccagtcggcatttaatgaaatgccgagtaatctgctctccttgcaagccttgttctttgagttttaacatgcggtccatcaactccaaggcttggactgcttcatctccgattggaagagagttccaggtatcttggtacatcggaggaagacaagagtactcgggaagagcaggctcaggattctgaacatagaaccagtttgcatgccaccctttgtttgaagtcttgaagggcatggaaaaatacttttggctcagagttcccctcagctggaatcctgcctccccgactacgcacggtttgctcttgttcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttcgaggtcggaagagcgaagccgccgtagaaaaaatgcgagaagaccacaatctcatgtgtatcgggggtcggaaaaatctcaccgcacgctggccgccacccgatgatctccttagcagggagaacgccgtgcgccaccatttccttcaggttctcttccgttacgtcggacggcgcccattggccttcaaagctttctttctcctccgccatcgattttacccgaatgcgttgatttgattcgagggatggccggggagaagtgagggattgaggcggtggatcacgggaaggattttgatgcacttttcgaaggtgaatttgagtggagtggtgaaccctagttcgccggcgcggttctgcactgtagcaaggagtggggaaaatggcgagagttccggcggggaagacgaagcgtcgcttggatctcgggatttcttgttaagggtatcggaggtgcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcgcttccttggtatgttatatacctattttcattatggtaaatagtcatagcctaggctattagacttactcattaccataatttttataatacttggtgggtaatctttagagttttatattcggatgcctgtccagtgtgttcattcgtgaaccttttagagtgtaaaccactcggatttcttttattatggctaaaaagcagtcggctagaatgcctctttaggcgccgcgtgtgcttttgtcatatgatgcatgattgtgctattatattgttctcaactatatgtttagtttgttaactaatcacatagttgggggctacacctaattaggtgcgtctattcaatgcaccatactctttatcttttcgccctttacagtcttcgtcttcgctactcggcaggccttggcatgaataatttgaagcactcggattgctatctttgagaaggctatggtggttgactgcaaaggtctcgggggctactgtggagattatggatatcccatatctacacggcgatactatttgggctggacataggataccgaatatgtatagaatatcttatttgtatctcgggtttgtttcttaacttgtacaacaaggaaacaccttgagacttagttggttacgactgtattttgtctgtgtttgcatattccgttagggatatgtattctcttttgtaatacggactccttcccatatatataaggggggtctaggtgcctctaggggcaggggttgaattttctccaaatcatacaatcaataacacactcggcggattcatccccggacaggagtagggtattacttcttttataagaaggcctgaacctgtataaatcctttgtctccaaacccatacactttcctagcttgatagccacccccttttattattgtcgaaatctagtttcgacaaaatggtatgtgtatatgttaaaataatgtaaaaatgatatggagataatgatttagcattacttgcatattatttacatgatatttaatatattctagataataattgctagtgggtggtgatgtggtacacttatatgtgatttaaaatactctaaataataattgctagtgggtgatgatgtggcatacttgcatattgagctttaggagttagtggacaccaactttatagtaagataggatgtgtacagatccaaacacagtaccaaatccaagggtgaattttgtgaggtacctttcaggatgatacaactgttataggtataacagaggggtaaaaagtttgtaaacattaccataagataatcgtaggcccctttggtttatgctttttgaaatttttaaaacatcatggaaagttaactaatatctctgaaaatcctactgtcggtgacatgggaccgggagtatcgtgactagaggcttgggcagccgcgctcacccacgtggcctgatcccctcggggggggagg

SEQ ID NO: 46885 - DNA, 3739 bp, Oryza sativa
atatgtacaaattttttgaataagacgagtgatcaaacaatgtaaacaaaactcaaaatccttatattatggaagagagggagtaataaaggacgtatataaagagatgtactgatgtttacttcaagtttgatcaagtaaaatagtaatattttcgacctaagataaatttataataaaaatatatttaattattaatttaattaaactaatttggtaatataaatattattatatttgtctataaacttagttaaatttgaagcagtttgactttgaccaaaaattaaaacatcttacgtgaaacgaaggaagtatatatttgagagagatcgagtatggttgctggtgtgcagctagctggctgctgcattatccagccatcctgggctaaaaaaagcaaagcgagcaaccaatcacagttggctcgcctctagctctctcctcactcactgcaggatggtagcagagggccagaggtggagcactacttggttgcgatcaaataggagatgattggaacggtaaaaataggttcagaaaaagtaacatatggggctgggctgcagtcactgcgacataattggtttgtagaggcactttttttttcttgcgctagttagctatagagacactatctaaattgcctcaatgattataatggcaatatgtaaaatgtctctacaagatatgtggtattatatttccatagaggccctgcaatttgtctaaagaaatgtaggggcactattttgatgcaattacaatatgtatctataggtgtagaggcgttttataatgaactagtaacatgtctctagacatgtagataataaatgtcctcatatgtcacttagatgatagtgtatgatatacctttgacgaatagggttggagtgcactcacctcgtgtgatgtgggatagaagagtatgggttaggtgaagtgtctggcgctcacctaaccgcatttattgcgggttggacgagcgcgccacgccgcatttaatgcagcgcagcgcgctcgcttatccggtccgtgaccggtcgcagtatgtgaccggtcacagaccggtcagatcgtgggttaggtggcagcaggcagcctgtcacacgcctcgccccgtcccgtcggaatgatgagagcctccaggcactcgtccctagccagagccggcgtgctaactcctggagttagcacgccagtcccggccagatacattccaggcttcatcgcaaccattgcaaggaagtcattgtatgaagaaggacagacgtgcggcatgctaaactgacacgtggtggacaagaatgaccggtctgtgactggtctgacgccggtcacgtcatcagcagacaaaccgtgctcccacgttgcatctgcttccggcgaagtggaggtaggtatgacccatcccatcggagggtcattcggacagcggccattgcaaatctccgcccattaatgaaggaatgacagggtaatcccctgtgtcaggcgagtgacggcgctgggcctcactcaaggacaagctgtgatttagcttccaagcgaaggcgcgagccaagttctggtcaagatagggtgggtccccacccaaaagaagggtaggtagaagtggtgcatgtggtatccccttgagatataaaaggaggaccttgcccaccgaagagggagatccagaagaagaataggagggatggagatccagaacaagaataggagggacgactctgagaatacctgagctcgtagaggagagaaagaggaagaggggttctagagcctgaactctcttgctctccagctctctgtaactccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccccaagctccgtcacctacaataatgcctactcaaacaaacaccattataagttttttcatgaagtgccataagcaataaagagtagcttcccaaaattatcagccactaaaatatactcacgttccaacatttttattgggccttaaggaccgatgacagatcagatgaggttcctcagatgtaacgtttgaggaacgtgggtgttaacaccaaaatttgatatgattcgcgaatggctcggtggatgggttagcttggtggagcgcccaccacccgtgctcgagggccgctcagtgcgggttttgcacccggattttatccctttctttggactgacttcggttagtcccgattaggtaagtggtacacacacgcgtgtgcgtttagtgggccaacacttttcccgtgcactaggactctaggcctccaatctcaatcctagtgtgtgttagggacgcgcacgtgtgtgtgtgtgtgcgtgtgttgtggtgtgtgttcgtgtgcgtcttgagttgtaccctctcaaaaacaaatgatatgattctttagtagattcggttaaggaaagaagctgattggtagattaaaagttaagtgtcataatttgtttttttgtgattaatgataaatctaattatatgataataatatttttataaacatttcattatctagtctcacatgggaaatgaaagtgaaaattgcgagaggttggttctcggactttatatgagttgagatagaaatattcgttgatggtggacctaaatcacaacaaggatgaagtgtgcggagataagttatatgtgtcattcgttttctccatgcacatgttaatattcctataatattttcatgtgattgacatatgcatgtgatactaatgttttgtttgagtcttatctcttaattacttagactatttacattgagaacatggagatgatgaaggtttgcattgataaaaatgccttctattcttgtataggatgagctgccaatgtttcatatatttttatgagtactcttgcttcacacaaatattttgtatgcatatatttagggggagcaaatcgtgtactttagttatgcatgtatttgatgtaaggtattcactgtcatttaattgggatatttagatttgagcatacattttaatatggcacttgtggttttgattaatactgatcatttattcatatcattttatacatacgatcaattggtcaacaagtggaggttgacaaccgaatgggactaacaattatattgagttgaatgagagaaataggtcccatgaattggaaaaggtgttcatgctcaagagagaacatgacatctaaagatatcaatgatgataaagtgaaggtattgaagatgtagggtacgaagtggctaccatgacaagacggtaaagggcaagcgatgctcagtcgcgatggaccatacggcggtgaaggtcaagcaaggggcttgacgccgaaggaccaaattcgatggtgaagagcgtgtgacggctttgtcgtgatggactgtgtgaggccattcgaagttacaaggagctcatatcattcactcgaaaaatataaggtgaaactgtttcggcgttgacatttctttaagataaagaaagaaagatagcatggagatatttttattggtatagttctcttcctatttacatttgagtataggaataccatactattaagagggatacaacgt

SEQ ID NO: 46886 - DNA, 2092 bp, Oryza sativa
  unsure (1)..(2092): unsure at all n locations
gttgaaggttggctggacttcaaattcgtcaaactatatgggggtttgtcattcgggttgagctcagacttcttgtgcaaccttggtcgacaggcttgttgttatagctccttacatttaatgatgaactccgtgaaaatcctgtgctgagtccggcgaatcaaattgtacggctcagcaaaaatcctctgtattgtgccgtttccgtggtggcagccgaagaatattaccatcctgtcaagcggagtgcacgcccaatgagacccaaggaagcagtcgtcgcggtaatgccggaactccctatcaacttgcttctttctatactgctcggatatatcaaaaaagatgctcctttagttcagttaatcctccttttaaaaggatagctctttgctttcagcttctgtcttctggcaatgtactgggtttattaatttattccatataatctctgttcttgcttaatgaagtgattgtgtgatctcaagaacacaaaaaatcctcccaaaaaatggttccaatgacgagtgggcccagaagacttggtagtcgtagataacgaaacccttggtccgtgagcgtgacacgcagcagttgaaggctgagaccggagacggagacggagagagacgacccgagcagagcagagcagagcttcccctcgactcgatcctcttcctccctagggtttccgctcctcctcgatcccgtctcgccgccgaagtgcccctccccttcctccccccacccccacccccacccccgccgtnaatgcgtggcggcggtttcggtacgtcctcgcgatcttcaatcgcccgccgatgcatttatcgcctctctcgcctcgtcttcttttttttatgggacagtcagtcgaaacattcttgcttgcgtggactcgcgcattggaggagatttgggcattggaacctcaagcgttaggttcttgatccgaggcctctcctgtgctgtgcaaatcccgtagaatttcactctttttaacatcatgttcaggtttggatcctgcaagttgcaggctgacggggggtgctattattgccatgtctacgtcatccttatctgataaatccgtaactctaatcctgttgttgtaatgattaatccgtagaccggatcccattttccgcgtttataatagctctggttgtgttttgcttggtgcggatgccacatccatcgcttagtaattcaaatgtttaatagcttgatgttctcagttcatttataatgcgtcccatgattttaagcctgcatttttcataagcagttcattaaaaatatgatttttatcgtgcatcctcttttgcagttaacgaaatgaggcatactggcaaacgccttcagcaacacagggaccatgacagagaagaaaggagggaccaaaagaggaggccagtgccacgtgcccaggaaaactctggtaatgatgaattggttgtttaccgcatactctgtccggacagagtaataggtaatgtaattggcaagaacggcaaggtgataaactctatccgacaacagacgagtgctaaagtcaaggttgtcgaccctcaccctggtgcagacaagagggttattttggtatattgttttgtcaagcatagaaacctagatgttaatgacgacgatgacagggagcctgtttgcacagcacaagatgcattactcaaggtacatgatgcaattgttgatgctctgtccatcactagggactctgatgatgaagaagcaaatatccttgtaccagctagtcaatctgcaagtgtcataggaaagtctggtgctgtcatcaagaggcttcggtcaacttcgaaagcatttattaaagtgagcccaaaagatccaaatgaagttacacattcatgtgctatgagctttgataattttgttcaggtaatttctcacatcttttacttttcttaatttaaatcatttgccaacataataggagattaacaattattgaacagtttgaggatattgagcagcatatttgcagtaatttccttgactttcatacgacttgtaataatatcatcatatatattctttgtttgtgagtgaccatgca

SEQ ID NO: 46887 - DNA, 6252 bp, Oryza sativa
atatctgtgttcctttaaaaaaatttatccatgttactgctcttccctgaggagtaatgggatgcagggatgggatggagagcctgaggagaaatttatccatatttttcaatttgacaaatttgggttaaattttactatttcaaatttgaactattgaaaactattcgaaaatttcagttagaatctaatttcgtcccgcatcgatcgaaatatcaaaatttcattgtttttttattggttttcataaaaaatgtaagccctagattttatcgaatggtggctctcttaccagatttttattcaggacacaatgggtcttatgaaaatctttctatatttggagaaattaaaaataaatgttcttattttctggaattcaatgcctaagtgtacgtaagggtatggtttcattcttttagatatgaatagtaatatgtttatatgttttaataggtcagaaccatataattagaagagatgtacgtgatcgaggataaaatattggatccagtggttacttgtgcgaaacgtacgaaagtgctacgcacggtgggaggagcagatggaaggagcacaactctgaatttaaagatggtagagatattctcatgtatacatgtaggatgaatgagaataatgcaaaccattattatggtttgatatgtgaaaatgatatatgagtagatttttcattaaaaatgcttcatatagttacattttcaacgatttctataaatatattattagaaaaaataacgaaaaagaacaaagttagtagtttgccttttatgttgtttactcataaaattatttactttctaaagaaatagtatatataatttacaagtctgtatcttttttaaagaggagctaaatctttcgtgacagatgtttaataatgttttcacggtataatcacgtgagtagaatctctagaggttgacttgagaacgtaaaacatgcatgccatcttttttaaaaaaaactaattattattcagtccccatgacttatctacctgtgacaaacaaatcttggcacagagatgacaaacaggaagatctagtcgcataaaattattgctacagaaaccgtgcccacattatggaggcgaaggtgatattattttgatgctgatcctcattgatcagatattctagctgggggggtccttgagtatggccgtggcagtacagatcaaagaccacaatatgtggcattaaagatgtggaaccccgtgatttgagagagagagagagtgaaggaaagcgccgaaagcaccattagcatggttggagacaacaagaagctttgcctaggttgtgtttgcaggaggtatctgaaaactactggtcttatcttttcgcttatgattatatttttcagctaaaatttaaattttcaaccttaaatttagagttttttcatcaaaatttatttttcaaacattgattttagatcactaagaacacatatataaaatttttatttataaattatttttcatttgcaaatatattgtttggcttattccacgaataagctggggtcgtacaacttatttcagaattttcatcttcccaaataatcagtggcaggcccggctcagttcataggtatccatatgaatatccataatttttagtaaaagtaatatgtatatacaatgtgtaatgcgtatgtatacgaaaaatataaaaaagatgctacattcaacacataatatgcatgctatatattattataccatcagtactttgtggtattataactgctaaatattagggtttttttaaattaccctaccacattttttaatacacaactaaattatgggcccgctcctgcaaacagtttagattattgcctaaatttgaagaactgtagttatactattgagaaaataaactcgaaactaaaagttgaagctcagtttttccaaattgttaataactatagctacatacttacaagctatgtttagaatcttaagcttcacaaacagggttatatattggatggaagggagagggcctactagtttattactccctctatcccataaaaaacgaatctagtaccggatgtaacatattctaatatatgtttagattcgtagtattaggatatgtcacatcggatactatgttgattttttatgggacggagggagtacgttggagcaacactaacttaaacactgctttgtgtgaaaaggtgtattatttgagtagttgcagactgatatgcatatggagttgtttatgaataaactattggtcaagaaggctccaacaaggatgtctagttgtctagcaaattaagtattgttagttactgttccaaatttccagtagagatggcaatacaaacgatttgggcgcattaatcactaatatttttgtactttgtcaaatgtagccatcaccggtggagaaaccatctttggtcggtcggctaaaatccacaatagtcccggttgcaataaaaaccaggactaaagattcaaaagattagagctacttttttatctttagtccagatctatttctagtcccggttggtaacaccaaccggaataaaagatcggcatgcgcggcggagagtacgaggcgtgcacgagatcgaggaggaggagacgggatcagttaataaattctatctccttctccctgaccttatctcttcctcttcctcctcctcctctcctttaactcctctcctccttcctccctcccccatcatccccacttatgatctgcagcgcgaaggcccgggcggccggcggcctcgcggcctcgcagcggcgcggcggcacggcagcgtgatggcgggcagcgcggcggcgggcggagggcggagggccgggcggccacgtggcgggtggcgcggcagcggtagccacagcgagctttttttcctttttttttgagaatttgtgattcggatctgtatatttgatttgtgtgtgatgtgaatatgtgataaattttgtagaagttgtgatgcaattttttttaagattttgtgatgtatttggatatgatcgatttggggatttgaggatttggggataatttatttgggattttgggatggggactgagtgaaatcaatatattaaaaacaatgaagaaaaaaaataatggagcaaccggatctagctagactagctctatctttaatcccggtttgtgttaccaaccgggaataaaaattctctatctttagtcccggttggtaacagcaactaggactaaaaatctatttttactcccggttaattcaccgggactaaagatagcgatctttaatcttggattcgtagtcccggttggaaaaccgggaatacaaagggttacgaaccaggactaaaaaacacttctccaccggtgcatgtataactgtgttaatcaaagttaacggctagtttgaaaaaaaaaagtgatgtacttcatgtgggtacttaattaacgatgtaatttgacactgctccttattttttatgtgagatttgctaaaataatactagatagtacttttcgtacatccaaaatgcaaaggattccttttatttacggaggtaataaattaatatgaaatggagggagagttagaagtaatatattatgcagtctaaaacgtgggatcgtgattattgtgaataaaaaaataaataaataaagtggttacaagttgtgaagctagctcgtgtgtgtgaataagatttttaattaatacttgtacagccactagttgagttgtttgacctgtacattcatcaattctgcagcctaatcttcgatcccaatgtacaagcatgggtagtacgccagctgcaatgggcacgttgtcacattgatgccagctgatgtcttcatgggcatgaagaattaatttcgagatcctgattggaccttgaatgatttcaatgaaaaatagtactccactacgatactcctccatccaaaaatactactccacgcgttgtcgtagaaatttagcagtactaagtaaaaataatgagtaatatatatatatatatatatatatatatatatatatatatatatatatatgtatatatgtgtatgtatgtatgtatgtatgtatgtatgtatgtatgtatgtatgtatgtatgtatgtatggtaaatttgtttggtgtttcatggtgctcgggctccatgatttaaattgagtatatactcaattcaaatgagtatgaaatttttttaaatgtttaggtataacatttactaactagttcaaaacaagtttgaactgaatttaaacatgtttttgtcagattttaattctaggtatatagcatccaaacatataattagttaggtatgtaatattggattgtgaaataaagttaaatttgagttgttttgttgctaggtataggtatgaatcgaatacttataactaggtatatgctcacaatttaaaaattttaaaatatttgggcgaatttgtgtatttcattccatggtgcccgggcaccggcaccatggtgcctcatatgagtgtcctgtatgtatgtgtatacacacacacactcacgtaagttgatgtggtttatgataatttaaatttaaatagtatataaaatgattattgaaatgtaaaagtaagttgacgtgactttatgagaaaagaaaataagagagatagtttggatcatagattaatcatctaagggataaaaaatggaggtgatatgacttaataagaaaaaggagggagataatttggatcatagataattatctaataacaaaacaattgatgtgatttggcttaatgagagaagagagatcacattttaactaaattaggagttagaatgaacaatatagatacataagatattataaaaaatgataaagagacatattgaaatattatgtgaattatgtgagatgatgatttaatattcttgcattcgaaaagctataaaatttagtaaatttaaaattattataaataatataacatgcttgcacgatgtttaaatgtaatactctatccgttttaagttataagacgttttaactttggtcaatgtcaaactactctaagtttgaccaattttatagaaaaaaaagtagtaatatttttaactcaagaaaagtatattataaaaatctattcaattatagatttaatgaaattatgctggtgctgtaaatattactacatttttctatagagttagtcaaatttagagtagtttgactttgactaaagtcaaaacgtcttataatctgaaatagagggagtaattgttagtggatgataatgtggtatctttacatgttaagctttagaatttagtaggctctaactttaaagtaagagaagataagtcacaatcactatttttattattttataatataagacgcacatacatacatataattaactaccatatttgtctcctctttaattcattataaataaaccatccacacataaaatctagtcatattggacacctagggaaccggttttttcagatgcagctatttatggtccgcctgaaacctactagcctactgctcatccagaaatatcagcaattgtatttattggagtgatcatcatacgagaaggtgataatagtatttttttttctataccactaaagtatattgttcaaaataaacatatagagtagcataagatagaaaagagggattatctatacttttatcgataatttttctctatatcagatataaatactatacaaattatagtgtaattacacttatatatgtaactacaatacaataactttttttgtgtgcacgtgttgtgggtatctgcgtctatacgtgtttctagaaaaaaaaatacaataaactttaaaaatcatgctataacacattatttttgtgaatcacaggtcgcaggaccaaatactttcacccatgtacacgctgtgattttttcctttcccaattgtacaaatttggagcaaattaacctaacgtttcgaaattacgtaaaatttacatacaagttatattgcacttgctgcatgcagactataatgtaaatacaccgtaattttgttgtactcatatttgacaaatgttttatagaaatagaagaaaactgacaaaatttttcaagcctaacgttgtcaggcggctctcctgttgagaagcaattaatatcacgcataggaacagtgccgtacagtggaacaaaactttgcattgattatact

SEQ ID NO: 46888 - DNA, 8806 bp, Oryza sativa
aggtcaaagcccatcttgaagatggaaaggatgtccgctttggagattggaaaagtgctgacattgagatcttgaataccttccagctacttacagctaagccagttgtctatttggtacgtatttttgtcatctgtatgccagtttatttgagatgttataaagtagttttcatgatgaggtgttcagttgttctttgtgagatttcagttttgttattttcgtgcttctgcatttagagactcagtaataatgtcagtacgttgattcatggctatacatgcttttgaatttatacaatagtgcccatgaatagcgcatattgttttctattagcaagataaacttggaatagtgcaaaacttatcctgtggactttctgttgtgccctgtttgtctgtttcagtcttcctcctattatgtaatgtttattttgaggcatcaagcaatattctgaagcagtgaataatactttcttgttttatgtatgggaactctacctatatatcattttcagagcacacaatcaactataacccaaatagtcactaatcgtgtaattagctgtatacccacctaacctaacatggatattttagttgacctgtcagaaattgaaagggagatgctagtatgttacctttccttgcatatggtaatttttttttaataaaagtagagctatatattgtttaatgactgttttgtttttgcaggtgaacatgagtgagaaggactaccagaggaaaaagaacaagttcctacctaagatacatgcctggtattgttctctagtatatagtaactatttcttgaagggattaaggtgtaatggaaaataaggcaaactgttgttttttattttcagggttcaggaacatggtggtgaaactattattccttttagctgtgcttttgaaaggttgctagcggatatgcccccggatgaagctgctaaatattgtgctgaaaaccagattgcaaggcaagccatgtcacactcatataccattaaatgttctttatgtgtttagcttagttccaaaaaaaccaaaggtaaattgcttgatttggaatcaagcaaatcaagcaatactgtcacactcatatatgagtccttttacttggattttatttcctgagtgacgcaatagtgatgcctattttttggttgggtcactacgtgtctttgaggtgaattccatttggtcatactttctataagatacattatatgactatgattctataaacaccaatagaactatcaaaccagcaagagtctttttagttgcatgttgtttaccatatattgtagcttcttttttatatgattcaaaatttctgatctgtcattagttgcttgtccttaagcattctctattttttgctgcagtgtgatcccaaaaattatcaagactggttttgcagcaatccatcttatatactttttcactgctggccctgacgaggtatattttttctggtcatattatgcttatcttacactattacttgttgattttaatataatccatcttttacttcccatgttgctatatgacagtagcattgccctttaacaattgtgttgtgcaatttgctgcactttgttttaagtaatacgcagtactccctcctacaaaagttatacatattacttttaccaccatgaccaaggagaaattaaactcatcttgcatgtaacaaagataaggagtgtatgcacgcatgcaaccaatgagtattaagatggctcctcgggttttgatcaaacatttaatttacctatccatttaaatcttggatgcatacacactacaaataggaacaacttatttgggaaaactaaaatatgaaataggtctaattcttgtggatggagtactttctttagttcttattttttatgttcttaatagttcaaatgcaagcgatgtgaaaattttagttttatacattcttgtttaaatatatgtttgaaatacattttgctggattagtgacatagatggattttctgttcaggtaaagtgttggcagatcagacgtcaaactaaagcacctcaagctgctggtacaattcacactgattttgagagaggcttcatatgcgctgaggtactcatgcgatatactcaggcttcatatgagtagttagtatatgcatgctaatgtggttagatattattgcaaacaattgatctcatgtcactgttaagtagctggtctaattcactagttatactacctcattttgtacagttatccccaactccgcagtactcaatggacacattgatttagatgttttctgatgcgacttttctagtttgatatagttcttttatttgtaataattattctctttgttttatatatttggttgggcttgtctgtccagtagcattgttctttttagctttatgcacatttgaaacttatgtgaaatacatttttctgggattaggtaatgaagttcgacgatctaaaagaactgggtagtgaatctgctgtgaaggtatgcaaggcacctaacaaagttgatattgttcaagtgcctcttttcgatatatacttaatgaaaacgcccattattgcgaattgtaggctgctggaaaatacaggcaggaagggaagacctacgtggtacaggacggggatatcatcttctttaaatttaacgtgtctggaggtggaaagaagtgagtcaatgtttgaaggtgatagcgttccgacagagtggtgcattttactttaaacttctacacttagctctgtagcaataaacaagttatgattcgatattttgtaccatgaggctataaaattatccaaggattgtatgatgaggctttaaatcattgaagaaaaagtgtacggttttgcaatacaagcattcttggcatgtttgtcttgcctgggtctacatctgtaatattaatggataactgccgtgcatgtttggacaactcgctgtcatgcagtcaaatgtggttctttccccacggtaaaattagagccttccacgtacagctgatttctgcaattctatttttaagccatgcataaacagacacaaattaacaattaactggaatagcaagtcttaccacgcatacaattaccagagcaagataaccctacgaattactgctcaaatctagcggacctctacttctggtaacggcccgtttatgaaatatgaacacgagcatagcataattaattacccttccagtgggtaattaaatcaacttaattaaattagggcagcatgacactgacgtgcctatcaaatatccaattaatcgggatgctgatgggcttcttctgggccttgaccgccctctcatgggccttctccttcatcctccggatcttctgcggcagctcgcacacgtagtcccgcgcgcgccgcccttcgccggagagccccgccgcgagctcctccacgcgccactcccgcaccaggtgctcgacgatggagcagtagtccgacaccgtgtacgtcccggcctgctcggcgagggacacgacgcaggcgtagaggtcgtcgcggcggccgtcggagatgggcgaggtcggcatggcgacccctcgccgtagcatgcgcgccaccgcgcgcacgccggcgtccgggtcggcctcgaggagcctggagacgatgcgggtgtaggcggcctcgtgccgcttctcgtcggcggcgacggtgccgcagacgcgggcgagggcggcgtcgccgtgccctcgcgcgccgaccagccgcgccgtgttgccgtgggcgaccgccgtggcgcgctcctggaacgccgtgtagacgaaggcgtggtacgggctgcacggcgggtcgacggccatgccggagcggatgaggcggtgcacggcgcgctccacctcggccatgtcgaagcggccggagaggtacatgtaccggttgagcacgtcgccgtggcggttctcctcggcggaccacccgcggatccaccgcgcccacgccgtggcgtcggcgccggtgaggtcgccgacggcgcggacgcggttcagcgagctctggtacgtgggcagcgcctcctccgtcaccatgttcgccacgaggcacaccaggagcaggtccggcacgccggcggcgcgctcccgcagctcggcgcacgccgcgtggaacccctcgccgccgagcaccgccgggtccgggagcaggtccgacggctgccacgccgcctccaccggcttcagcagcggcagcacgtgctcctccacccacggctccatctgcgtcagcacctctagcttctccggcgacaggtagctcctcatctcctcgtcttcctcccgccgcacggcggcggcgacgtcggccgccgccgacatgatcgcgctgccactgacagcactacccctgcacatcctgcatgcatgagcacgacaacttgcaagttgcaactggtaatttatttctttctcaaccagctgaaaataaatttatgctttgatcaaatcgatgaaatttttggtaagtttgcaaacaatatgtcaagtaagggagtgcacatttgttcttcgatgcagagatcgagttttaatatattttctaaagggttatactttcttcatcatttttaatgtgacgttggttagttaaaaatgaactaatgaacgttatttatatataacattggaagtatgtctagtaaaaaaaaaaacaaaaacataccagcggctgctactgatcatggtgactcgtctaccaaatagtgttcttgatggtgaagaagagttggtgtttggtttgcaacgaagcctattagctaaaggcatcgccattgttgctgttgcagccatgctggaggagaagaagaagaagatgatgatcgtctatggatcgagttgaactattgtgtcttgagttgtgataggtttagtttcagctggtcgaagcctggtgctgcgttgttatatagagagcgagctaggagtatatttgttgcaattatatgacttcttccactttccttggcaccttagttggccacgtgccttcgtgtcagatcgagctcaattatgcgcattgcattaaaaacaaatgtaccactcccaaatttcaaattttaaaacttattttgacttgattttggagtttttttatattattgtaaataaattgctaagaacaaagttttatataaaaatagttttccaggtatttttttaataagccatcggctttagtttagatagattagtgatgaatgagacggagagagattttaatcacccagaggacgttcattgttacttgtttagggcatcttcaatgtataagtctcattggatcataagctgggcctaaattagctatatggtaattgttacaatgtatatggcaaaaaaaaaagaaagatattaagttgggttgcacacaattttaaaaaaaatcttactatatcataactagtactactgcttttttctggtgagagagtctgagggaagagagtcaaatacaaacggtttgttttttcccgatggcgcccaaacctcaagcttaatgtcacttgcgatatttctcataatgtatatggttgatttttggactaaagtccaccttatgtcctacatcatgtcgactaaacggttatgatatttttaaaagaattgataatatagattaatatgtaatatatatcattgtacaaacattaaacatgtaagtttaaatattcaattccaataaatggtaacaaaaataaaaaaaaactaaactaattaatcacctccctctttcagtctttcgtcctcttgcttcatagaggaagttcaataaaagttatcaaacaccttaaattcggttagtcccgatactactaaatcaacctattacggatatataagttaaattaataatgttgcagtgccacccactacagaaacacgcaaaacaaaaaagaacagcaaaatagatatcagaacaactaagaccggcatctatagttctttttccgcctaaggtgcacctccgcgaggtgcccaaggcaagaaccgacacatttgtgaaacataagtgccggttctaactaaaaccaataccagtagtattagtgctggtttttctataaaaaccaatacctatacttatattataggtgacggttttcacctattaaaaaaccgagccaaacccactggctctctctcttcccctttttattaccccttctctaccccttatcttctctcctctatcggtctccctgcatcatcctttctccctctcccatgcgccacggccggccagggatcagtggcgctccacaggtggcgtccccctcgatggcactcggcggccaatggtgtctctccttctctccgcccatcgcctcctttccctctcccccggcctcccaccaacggtgcgcggcctcctcctttccgttgccatatccaacgcctccacgagtttggggatggccagatctacaccctctgttgctccctcttggtcttcaccttgctatggcccgttggccaccgtgagctcggagttggatcctgccatccctactatggcggaggcaccgactactagatccacgtgtcatgatgatgaaggcgaccaccagcagcgtcgtggctccttcccgtgcgtggcaagaggatttttatggctttctttgttgatttcttacttgttgatattggttgtaaaaacgatattggttatcccttttatgctgaaatgggtatctagtgcttgggtagtagatgatcctttgtgataaaatttgtgattcacttagtgattttgatgttgaaaagcaatttatgactgattgagaacaatttgaggcttggacgttgggtttctctgctgctcgatgcattggcttgattcgagctgatgcattgagcctgttttttttattcctcgaaccataaaggtgttggttggaaccggcacctttgaggaggtgccacctgttgagtgccggttaaaatattcagtatctacggccggtttctaatcggcacagaagtgattttgtgtagaagtgccacttgtcttgcacaatataggcggcttccagctcactagacccattggcatatattgctggataacacatggtacgtccacctaggtatacttcttcacgcatgcagggtctagctagggttcaggccattgtttcacccaaagaaattgttgaattttattactatcacacttctatggtaaatttgagacaaaatagctgaacaagatttaatatcgaaaaaaattcacaatttagtttaaatttggagatggtgaaggaaaaaaagaaccaacaacgttctactattgccccgaagtaactcaacctaggaggataggatgtagacaataatattctaaaacaacggatctggacaaactctcgtccatattcgtcgtttcatgataggtcacatcctatcctatttattttggaaatgagggagtatattatcatgatcttggtatcttacataatacatacgttcactatatattgtgctgtaatttaatacacaataaagtttgtatataccctccgtgttttagatatgtttacccttcgtcttattaaaaaaatatatgtaaattttatttattctgttttgacttgttttatcactaacttatattatatactttaagaatgacttatatttttgttatatttgcactaatttttaaacaagacaaatgatcaaactatattcaaaaatcaatatcattatatatttaaaaatagaggtattatatatgtgtctgtatataggtaaaaacaatacaaattgtatataaaaaatagcgagggtaggtcaccagagctatgaggaaagagaggaggcagtctccgagcaccatggctgttgtagtgatgtggttggcccgataccctccttcctcaccaaggtgcattgctgcactgtgcttccctccgtccatggacctcgtctctcttcgccacgatgaaggctgcaatggccacgtcggcctggggatgacgacggtgataaataaaatgggcgaggacgaggtggattgggcaactttgttgtggagatggagcttgaccttgccaatggagtgatcgagctcaagctcttcgtgctacttatggcctcctccttgtcgccgctgcaccccgctccccttcttcctcaatgttgtgcctcccccggccccaccttcccctctagattccgcagcagtgaacagatcgatccgatcataggaaacaaggcaagatttgtggcttcaggacggaatggccgccattgccaccatcatgtgaagctattcgctgcttgggcgcgcggatgtcaatgcggcctacgaggtgctcctctttgcctaccctcggtctctagaactagtatggaggcgtgcgatgaagaagatggtggctgacagctgggccccactacaactaattaaaaatactagcttaggggatattcatacggtttgagaagttggggcatgtaaaatatctagcactaaagttttaggagggcaaatcgtacttttgtgataattgagagaggtaaatcaaacttaaccctaattatggagggcggtgcgacgggcatgcaatgctacggctaagttcttatcccagttttcctaactcatctctctcgttttccgtgggtatgctttttaaactgctaaacggtgtgttttttttaaaaaaattctatacgaaagttgttttaaaaaatcatatcaatccatttttttaaaaaatagtaaatatttaattcatcgtgcaat

SEQ ID NO: 46889 - DNA, 1131 bp, Oryza sativa
cgatcgatcaatatatatatacatctgcatggatgcatgtgttgtaggcacgtacagtccgtggatctgatcatgcactggtatcaagcacgttactcggggtgcgtgtttagttcacgttaaaattagaagtttgattgaaattagaatgatgtgatgaaaaaaattagaaatttatgtgtgtaggaaagttttgatgtgatggaaaagttagaaatttgaagaaaaagttgggaactagatcaggcctcggatcagcaatagctagcaagccttgttttgctagtagtagtactgctcctttcgtcccacaaaagactttatttttatatttctgtgaccaacgtttaatcgaccgtgttatttgaaaattttataaaaaaagttaaaaaaatcacacataaatttttatcatgttttatcatctaatataagaaaaatactaatcataaattttataaaataagataaataattaaatgttgtttctaaaatctgaaaaatagagttttgtgaggagggagtatcttttgcagcagtaaatttgataactcgctgaatgaatcatcaatgcatgcgttagttgcatctacggctgtagtactgtgtttactcctaccctacctaacaattcaacagattcaacccattgaatatctaatggatccgaacagttcttcatatgaattttattcacacgtactacatatactgccgcacacattttggtaaagtctgagttaccgacgcacgcattttacatttctatacctaactagaaaaaactcccgtgcattgcaacggctaaaaatatcttttttcattgatacaaccgctattaggaactaagcgataaattgaaatgttaggatcattatatgtacattataattggaaaagttaataaaaaatgttcctgagtttgggccgaaaacccttctttcctttcttttcagtcccaacctagtccgctacctccctctcatttgactctctccgatccagcccacagtggagctacaggtccagctcgcacagccaactgcactgactctctccgatctagccgactgccctgactctctccgacccaagccctcaagtagagctataggcccagctggggtgcag

SEQ ID NO: 46890 - DNA, 8867 bp, Oryza sativa
catcattggcccatcaaaaaactactctcacaaatcgcattgtatttttttacattattggtccatccaaaatctacccccacaagtcactgtattgtaaaaaaagaaacatgtaatcaccaacaaattgaatcatgtttcctacgcaacgcaagacatcaagatttttttactccgcgttcggttctcaatttcttatgcacctatttttttttctttagaatttttacggtacaatatactctagtaatatataatatccggggacatctcctctgcgagtccctcctaccattgtgccgtcctttgtggcgccgtccgtgtggagctgggtggcgcgcggccctatggccttggacggagcaagctcgtttgttgtgggctccctctcttcattccatgtaggcagtaaggatggtgccgcgagcctgtagagctccgcggatagcatcggcgttttcttagagtccaactggatatccacctacgacggcgacaacgcacgccatgcggtggcttggagcacacaagagaggggcctctgcagggtagggaagcgaatttgagagaaggtggaagtgggagtggtttatggcaacaaaggagcaggatgccgagagaagcttgtcaggagccctagcactctccaacagcggtgctagcagtggtcacctcaaggtgctctgagccctggtgctctcccaaattaagagaatttttacggtacaatatactagtaatatatattaacattataaatgagggcacatttggaattcgctaccaaatttaaaggggtatttagtaattcgtgattcctcttcattccaatcgtcaaatcgatcttagatgcctatcgatctggagcggagagacgacccatggcattgaccgaacgacaaacatcggcggcggtgtgtaggcaacgacgggacggtggggaggccaggtacagcgggaggcgcggctgcggtggtgggcgtgttggccaacaggtgggcggcatagcacgtgccacgtactgctgctggcagcaagcagagcgcataaccatgaggctaagaagctcgcagttgaagccatttgcagctacaatctatgtcgttcgatcatttatactactagtatatatacttgtagtatattgtaccataaaagttctccaaattaaaggtgcagttgagttacttgttgttgcgctgcagaagctcatcggtgatgcgtccgcgctgccctgctcagctcggccctatctctgctgtcaccagccgcacgatgcgtcaccactaccgacaacctcggcccaagacactaccaccaccagctcacccttgccgcttaggtgctagtgaggccttctattttttctatgagatttacatgtgagtcccatgttggataaagactagccaagttgtcaagttagctaaaacgctttctaaatcaccgagggggtatagtttgcaccggttttgatagttgtgggagtcgatatacccagttttacgattgaagtgcacgaattagattcgatcaatagttgaggagtcgaagtacattttcctaaattttagggggggccgtgtacagtaggtatacacagacccatgccaacatgttcaattagctaggtggcatgggcttcattacctagatagatttcgtggatagtgtttggtttgtcgtctcgatcgatcctgtcgccgcttgattaattgcgccccataatgctaacacattctacactcatgtcctctgctttgctaaattatcatcgtaccaacgcgctctaatccctataaagtccagtgttattattacgttgtgtcgcagaccagcacagatcgatagagatatcaaagcatggcacaccatacacgccattgcccatcaaagcattcgaccaagcccatcttttcaataattattcttaattgtctcccaattttgttttgaattccaatatctactacaataattattaattgaacactctgtcacataaatttagagctccactccggtactctctacttgtatagtataaattaatctaagccattgaccatttttcatctaaaggacaagattaatttatactgtcacctttattaacggtagtagaaacgtgagaggatttaatcatcaataaaaatatatagaatgagaggtaaaattgtaatttgtatatcagttgaaaacccttggatggttggaccgtgctggcatgagaaaacggcgtgggggcagactttatctagagtttatttcttcgtccgtattttaatatatgacaccattaattttttttaccaacgtttaaccatttatattatttaaaaaattatgtaattattatttattttattgtgtcttgatttatcatcaaatatttttaagcatgacattttttaagcatgacattgatatttttagggaattgctagacggcagcctactaaaatttttttttgttgtcagctgaattttggtccgttcgatttctgcccaagatgcatgcaaccaacccatctctttcacgtgtccaacgccgcacattttggcccgacccatctgtctctctgtgggctgttccccgtggcccacgcagcacagtatacctagcccaacccacaacatgtgtcattccgacagctacacacgcgccccgtgcactgtttcaaaaaggaaaaagtacacccaaggtccctcaacttgtcatcgagatacaaaatcgtccctaaatcgcaaaaccagataccagacgtccctcaactaacaaaaccgttcactttaggtcccttggtggttttgaccccggttttgtctgacatggcggctgagtcagcgtaggacccacgtgggcctcccatgtcagactatccacgtcagcctcccctcttccccctcctctcccttcctcctctcttcctctctcctacactgctacacacacccagatgagtcgttcggctccgtcgacggcggcggcggtagcgcgtccgcgcgacggcggcggcggccgtagctcgtctgcccaggagcggctccgtcggctgcggcggcggctgtagtgcgtccgtgcgtctccgtcgttgccgccaccgccgccatcggcgacaacctcctggaactggcaccgtcgcgggcaccatagaaggagcggcgggagcggatggggacggcagaggcgacgcgggagaaggtgtcccgacgaaaaatcccaccacgaagctcgccggcctccctcggtggcaacgacacggcggcgaccacgcgggaggaggtcatcgggccgaggcgcgaggaggagggcggagcgacggcggcagttgcgcccgccgcactggcctgccggatgtcccactccccctactgagtcccagctccgccgcctcatcacggacgccgacctctccgcctcctcccaccatccacaaaatctcatttaatgaacgtgaatcatcttttcagttggtagattgcatattttcctcaaaaagtatcatttagaatacaatatcaaactcaagacatcaagaaagtaattaccagccagctctgttagcctttcagcatacatttgggtagaagcctctgtagcaagcatctcctcgcagatttctaccactttatcccactctgtgatgaatgccccaaaaccttcgctcacagacgccaagcagaaacaaacgtcaatcgagcggatgcaagaacctatcccgatccactcaatcgaagcaagaactcccatgaagctggatattttgtttggggggggacaccttgacgccgtggaggagggcggcgttgacccagcacggcagcgggagcgtgacagaggtagtgcgagaagtagacgaagacgtcgatgaggtgccagtgccagagcgcgtaggcgcccgggtcgtcgcccccctgcggcgccgcgtcgtcacggtacccgccccggaagtcgtggcacgcgaggatgtggcgccggggcgggagcggcgcggcccggcgcgaggaggcgagggccggcacggaggcgcggttgaaggggaggtggaagttgccgtcctcggagaggtaggcgcgggatgcgagcaccgcgagtgtggtgatggggtaggagatgggcggcgccggcaaggacgcgtcgaagggcggttcccacagccgccgctcgccgccccccggccgcccggcggccgcgcgcgcctaccagccgccctgcagcgagtgaacgaggagaaaagagagagaggaagggagagagagatatgatgtgcaccctgacatgtggggcctacgtgaggtcccacgctgactcagccgccacatagggtaaaaccgggatcaaaaccactgaaggacctattgtgaccggttttgattagttaagggacgccagatatctggttttgtggtttgaggacgtttttctaactcgatgacaagttcagggaccttcggtgtactttttcctttcaaaaaagaatccacatctttttctcctccgttctcatccgctcattcgagaagagaggcagaagcggagttctcggcgctatcaccgcagcttcgccgcgtcagcgctgctccaccgccgcgaaagatccccttggcagccagctctcccaagcttttctcgcgcgtctcagctgctgccgagggggaggggtgaaagcgggacggggcaaccccggcagccagtgaagcggtgaatttctcggggtcggcgacgggagatggctgctctcaagtttgtccgcaaggtagccacttccgtcagcgagcacccgacgaagtacttcgggcgtggcactgattcggctatggtggttctctctctctggtgggtaaggaccgtaaggtgaccaaccatctctccaacgggcgaggggaccaaccatgtgggggatctcgcagatggacctctgatccatgaactcaggttgaactctgttgacggctgttaagtacaaaattctcgccgtcaatatctgcataaaaccataaaagtaaaacatccaacatagtggtaggatttatttctaactatttccacgagtgttggtgtatatttatatgtaaatgcaacccaccaacgttgagatgaaatgtacatgaagaatataacttccatatccaaccctatggagttttgagcccacaaacccaataagatagatttattttggccaatctctagtagaaaatgtagtgggactcacatgttagaacaccagagaaaaggctgggctggatgggccagccagggttcggccgaatcagcagctagcctaatctagcccaacttcggtatggcggttgtaaccctcatcctatgacggttgtggccgttaataccgatggaaactgtcatcaaaagggacacatggcaaagggagaaggaagatgctctttagattccatggagaatatttcttagcatctccacactcccaagcaagctcacactataaataccactctcatctttcattccaacacacataaaagcttaagctgaattataagaggctctattgtactagattagagatagagtagagtagaagaagtcggattagttccggagttgtccgtaatactcttcttatttttttctgctctgttaattactctgattataatataaatatcttttgggtaatttagttttgcttggtgagaattaccttttggttagatcctaatcagcgtgcgggatcatcgttcactataatttagtaaaatatagtgattgctttagtgagttataaatactatagtagttattaattgcttaaacgcggtgtctaggtagttgatttccggtgtttgctccgtatcccacaataggtttgaggtgggtgtaaaggtggtgatagccctcaagatcacttaagtcctccatgtccgggcacgcagtagagcgatatctgggagcagtgggctggctagtgcccgaagtatcatgttaagattaaactaagctttccgtagatactgtttctaaacggtaaatcctctctatcctttgcctatccttagcttcgtgtccttggatgaacctgacgaggagttgagcacacacgttccctgtggattcgataccttggaatactactgggtggagtgctacatcggtatcttccgtgcgcttgcagattttatctgtgacattaagaaataccaacaaacttgtagtaagccatgagggcaaatcgaccaccaaggtgagcgagtataccttttttttcattttttcaaggcttttcatttgttgtaatttgtgttaattttttttaatttgttttcggaaacattcatctgcgagtcagatctgttaatgtggctaactgatctcgatcgccccagtgcaaaatctaagctgtatttgatttgtgcttagtgttgtgcttagcgcaaaatagttgcgcttagtgttgtctgacaaaaaaattaagcatgtggtgtgatattctcaagttgtaagtatttcagtttctgtttatagcatatgtgaagtatttttttctacccttgcacgtgtggaagtttatgctagctctagaaagtatttcagtataattcagtacatggtggcctgtatggtattcatcagtacatgtgaccataatttgttgttatatgcaaatgttttgtagcatgatcatcgtggaactataacttgtcatgctttgtggtgtatcttttggatttttgtagtatacattttgggccaattgcatatttgccactactttgaatcggtattgtgaatttgccattacaaaaaacataattgcatatttaccaccaaaaatgattggaacccagcatacctaccatcaaactcacaacatagactaacaccgttagaagtttggttttcatgaaagtgaggacaaggatgcccctccacaggaaattgcaatcctaccactggagcatacaacctaataaaatcgtgcagcataagaaaacaaacaacagtggaacaaacattgcaacgaagcatgtggaactgctgtaaaaggttttacaggtggagaatcgatcctataagaaaatgaaaatcagggcttcagaatgaaattgtcgttctaatgttattaatatccagaatcttttctaaatgagcaaatgtttattggacatatatactaccaaaatcaaattctagactaacaactcaaatatcaaggaaataccataacaacttcctctgctgctgttgttggtgtagtctgcccctgttgctgcagccgccgccgccccaagctgcttgttgctgttgctaccggtccgccgccgccgcataatgctgttgtcgcccaagcagcttgttgctgccagctgctgcccaagacgcttcttcaaattggactgccgcagctcccgtcgccaagcagcatgctcgccttgatgccataatcatcaaaatccatctccatgagcttttttactatcaccagctacttcatcgcgaccgatttctaactgatttgctcccgattcgaaggacgagagtatttgggatctagggttcctagagagagtgggggattggttcttctcttctcgcgtgtggtcagattgggagacgggcagtcgggcatggaggggattgaatctagccaagggcaaaaccgacttaccattgatttcttgttttcttgaattatttctatgcccttaattcctccaattcagacgggatggcaaacggaagcaagctggactgactttagtggcaattttgcaattcgtgcttttgtaatggctattccgagttagaggatgaaaacagtggtatatttgcaattctcccatacatttttgggatctccgctatacgtcactcatgaaaaacttgtaggcaattcttgctgcggatgtggcccttgagtttggcgtatcagttatcaagggtgcgatattttcttatgtgttggtttaacacacgaggcaagcaagttcgcccccattatgcatgtttatttgtcactggatacatggatatttgccggtagtcagttttgtttgaattctagttgcagctttgtcagtgcaaattgatgtaaactctgatcacaattgttttgaacctgacaagagatgatatttttcattaagatttgtcaggtacaatagggagaaatgcaaggaagaaccatttttacccgctgaagtctcattaaggactgctgatcatacatatccaccatttgagcaggtattactaataatcttctttatgtgagtctttcacccaacctgaaaaccacaacatgtaatatttgtgatttgttgtaatttatcagttttgtctcaagaaatcatgtcatgtaatatttctagaaatgttttgtgtgaagaagttatgtcgtgccagttttgttcacactctctgagtttgttttttatttttgtctttgtcttttgtctgttctttaaatttaatattaatcaagcttctagtacctaactaattaaagtttactggacttaaagttttttgtcagtttgtttttgtatttttgtcttatttgtctttgtgttcgtctttgtcccttttttaaatttaatattaatcaagccaatttcttagttttgtgaaattttcaggtagcaatgtttgattaggcacttcaagtacttaatacatttcagctagcagtattattcaatggctccttggttcaattcatggattcaaagggccttatgagtttcatgctatagttcaatgactccgtggcccagatcatggattcaaagggatgctatggtccctgcatttttttagtcaacaggttagtcttggcactatcaaacttaactgaacactgtacgatggtagatgttcagaa

SEQ ID NO: 46891 - DNA, 7224 bp, Oryza sativa
tatataaaactagctgggacccgcgcattgccgcggacatattgaataatcaaatcaaaagttatacgattcttttgctaatcaatgaaatattctttatcattataatatagttaaaaaaaatgtatcaattgttccatgtacatgacctataattgtttatacaaacgaagcattggtgagttcaaatagtagacctgaaggctatcaaaatacaatgtacccaagcaattaactaagagttgttttgttatggatgaaattgagaaagctgcacagggtggcctctacaaaaaattaagctcaaatgcaatgcaagatgcataagtattattatacacagaattttgctcaactacagaatagaaatcaagcaaaacatgaatatatggtatatggctcaggggagcttgaacaaagttggcattttacatctgatggtgcaaatataattttgtcaaaaaaaatcttgtataaaaagataagtaagaataactaatcaggttgtctggtttaaaaagaactaaaatagtaataggaggatctctagtatagaagcccggtgaaggagatgtaacaatatattactgtaataccttcaaaggcctcggtaacaataattgtacacagcacccaacgaaagatccttgtgtgtcatgatatgatactctgcatggagattgaaggtcacatcaatacatctgcatttgcagagacatgaaaagcagcagcgcacagattaaatcatactccctccgtcccataatataagggattttgagtttttcttataatgtttaaccactcgtcttatttaaaattttttgaaattattatttattttaattgtgacttactttattatctacagtactataagcacaacttttcgttttttatatttgtaaaaaaaaattgaataagacgagtgatcaaatgttacaagcaaaaactcaaaatcccttatattgtgggacggagggagtagaagttagcagttgaggataaccatatgaagaatctcaaggacataatagattcacattttactgatagtatcttacccatcgcaattatcaagcagcgaggtacactgttaaactgaagctattgtcctaggcataacaatgtaaatatgagagaggaaaaaaggcacgcgatgaatttgaagtcatcattcttgaaggatatctcagggaatgtgctaggatcagaagaaaacaatcatgaacacatccactgcatagttgtttagcagagaaggtgcatacatcgttggataaaaatgcttcctgaattgagagaaaaatttcatgaccaaatcaacgtaatacatagcataacttggcttcaatgtgatatgagtatactgcaagcaacaaagagataacaccaacaaactttgtgctggcctataatacctgcaatagccatctttaagtgctctagaactgaaccatttgggacaaaatattatacagttaatagctgccatatcctttaaggcctgactcttatgtaactgaacgtgatgagaaatctaaaattaagtgacagcagtgtgtagttttgagtacttaactaataatgcataccgacgggctaagtccatcaagcatttcatcaagtatatgacatacacaaacatatatagtagacgagtgtatggttaatttaccttctatttcaaagagttgtaggcaatcaatttgaaacaatgattgagatcaaccatcttacctataagactgtaaagaaaatcaaatgaagctactgaagaattctgaaaatctgcaaatataattaaacaaaaggagaagagcacaacgtaccttggttctattaaactgagctgctcacaaagtcactgcaccatatatatcaaaacacagctgcaatggagtagaaggtgcatctaagcttatggcatggctataagaaaaatagctttcaagttatacaacgcagcagcaggccagtgaatctgacatactttggtcaagataagacaccacccaacattaaatttacattgtaaaccgtccatgaattttcctgtggatgaaacaatggccatggaaatcatctgttgtagagtaaacgatggcgaaaccaaccaattgacaacaaaatgaatagagtcagaccagataaagcgctgttgcggatgaaaatgcagatctgcaaggaaaagaatcaaatattagatattaatgcctaaaattaatgatgcttcagcagcagagaagtggcaaaactttatcctggacagggagcagttggaatagtgcaggcacgcatcggaatcaacatttatggcctaatccagagagaagataacagaggcatagaagcttacctatatccgcttgctggagctgactgtcccgtggaaggcaatgacggcagtggccggaacacacttactctactccgtactgaaaccctaaagaggagctcatgctccatggaacacgcgtggtggcggatgagcggaggcccgggaattcagacaactcgatgagaggcctaccggagcaccgctcccctgtactgaccacggcgaatcgatggatttgggggtcaatgtactgtggtggtattccatctagaagagaaaaaaatcccctaacaaacaaccaataacggctaacctaaaatacatttacagttcaacgtggagatgtacaggaaaaggtggtgcaaattcaatacctgagtggtcttgctgcttccggtttctccgacgaggatgagggtctggttgtcacggaggacggcgaggaaatcgtccttctgctgccacacggggagcgtgcggtgcttctagaggatctcgaggtaccttgccgagtagggcctccccgtccaccaattgatggacgggttggccgcggcggtggcggtgctgttggtggtgccggcgtggccgagcttggtagagacggagctctcatcgaccacgtcgaagaggctcaccatgcgcttccgctccgtccccatcacggctgcggcagcggcgaagcgggggtcgggtcggttcgcgcggtaaggaggaggaggcgggcgggggaggtgaaaccctagctcggttcccctctcgccccaatgcagcgatgcgtgggggaattgcgcagccgtgcgggatgggatccatcgatctgtttggtgggatgtggggccagcgaagcgacgcatacgatagaggaaggaagcatcgcggcttcgcccgccacaaggagacgacggacggatggatccaatcgagaggagcagatcgagcggcgcagaagcaaacaggaactgttgccctgtagcaacccaagacgcgctgagattcatcggcggactggttaaaaaactaaggatttgatatgatgtacgtgcacgcatgtgtgagtagctcaagagtttatcaaagcccgagtacgtgacttcaatttgaacagaattcatttgaagagctgttcgcctgttctggtatgtagatttgggtatttactactagaaaaaagatttttcatagcgttattctatcattttcgctgacggtcatacgagaaaactgctagcaaaaacgtaacaagaggtggagggctacggaccgccagtgaaaacagatttttgctggcggccgagttaagcgggccactagcgaagatgttgctattttccctgatgccgccaccgaaaatcagattaaagagcaccacggcgaaaaatccaccgcccacctattaaaatccgcgcccaccaatatattccacgtgcttctccgcctctctccctcctctctccgcctccacccaccgttctccctcctttctatgactctccatccggccgctggccaggccttgggagctgcgacgacgaagctcatggcgcacagtggcttggtcgacgggcggagcaccggcgacggcgactcgcggggcggcagatgcggcggcggtgactcgcggggcggcgaacaggggcggaggtaccttggttcctgggtattcccgggaatacctaaaatttttttatcaaaaaataagtatacttttaatatatacacatgtacacatattagtgcacctaaatcctcaactcttcgatccaaacacggcccaactggcctcttgcattgcctcctaccaacctgatccactccgtcatgacccatcagacatcagttgacctacttagccaccactcttccagacgacgccctctcgctctccctccgtgacctatccctccctggctcggctccctcgcgccgctccccatttgcaaaccctaggcggcggcgcggcgaggctaggtggcaaccggcggcgggagctagaccgtgctaccatggagggggagaccattgccgccgccgctggaggccagcacccgacactctgccaagctcaggcggtcaggctggttgggtggccggcggccacgaggggcagggatggccagcggtttagcacttagacagaaatacccaactttaaaatcttggctccgccactggcggcgaatgccacttttaagctctgtttttatttgtactatgtttttttttaaagctgatgatacatctattttatttgctgatagctaatgtcactttttgacccagttaactctcttgcccgtggcaacgcgcgggccgccaatagtatatagagatattatgcatatgcttgcgtgcataagctagctgactcgatcgtgcgcgttaactattgatcgatccatcaaccggtcgatatcaagctgtacctacgtacatgcaaattaactaattaatcacctagctagctatatatatagattccatgaataatgcttgtgcgtgtgcgcatgtgtgtgtctatatatatatatatatatatatatatatatatatatatatatatatatatgcatctaattaataataatctctcgctctgtctctctctttctttcggagatagcatgcatccgttgttaactggtactttatcctcctcatgcatccacatgcatgcatgtgaccaataaaagaattgcacagcaagtaagagaattaatcaatatatgtgaatatgtctgtgtagctgcgctgtacgtacctacatgcaaattaatcacttcacttagcttccatgaatatacatgtgcacgcatatgcatctaaataatgtcatctatatatatacggatctttaaaggagttttcttcacatgatcagtgttaactttcagtttccaccactactaaaataaacatatctacagtttggcactatcggtgttggaaatactaaaccggtacctataatgcttttcccgctccaaacgcgcatccatgggacaccatcggcctgaactggcaccttgctgaagacacatgtgccggttcgacaagtatcagttttttaaaagaatcgacacctataatatattataggtcctagtttattatcatccgagatgtgccaggaagatctagcatcaagttttggaatgacggacaatggtgaagtcagatctaagtatgaggggaccaacttaatttacaagtaattacactaagaaaaaatattataaaatgttacgaaaatagatgcacaacggaaacacaaattttacgtggaaaacccttgcggaaaaaaactacggacgccgaccggcaacgatcaatgtagaggagtttgatacaacgtgggggatacattgggctgttacactctcgccgtgtggcttacaagggacacaagggtggatctgaatgggggccttggccctacaccgaaggggggcaaaagaccccttacatttctttttcactttcatagtgtacctgtgcagtagacaccccttactccacctctcattctactcgttgtttctgctcgtttgtatatataagtaactactagttgatacctcgcactttgttgcaagatatgtgaatgaatgcatgttatacaatatagaaatggtagatgtatatattttaataatgtgaaaataatatggagataatgatttgacactttttgcatattgatttcttaaaatacaacaaaattataaatgatatggcatatttgcataatatttaaaaatactctagataatagttgttagtgagtgatgatgtgacacacttgtatgtgatttaaaatactctagataataatttctagggagtgatgatgcaacacacttatatattgagttttaagagttagtggatgtcaactttacactaagatatgataagtagaagtaattatatatcaattcactgttagaagccaatgttatccagcacttatgtgaggaagcacaaggcagttggtaagggccggagaaagaccagcacgctaccttaaagcaggtcatgactgcttcaaccaggcaatctagcttggtgatcaggaccagaaacaggaccgtccatgtgtgagctctgcgacttatgaaaaataaggaagaagaagaagttaggagcctagaaattgctccctctatcctagaaaaaaccaaactcgcactaggacgtgtcactactacaataaatttaaacatagagacatcttagtacgaggttggcttttatcgagacatgatatctagatcagatccccccttccccaaaaaaaaaatttactatttctgcttcacttaatcgggttgaacaaattattttttctcaactccgacaagtgttcgatggcaattataactacatccaagatctgtattacgttataacgaagcgagtatgcaatctaggtggtatgattctattttttttatttggttagaagaaaatgaattgttgcaatgattcttattctacttattcacaatgtcactacatatgttggtgagcttatttaatagtatagctctaagttgtcgttagttgcgaacgggtttttacttgttagataacataacataactaaagaaagaagtattagattgttgcgtacttccattgcatagttggaaggcaaaaaagattaagaaaaatgtagtggtattagagacccgtcctaatgcaatataaattatatataaccctgatctgtcatattgtcagtattttcaaaaagataggattttattttatatttcggaaatggacttaaattgttagggatggcccaaagatgatggatcaagtaacgccaattctttctgcagcaacaggctgccgtatttttacctcctgtcgct

SEQ ID NO: 46892 - DNA, 743 bp, Oryza sativa
attcctgcaccccaaatttatctcttcacagcccatagaaaaaaatataagagcccatgacgatttatctttgtgaaacaggcccagacttgcaaggagagaaagcaagaaaaaaaaagcccatatacacgtgttttgtccaaaaaaaaataccaggaaaaagaaagacacacagatcacgcctaccgtctgccagcatcacccaccatcatcacccatccaccaccttgcgatccaagaaagaaaaaaaaagaggaggtcagctcaatcgggaaagagagaatagtgtgtgcaaagaaaaaaatctgcatgcatgcatcgtttttttttttttggaaaccccacggggtagttgtattatagtagagggaaacactgtataatagccatgcaggctaggagactacaaagaaaaagagaaaaaaaaagaaagcggtaacggagggtgtaaccacaaaaaggaggtgtacgggttgttggttatgttgatctacacgctgtcatttgcacttccatagttgttcgccgtcaggcactggatgccctttgcccctcccgcgcaccatagccagatctcgtcggtcactttatcaatgattctgtgcggcggagtctctaggtttccgaaaaccctgctgtttctctccttccaaatctcccaggagagtaggattagaatcgatttgacccccttccttttctccttagccgttgcctgaactgtttggacccaccagtcctcc

SEQ ID NO: 46893 - DNA, 10628 bp, Oryza sativa
  unsure (1)..(10628): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaattgtcaccgtgtgagtgaattcttctggatgccccaatggcgacgtcgacagcgaagatgaggctaccccgtttgcatcgtgagagctacgatggatagatcatagatatacccagggttcaaaatcaaccctcaccccccccccccccaaaaaaaaaacaaatatggatactattttagccaaaaaaaaattaatttagcaatattttgttcaaaatttttggtatatcagtaccctcgtatcgacgaaaacaaaagattgaaccctggatatacctatgtgttcctgtgaggctatgaacgaaaacgactccttttccttagcactcatgtttcgccttcattcattcgttttctgggaagggattgatccgacggtgacaccgtgatagttgagtctaattcattggagcttatgcttatacaagtcaaaatttaaattttaaaacttaagtttaaagttgattttatggcatactttttccatcgtagttttttttacaatagtgacatgtatatataaattattatttgttggtttattaataacagtatggataaatataggtgaaacgatgggcttgtttatataggtacaacttgaaaaaaaagaagcataagaacatgtgttttttttatatccatgacaataaacaactagtgctagatgcctagctagttcaccttttaaccaccttccaggcacgaaacaacaactttgcgcgactatttaattgcccgtcgtgtgcgtaatcaatgtgtctggccggtttgatctacgcgatttgcacgaggttagccgacgtgtgtagcgtccatggttgatccatcttcgcatcacggtgacttcttctggtaagtcactgtgaattgtgtccactcgtccaagaacatgtcatactgtggatgggctcaaagtctcaagcagacgaacactgcaaattaagcttgttatagtgagtagaggttacagcccctctctccctccactcctctctcatttatccgcctttgttcccttgtgtcactcctctctcaattatcggcacacattggtctcgtcttacctcgtgtggttggcaagcagtacgtctgtcctgtatgattgcggatggaccccccactcccatttcagtgacggatctagaaaatttaagccagatgaaattcactatgacacattactagaattgtacgaatctgttatgcttgatgtgctgatgattcctctgtcaataacaattctagaattttttttaaagatcagatgaaaccacttaaaaaaaaaatcacctacctagttcgttaccaacgacatggcatttccacctcatgtgttgtgtgctgctgcgcttaagcaattgctcacgacaacctattgttagcttcactagtgcatttacgatgatcattctcctatccaattctaataaaacccgcgatgaatataattcctactttatggaccaatcaaattatatataaaaagattttgtactaaggaagaggcttagcgtcgatgtcccatgaaggaggtgctctgaaggagcattcttgttcagcatggctatttcctccgtattctcctttagagacattaacctttcattaatgtgagggtttcattatatgaaaccaaagctgacataaaagctaagttgagcaatcagattttttttaaagaaaattagggcaaatattagaacctttagtgttatttatctttctctaccttcatatccttaaaaaactaagttgaggaacataggttttaaatgattttcggaggtttgcaatcctttggaattgtttcttatgagcttgtttggaagaaaggaataggtttgttggattccttcggaaaagtagcaatttctccattcataggaaataaaacatctactttgatccgaaggaaaatatcctttgcttcatgcttgcataaggggacgtgatttaaactgcctaaattgcatcttcccgtcttttgaattccttagttttcaactttacactatatcatattcatgtattttcattctcggatttaataattgtgggtcttttattttgtgttgttgcttattagtttgtgtttgttttatgttaacttggtgtgtttttggtctcattacatcgtgaatgcttttgatgatttgatataacaattggttgtagcttgttgagaaaaacaagaaatatatattccattcttaaaaaaaatgtgttttttgttatcatgttttcatttcttttttcaaacatgacctaaaaactgtttttttttcttggccctactctaatttggtggtgcgctggtgcccttcacatttttttcaagctgagaaatcaattttcaaacacaagcactgttgaaggtgtccacatgaagaattgccacggcccacgtgcatagaaccactgcacctagtagtagtactagaaggtaaagtaccactccatacttctagaagcgaagttccaattccaagaggaaaagaaaaaaagcttactccttctagaagcctatgataagatggacggcatcacggcaacgtcaatatatccatccatccccacacaaatcccccaaaatacaaggacctccaaaaaaaaaacaaaaaaggcctccaacaatacagaaatctactacctcatttttttaaatagataacaccgttaacgatttatcacatatttgatcatttatcttatttaaaaaatttacataatcataacttattttgctgtgtgttattttatcacttaaaaagtacttaaaccatgatttatattttatatattgatacaaaacttttaaataagacggaatagtcagacaagtgttcaaaagtcgacatcgttatcgtttactgtacggtacaccaggggtataccgtatacggtacactatatactccagtgtttacatacgtcacacacgtataaatacaccccccccccccccccaacacggatatactaccccactagctggaaggcgccatttttatagtagtagcccacacacacacacctcatcacttcaccacgtcgccttcgtcttcctcctccccaacacaaacaaacacaaaaaaaccttcgccgactctcgctcaactcacctcaccaccggaggcagcttagcttccttccttcctcctccatccatggcggaggagcagtccaaggcccaggcgggggcgaaggccctgtcggagccggtgcgggtcggggggtccgcggcggaggccacgctctccggcggggagctggcgtggcgccccacgggaggcggcgggggaggaggggaggcggggaggctggagctggagtccgaggtgctcggggtccgggtggacgggagggcgctcagggtcgcgaccttcgcgaggggcgacgacgcggcggcggcggcggcgcggccggcgacgtgcgggggcggggagaggaggagggagagggagagggagagggaggtggtggtggagatggagagcgaggaggccgccgcggcgtggggggacgccatgagagatcgcctcgcctcgcttggtaaattcactgattaatcactagtagtagtagtaactcggtaatcatctgctcttgatttgttcttagtaacagaaatgtctactgttcgatgatctttaagcttgtttaggttattgtttgattcatggtgtgatttggtcacgaagtgtcgccttttttattgggattgatctttgatcaattgggcggtggttgcgttgactcagtcggagactcggagtaacgtagtggggaaagaacccccaaatatcgattattcactttgtttagttgatcaccttcataaacaaaaacttaatgtaatgagtttttacaatcgacgggagggatgtacagtactgcatctctctggatatttcttggtgtccgtgctgttgtaacgtggcctgtcagctctgttgcacaaatttgtccaaatcgtcaattgtacagtactactttatatgtacggatagcgtacaatacttccaatagggagttctttttaccccattgtttcttcaagtttcactgaccatagatcaacttttactagatagtttaaattgtgtatgagtttttgttttttttaaatatattttgaatcaaatggaccagctcctggtggcataacaaagattgtggtgtttgaacttgaaatttcagccaggtccaagaatcataccatctgatatcctgatgagctcttttcatctgctgctgattaatgtaggagaagatattttttgtaatgatcatttggatacttcattgattttcatgtgttggtcaaatgtccttctcagtgtcgctattgctattaaatgtcacccttgtgtatttcattagacttcaataaaaaaatgaaggtggtttttatgttttcacttttccactcattagtttattataggattgttataggacttcaagcattttgcttctactgctctcacgcacacaatgtaattctatcctatctctaagcattgttcttctgcactcacaccaaccgtgtcttatgcatacttgaagcagagacaatgaccctctctttggaattgggttttttgctggcaaagttggattgaattcttcgcttgccacggttggcaggctgttatttcctggcaacattcatatgtcccaaaatccagaataacagtctgttggtaatttgtaatgcaaataataccaaggaagaaggaatagaatttgcccccctttttttagataataggaatcccgcatggttggagtgattatatacacctgttggaatttgtgaaggagtgaaatgtagccctttttgtcagcactaggtagtccatccaggtcttcaggaggtgttctgttgcatcaaagaagatgttgaacttagacagaaggtcctaactctcctaaaagttagtttctttggtttgtcatgtttgctccagttgttgatttccttctggtagtaaattcttttttccctgaacctatcctggacatcctccataaatttccagagcccctctattagtgtttttttaggaaaaaaaggaaaaagaacgtgtcatctctaatttgttcttcttcatgcatatggagacaactatttagggtattgacactgcaactaaagctggacttctaattattcttgacatgctggacttctaattattcttgacatctatcttattctaccgtgatatgctgttgaataggtcggccaaagagattgttcatcatagttaacccttatggtggaaagagaggtgggcggaagattttccagactgaggtcctacctctcattgaagctgctggcatcctttacaccatgcaaggttgtgatatctgttcaaaatcttcctattttggtaatctaagtgtgacacccagtttctctgtatacaaagtttctgaattatgaattgtgttcagaaaccaagcatcggcttcacgctcaagaaattgctcattcactggatcttaggaaatatgatggaattgtttgcgtcagtggagatggtgtacttgtagaggttagcaaaaaaagatgattcgtacaaaaacctgatgcgaattataggcagtagtcttctttatcctcagatatttttagagaagggtgaatttcctttattcttcttacttgcatttaattattttattttgggtttttaggtggttaatggtctgctgcaaagagaggactggaacacagcaataaaaataccattaggcatcatcccggcaggtgtttgaatatgtgatcacaattcacaatgctattctttattgtagtgatgcaaagttacacctaggagatctgtaatatgccttaggtttgttctttctgatcactgcagaacatcataaagttgtgttacactagagagtagcttgtgatttcttatttattttgttcagccttgtgtagcttctttacagctcaatactataagttctctgggtagagttttcacccattacaaataccataggtaccggaaatggaatggtgcaatcacttgtgcattttgctggtgaatccttctccgtttataacgctgtgcttgcaattatcagaggcaagtctctaccccccccccccaaatccccacggttaacgtaaatagtcatctgtgtttccatattgtaaatcctctcaaaatatttccattttctgtgttaataaagtactgatggcagcttctgttgcacaggtcacaagcgtccccttgatgttacctctgttgtgcagggaaagacaaggttttttagtgtcttgatgcttacttggggtatgccgtgtattagcttgatgctaagcttttttctctcttaaactacacgtctatacccccataacactgactgtcactctcagagcttgttctcccactatctatttctggggcactaagagaaaacgatttatgaactgcaggtctggtagctgatatcgatattgagtcagagaagtacaggtggatgggcagtgctcgtcttgacttctatgtatgcattctaccataactctatcaaacactcaattatatccatatgctttctctcctctctctttcctctcctttatttatgtggtcctcatggtcagtcatgtgcacaatgctgtaatgtgcttccaaaattagatgatcataatggttaggcttgcatcagtgtgctgatgatataataacaatcaacagatacatttgtttatgacgttcccatcgtggagcatgttctttaaatggaatgcatgtttatgcatgcattattttgctttgaaaaatgttgtgtacttttgaacacaaaaatatgccttgatgtctaaaaaaatgtcatcgtgagctttagtacttcatcgagcatatttagaggctgtctaaagtataatgcaaagattgttgtagtgtccttgtattcgcttattcagccccttctggatacttagcaattcattctatgctctgactttatttcagtcccttctccgtgtggtgagcttgcggcggtacaatgggcgtgttctttttgttccagccccaggatacgaaggacttggtgatcttgtagagcaaattagcagttgcaaatcaaatggggctagcactggtgtacaagaggacagatcaaatgattttaatgacgaaacatgtgcttacgcaggcccttcaattgatgaaactgatcatgagtggagatcactggatggcccatttgtttcggtttgggtcagtggtgttccttttgctagtgaaaatgtcatgacagcaccagaagcaaaggttaatctcactctgttttggttcttcataatcttttagtccggaaaggccaaaatattgttaaaagataagctggaaacttaggaattcaagtgattttagcaatagaaagctggctattgggttagtagcaatgaatattcagacgcttaaataaatactgtatttaaaagtgtctacatcctattaagccctaaagctgtctctttagttttttttaatacaagtgtcaaaaggtcgccaatcattcagtggtgttgtcaatcattttctgctatttctacaaggctcttgattgtccacagtccataccctgactattcttcattacattgcagtttggagatggctacttggatgtagccataatcaaggactgccctaggtcggctcttgctgggctgatgtttcagatgaaggatggcagctatgtcaaatccccctatgtggagtacttcaaggtactgtgtttacttacccctctgtttcctgaccactccatctctgttcctcagtgtaaaagaaaatgccatgctatccaccgagacattttttttagataatggaaatggtttatatcttcggcctctgcagtttcacacagcaaaatccaccgagataatgccattcaatcgtttgattccgtgccactttctccttttttttctttctcaacccaatgtaaaatctctgacaggtgaaggctctcaggattgagccgggaatgcgggtgggcagcaccaccaagggcggcatcatcgactccgatggcgaggtgatcgcgagaggggatggatcacacactggcgacgagatagagcacctgatggcctatggccctcccatccaactgacggtggatcagggcttggccaccattttctcccctagatgatgatgatccttgatcctgccctgaattcttcgcttctttcacagcatatgctacatacttacattacacctgtaattactcacacaccacaaatacaaggagagccacccaaaagcgcaatgtccggcgagatcttcctctctctctttttggcactgatcagtgatagctgctttactcaaaagtgtgacagagatttgtataccacaagattcctgatcaatgctgctactatgcttacaagcctacagctgctactatacttatcaatacaactgaaactgcagtttgcaaagacaagtagaggccaacctgcgaaccaccaatatcctactacaggtgtgtttacgggctgggctgttctgcttgcatctcatttcagaggctccaaccttcctacgtgaaatgcgaatggtcttgttcaactgtgatttttgcagcagctgcgcgtcattgcatacagcatgtggatactattccctccatttcatattataagtcgtttgatttttttacacactttattaagtttgatcaagtttatagaaaaatttagcaacatccaaaatatcgaattgcattaaatctgacattaaatatattttaattatgtttattttgtgttgaaaatactactatatgataaacttgatcaaacttaaaaaaatttaactaagaaaaacaaatcaaacgacttataatataaaatgaagggagtaacaaaacagctttagcagtagtaaaaaatgacaacccaacattggtcaatttttttttcagctagctgcagatcatctgcctcgtgatgccgattggcaccacgcagaggggcatgtggtcataaagaggaagagtgaaaaattaaaaagagaagaaaaacgggtcctggtgttttgacgcccgctagcttgctgctgctgatgcggtggcgccggccggcgtgcacgcggcattattgtaccccgagatggggagaatcttttgggagggaaggggagtcgccggccgcaagcaaccggtcgatgcgttgcatgcgttgcgtggtaccgatcgaaaaaaaaagggtggttatcttgcagccatcgattgcgatttggggatgttggtgtgagtgagagtgagtgacggatgcagtacaacaactgttcattgcgaccctagaatttggtgagggatagatatatatatagaaagtttcaaacacccttttatcttagttttcgttatcaccttttacaaactattaaacgttacgtttggtacgaaaacttttctacgtagaggttgttttaaaatatcaaattgagtatgttcatttgataagtttgtaataactataagttaattaattatataccaatgactctcattttacgtgcgctaatttaatatttatcttcatcagactcaaacaatgtcatatttcacgtggtaggaaactatcccctccgtctcataaaaaaccaacataatactagatgtgacacatactagtactagtactatgaatctggatatacctatgtccagattcattgtcctagaatatatccattcagtactagattcgtttttttcggggacggaagaagtaggaattatcgatccaatgaaatcgtacaagtctctatatagtacttcgtgctcaccagttttaaggctcgtaggaattgaagatggttttatccgacctataaaatcgtttattgaactgattttattttttttggagatgtgaaattcgtcgagcttcgactgaatagtgttgagatttaaacattctcgaatcccataatattatctttagaacaccggattcctctttccaacacacacaataaccatttgtaaattgaaccgatctatgcgaaaaccttatactaagattttgaagaaattcatggtttacaatcataaaaaggcagggctcaaataaagtactcctactacttctacacaggaagtttggaatcgtctggtagtaataaaaacagagcatatgcgcaccaaacatcaccgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgttcgctctcgggcgacggccgtcaacgaaatttgcaggcgggccccttgccgccctccgcgagggcgattttctactgtgcggggggccgcctgcaaatgggcggcgaggggggcatggaattttgc

SEQ ID NO: 46894 - DNA, 1511 bp, Oryza sativa
tacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaatcatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttgacaggggaggggctgggctttataggggggaggcaaaaatcgccctcccccagggcggcaagggggccgc

SEQ ID NO: 46895 - DNA, 816 bp, Oryza sativa
ttgtttaacaaaatctgccgctgacttcataaaagatttccagccacagtagtcaacaaccatattgaaatcaatccgatggcgccttaccatgtcaaatgcatctctaaaacgtccctgaaccagtgcctgaacaattgaaacaaggaccagcttcctggggtagatacactccaagttaccacgggtggtttgcattatgacagctgcttcatcaccatggagaacaccaatcagctttgcccccttttcccatacagtgatatgctctttgctttgctttcctcgaggatgactcctgatatggctatcggttgtcacttcgccatttttaagtaaaatctcactgatatccacgatgaataaaagatcctgcttagtagtcacaagcaagtgggtcacaacctgctcttttgctccataagcactggaatagaatgtgaagctgctacagttactgcttaataaccttttgcccacatgcaacttgctgctatcatcaagtccaaagagaagtgtcctaaccattccattttcatggcattgaacagcagtcatccaagggcatgatgttggaaaagtatggtcggaacctgtttcactaacttgtaccggggcagacattctaaacaaattcacttttgagcagtattcaacaacccttcctccacttaactgaataaaggctgaaccttcttttgctggattttgagatattccaataactgcagcctgcagaggcattttcttcgatatttttgcctgccaacctgatgaacaggctgaacctagcaaagaatccttcgaacatacaag

SEQ ID NO: 46896 - DNA, 26866 bp, Oryza sativa
aaaagatcttgtcctaaatatcaaatatttaggttagaaggtacacgctcagtgctaccatagcaaattgaagatgatgatgtgtttgtttgtttcgttgtacaaaaaaaaaaatcatagtgttctgcccaaatttagttagcagtataaacgggtgtattgacccaaaaaactggaatctgagaatcatacgcatggtaaattaacaccatataatatgtgtatccctcttgtactgagcgtggtactactattgctacgttgcgaggcaaacaataaaacgaagatttcaagcagtataacaaattggtgagcagaggaaccgtacctgggtgggggcggggaggtcgacggagtagaggaagttctcggaggagacgaagaaggcgcggcggcgctcggcgtcgacggcggagactaccacggtctccccgtcgagctggagctgaagcttctgcgctatccgggtaaccacctttaggttcttcatccccccgccgccggtggccggtggatcccttccggccgcgggaggagatccggggagagacggagacggagggagggaggagggtggagggcggcgggtggagctcgccggagttgatgggccgcggcggcgggtgtctagggtttggggaggttttggcaaaaatatgagttgggagggcttcaaggtggggggctcgatcccccacccgtgtcgatctgggccgtccacggaagatccgagggttactgttaaaatcgtttttatgttttcaaaagggttcttgctagcaacgaccagggcatatttgcaaacttaaaataacttgggaataaaacttttatatatgtgtttttagtgatctaaaacaaagaatgaaaaataaactaagatgaaaaacttcaaaatcaactccaaatttaaggttggaaattcaaattttagcttgtaaatatatttactcatataagtagaagcgaaaagatgaggctgagctgtgttctagagggttggaacttttcagaaccctttctactcggaaacggagctacaaattaatacataattaattaagtattaattaaaaaattaaaaataaattaatatgatttttgaagcaactattttatataatttaaaaacatattaattataaatttgaaaaacgtgcacatggaaaataagtgactggatgttgggtacgagagaaaagaacacacccgaagtaccgagcagcagtgaaaatcaaagcgccctccctttaaagaaaagaaaatcaaaacacactcaaaacgaatttaaaattttcatttcgaatgtaggaatttcacgatgaacgattcactttaagctagaaacggagaattatttcccgtgcgagcatgttaaattgttaactcagtacaatcgtgcagaaagcctattggaaaaatccaacagaacaaaggtctccaattttggggctgtttacacaacgtagaaatctcacagaatctaagcaggtaggagtatttcgataatttttttaccggtatttgatttcaaagccttcttttgttgcaaacttctgattaagggagagagaaacttcgacaatatttcacctgcacgagcacgattatttctcgtttgctccatgcatcctgacatctttctcaaaattctttgaggacatcacacacaaagagagagtaagcataatcaaacagtttactctaggtgatcaaaatactggttcgacatcatatgtacatcaaaattgaaactgttacatcctatccggcttcgctgcaccatacgtatcactagtaaggagcccatcagtcaccaaagcaattcttctcacttgaggaaccccaaattcatcactcgacattccaccacactgacagaagatagattgccaacttcctctaaacaggaatgactgcaggagacaacttaaaggctacagacttttgttgttgagttgaaatgactattagttagtaataacaactaataagtgaccaaatggattttctaatattgtttcagtaaatacaccgatggaaacttttcatcattctctaaactttatctgaaaattacatgtacaatggatgggctagccatcactattctcagctctacggtataatgtgtaagcattgtcaaattgccagccagcaagatgcacaatattaccatgtaatcacctggatgaggaagtgggtcagcagagggacataacctggaattttctggtgatatataaaatgcatttccacgaaaagatcactgtacagaattcgcagctccttgtggctagtacttgtaagaaattagtcactatctagcggtaatccaacacaccagcacccaatgtaaatggaaaggttagggaacctgcatgcaaataagatcattaataagatctatggcagcaagccagcaatatagtttttaatggtaaaagaataatataataagtaccatcagcagggccattgatgaaattagtatggctgtgtagacctcctgcgacgatattgtcaattggattttgtgtttgatcacaatgagccccaatcatggcagcgatgtctgggggccttgtttgaagagcttgttctacttggtccataaatatgcttgattggttttccatatatgcaaaagtttctatagaggttgcagccctagctgctgctatgctgaacatccgacacagcaagttataacgttttgtttgaaccaactgaggatcaccatcaagtgggaatgaataactacagtttggagatcctgatttagcatcctttctccaccttttcaagaagtattgaggaggaaggtccttgatattcctggtgtcaagtacctttagcatatggcggcatggaatgcctacgaattcaaaccctttacagctacagtttaccatggaattaagcgaatcaaatttaacaaaatgatcttttggattgtcctcaatgactaccctatactcagaaattgtgcccatctcaccacagttgtataacatgcaatccatgtataactcaaactccctctcgaacattttaaaggcagcaggtgtatatatattggaagcttgccttaacactcgcataggtggtggcttctttgtactctgactagcatccacatcagcctgcaattctgttgatcggcggtcacacaatactctttcaaactgcttgaagaaactcaaaaggtcaaattctagggataagtgtttcttaagctcagtgcccaagctctccttctgctggacacttttcatatcagcacaaaatgcctcgcggccatatggtagtgcccatttctccttaagagagaacaaatctgctagccattgattatcttctaggtcatacttttccaacatttctctccatgctgtcaaaaactcaggctcatcttcagagtcaaataggcatttctggaagcagtaatctaaggtttttgacccatgaaatgcttgactcaactgctgaagagcgttttggtaaatttgccagacacaataacgatgggctgtcgcaggccaacttgctgcaacaccttcacttattgcatcagatctatcagttaacaatgttttgggctgagttccattcattgccatcttaaaagtatcaaacaaccatctgaaagcctccacactttcgtcataaagcaatgcagcagcaaagataacagtttgcttgtgatgattcacacccgtaaataaagcaagtggcctaccatagccctgcaatgcatacgttgaatcaagacataccacatcaccaaagtggacaaaatccatgatagacttgaatctgaccatagaaagtttgtcaagttcccatcatcatcagattttactgcaaagaagaatgaagggttatcatgttgcatcttttgcaggtactctagagtagcacctacatcaccatagtgaggaacctttgtacacttgaatcttttgttacttctaccttctagagatgttgccatgatatttccaattataagattttgcctgtggatattagcatcagctgaaccatcaaccaaatccagtccatcatcttgaccagtttctgtactttgtgatgttgccacaagatcagaaggtactgttgcaccaagctggtgattatggaaggtaacaaattctgttacatgatatttgccattagatgtaagtctaatgaccatacacgctggacaaccagttcgggtctctgggcgaggcttctttactctttttgcccctcttttcttctcacggaaaccttcttttgaacaaacaaacatccttcttgtgatgacattttcagcattcatagtcatgcttgcccttctcacattgaaaccaattttcccagcatacatgctgtaaaattcatatgcctcatcttcactcccaaattctggcgtcctcacagtatcatcaaccagattttctctcgcagcccgtgctttaagcctgattttcttagccttcagcatatgcattgtagatgctgttgcaagttgatggttatggtttggtacaaactctgtcaaacggtacttgccgttggtattaagtctaatggtcatgctcgcagggcacccaattcttgtttcaggccgcgggcactttgcttctttggtgcccctcttcttctcccgaaaaccttctctcgagcagacaaaagttctcctagtgattatgttctttgacgttgtccagagtgttgatctccggacaaagaagcccaccatctctgcatacgcattgtagaaatcgtatgcctctttttcgccatcaaacagcatatctacctttggcaacatcttctcatcacaacaaccaacgtcaggactaacatcagccgccgccacatcctgccaatcacaaattgcagcacagcacaatcaataagaaggaggcgatatatgaacatatccctcaacacctagatcaagaaagtcacataggcaactataaaatcgcagtaccacgttttgttgtggatttgcaggattcaccgctggtggcagggtcggcacatgatgaggccatgttgcatatggaggcaggaggactacatggcccggccaagacagctgtgctgatctcgggtcagcggcaggatcaatcactgcatgaacaggcctcagggtccggaccaacggcagtgccacaagctccggagcattttcaggatctttctccttcgcgctacccccgctattgctggacattgtgttctgtaacctcactcatacaacaagcttacttgatagaaaccggtgaagcttctcctaggtgcccgtctctctcctccttgtcaaaaaaagaaatggaatgaaaaaacaaaagaaatggaatgaacaaatgcacaatctgttatctctcttcaagaactaacattctagtagtagaatgcaagcacgattgatgtcaaaaaagttctactcgacgggtcagaagtataaagaaagggggaaaaagaatgtgcttagaggcggcgcgagactagaagcagcacacataatgtaaaattgtaaagtcaaatttgaccacgcttacaacgaagatcaccgagctaagtaggaacagcacagcgaatccatggcaggctagctcatctcaccgcaggggaatcaaagaacgcacctgtaccacccccacccctcctccctctccggcgatccgagatggagacgcggccgacggatgacacgcacccgcgccgctgacccctctccagcggggctccctatgccggtcgcgcctccgcagccacctgctcctctcgatgcgccgccgcacgtccgcctcgctcctccgcgggtcgctgcgccgccggccaccggcgcttcgctccgctcgccgcctcggtgacaagagggggatctggggacaaccgggctgaggagtaagggaggtggttatgggctattgggccgaaatccacaccgcgtggacccacgggccggatatatgggcctcacgcaaaagcaaagtgggccgtagcatcagcccagatcgtgagttaaaccgcaactgaagcagaccccctctgccgttgatcttgtgcactaatctcgaaacaaacccggtgcagtttcttcaaaacgaagtgccctgttcgtgcttacggtttcgcaaagtgcagtgtctgaagagaagaccgaatactgtactaaatacagtggccagacacgtgtagacgagtaccatgtcatgctaaattgctactagtttaatgctcgatcaagttcggaatgggcagcatgccggccatgtccctattgagtattggcagtgttttcccgttttagttacatgattagtacgcaatcctccttgatttgacagtccaggctcgctggcgcgtgccactagataagcctatccaaattaaatcccggtgaatataacctcaagtattggtgtatgatatcattgattgtttgaggcacgtttaaccattttcttaattaaaaaattatatgtaatgattatttatttttattgtaacttgatttatgttttttaagcacgacttaaaaggttttcatagttttattaaaagtttaaataagatggatgatcaaaagtttattagaaaaagttaatgaaaccatatattaaaagatatattaaaagacagatatagcatatctctgtccatcccactcctgtcgccgacgacgtttacgtgtgacctgccggccggcctctcgctagctatagctcgatgtatatcgatctctcccatgtacaatacaccatgggttacatccgcgagacgaccgtgcccatctgcacagccgtgttgacatgacggctaggcggctagctgatcggtgaacggctagaaattaatcaccagcatatatatatatatatatatgacgacagggagcatttgcatcagtggcattaatcgtagccaaacttaacgagcagtgtcaagctaacctaagctagcacatgatcacgagaacacgctagaatcgacatgtagtacgtattgtgtcccattaattgctgaacatattacatcctccgtcggcagaagcttccaagctagctgcagtaggttacatcgtcccaactgtctgtttgccactctgccgtgttgaaatactttgcatgctcgatcttgatccgaccaacactctcagcaggtagtcgtcgagattcatctgctgctgcatgctattagctctgaacgtctgaatctcctgactttcctctctgcctgggtcgcgatgcaacgacgacgacgtacgacgcgcaattgcgtcggccggctaatgcatggccaggtgcctgtcgctggcggccgaatcgcggcgatttccggttggacgcagaggctaggtcgtcgtgcatgcaggtgtcgggcggcgcttggcttgccggccggcgacgtacgtgaggcggccggccaggatgttataagcagcatatgcagctgggagacaattcgagtgacagtcaaactgtcgataagattcagaagaaaaaactttttgagattgtatcggataaacactctttacttttggtttgctgacgttgaaacggtcactttgtcgtcctaactaaccaactattttacctgcggttgctggtatatatttttcacggtcaatggctcaatgcgataagtgtaacttgcagtgtacacgtctgacatataagatgggcgttgatttttttttcccttttgtttttcacccgcaacaaagctaagtcaatagaacgatatggagcactgcaccttatccagttatccttgactccgtctttatacaatttcgatatgatcgatataatggcacgctgcgatatactcattctattccaaaataaactaaccttgtattataacataatgcattttaatgcaacaaatttaaacatcacatcctaatattttgtacttgtgtacgcacgacatactacctccgttccaaaaaacacttaacgtaggaggggttaatttttttttataatggaataaaacatcccggcctttgctcatcagagctacagccaattattataaaagtaacacccaaacactgagtgtagttcaaatgaattaaacacacccaacaaaataaaagatcaaactaagataaggagagcatatttattcaagtctatttgtgaatctccatccatagtttgcaaggagttgcatgaccgttgtctcaagcctacgacatgcaaccttcataagctctcgatcatcttcacacatttgcaactgtgcccaaaatcggaaccaatatgttgccctgaaaatcacctgcatatatgagatagatagtgatttgtcaaaaaccatattattcctagtcaaccacagagcacaacatatggcagaagctcctacaagtatgagtttactcttcttcttgtctacccccaagagccaaccatcaaacatattagatatggtagtaggaaggtataaaccaagagagaactgtactgctctccaaacaaattttgcataatgacactctataaaaagatgatgaatagtctcatttttcatacaaaaacatcttaaactaccattccaatttcgtcttgccaaattattcttggttaggacaacccctttaagcaagtaccacacaaaaatcttaatcttaagtggcatcttaagcttccaaataatcttgtttctctcaatataaccattattaattaaagctagatacatcgacctaacagaaaatattccattctgatgataattccatctaaagctatcaggggattgattcaattgaatatgtacaatagaagcacacaattcatgccaatatgcaagattctgaccaactaatgatctcctaaaggaaacactgagtggaacagatctcataacattagcaatagtagaacttttccttcagacaatagagtataaagatggatatttgtctttaaaagccaggtttcctagccatttatcttcccagaaccttatttgtttcccattatttacagtctaagaacccatatctaagaaggtatctttgaccttcatgagacctgaccaaaaataagaatcgccctgtttcttattaacttgggttatagactgattgtagagatactttctctttaatagattttgccacacaccttcctcgttaaatcaacttaaacaaccacttactcaagagacacttgttttgtatttccaagttatgaacccctaaacctccctgatccttaggttgacaaatgatatcccatctagtaagtctatactttttttatggtcatccccttgctaaaagaaccgtgatctataataatcaattttttgaagaaccccttttggtatctcaaaaaaagatatcataaacataactaaacttgaaagtacatagttaatcaaaaccagtctacccccaacagataaatgttttcctttccaactactaagttttttctcaattattttctcaatcattttccaatctctattattcagttttctaacatgcattggtataccaagatatttaacagggagagagccaaacttataaccaaagatgttagaatactcatcataatattcttttgcctgaccaaaacaaaataattcactcttatgaaaatttattttcaagtcagacaacttttcaaacacatataaaatcaatttaagattcttcgcttgttgtaagtcatgttccaaaaaaatgatggtatcatctgcatactgtaaaatagataaaccatcatccactaggtgagggactaccccattcaatgaaccagcatttttagccctcttaattaataaagtaagtgtcacgcccagaaattctcaaaccagaatttctaagctgaatgtgcattaaatccctgtccaagaccagccagggtacacaaacgacaattgttgacatacagatccacgtcttacaaaaatagaaaagattacaaatgcagcgggaaagataaaagcgagctaaaccgggaagcttgacttcagcagcgagcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagtagtaaaacagctgtagtaattaatcaatattaacctatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaattcggcagctggacaaccggacaccccggccgacccaactccatcacgcccaccctcgcccccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacagcccaccattcagtgtattttaattacctaacaccattacggtggcaccaaaccaaagctatgctcatagtcaaagtctatgtaataatgtgatccccgtgtgtgtgctagttgaactaagcatggctaagcatttcctaaaccaacatctagtcattttgatacccaagttatcaacggcatatggtaaacaatatatagctgagtattaggacccatcccacatgacattgcaaaaggatgcaacatttaataaaaatgcgggatatttgtaaattgggtacaatatgatcaaacgtattgcatgacttgccttgctctcgcactgacgagacctcagcaacatcttcgagaaaccgcggatcgacgaaacggccgaaatctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcagaagggggggcgggcgccgacaggcgggccccgcttgtcagcggttcaagagagaggaagggggcgccggcacgtgggccccattggcagcggcacaagggagggaggtggcggcggcatgctcggcacggctcaagccggccggccagccatggggcggcggcggcggcacgcgcggtcaccggcggtgaccggcggcgcgggagacggcggcggccggcgcgaaggcggcggcggcggccgaagacgacggcgcacgcgcggagggcggcggtgctcatgggagagagaggaaaggaaggaggagaggggattcctcaccttcgagcacggcggccggcgcgaaggaagaaagcggcggcgacgaccggtgatgcggaggcacggacgggcggcggcgacaccctaggagaagatggagaggcgttagggatggagaaagcgaccgcgacgaccaaaatggccggccggagatggaaacaatggcgagcacaccggcgacgcggggaaatcggagctccggcggtgattcgcggcaacgaagcggcggccgaggtagctctcgcggcggcgaagctaacggcggtggcgggttggcgcggcggcgaccctagcggcagtggcacgcggccgaaggcgacggcaagcggcggcgctagcaacaagcggcgcaagcgcgataggaggcacgggagagcgcggcgaatgagggaaaacgaaagagggggctcgggagagtgcttttatgggcgagggaggggaggacgtggccgggaaccctcccgatttggccggcgacgtggggaggagagagagagagaggggtgggattcgaaatcgaatcccgccctctcgagcgcgcgcgcgggccgggagatgcgggggaagaggcggcgacgtggggaggacgcgggagcggcgcggcgtgggcgcgggaagagcggaggaggcggcggagtggcggattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaaaaggagggaaaagaaaaaaaaagaaaaaggattttcctgggatttatatattgcacatgctcatttttaattggttaaaattatttccaaggctctgaaaattccactaaaaatcctgttagcatattttgacatgtagaatccaagaaaaattccacatgccgattccgattattatttgcatttattaattaaggaattcagctctaggttaattaagataatttcttcgggcaatttatttaaccaatttttaaagcaagcaaaagggggaaaacttcagggcgtgacagtaagcatatctgctactatattaaaaagaattggagataaaggatctccttgccttagacctttgtaagtttgaaaattattaccggtctgatcatttactctaataccaacatgtcccccttgaataaaagaagttatccactcacatcatttaggagagaaacctttcattctgagcgtctgttgtacaaaagaccatttaaccttgtcataggctttttcaaaatcgatcttaaaaatcacacttttatttttgcgatgtaattcatgcatagtttcatgcaaaataacaacaccttccataatatttctcccaggtataaaagcagtttgagtagggctaatcaccttttgagcaacactcattattctattcgtagcaactttggtaaagatcttaaaactaacattaagtaagcagataggcctatattgttgaattttcatggcctcagcacacttaggcaaaagaataatagtaccaaagttaagggagaataaaggcaaagtaccattatgaaaatctctgaaaagatccaacatatcatccttaatgacatcccaaaagacctgataaaactcagcaggaaatccattaggagccggagctttattatgttccatttagaaaatagcctctttaatttccttttcagtgaattcttgtattaaaacttcattctctaattgagatacttgtgggatgtccacaaatttattttcatcaaactggagatcagaatcatcaggaggaccaaagaggcctttataataagtggtaatatgcgattttagatttgcatcaccatttatcaattgatccccatcttgaagttgaaaaattctggtttttgtatgtttgccgttagcaaccaaataaaaatactttgtatttgaatcaccctccaaaatatccttagttttagccctttgataccacttaatttcttcttctctcgtaggagtagataatctattcctacaaaaccatctaaaatcaatttcctcctgagttagaagaacagatttagactttttatccaacaaatccaacctatccaaaatctccctttttttttcttttttatacataccacgtgtatgtttagcccatcctctcaaaatgctgtcttaattggcgaatcttcgcctgccatcgctccatatgagtattaccctcatgtacactagaccagacctcctttaccatatctacaaagccatcacggaggggttaatgaatctggactacctttatctgcatgatcacaccattgtataacgtgtacacgtgtgagcgagcttagccgcatgcacgtcatatacgtacgtgcaaagctactctgtgtgtatatgtgtgtgtgtgtgtgtgtgtgtgtgtatatatatatatatatatatatatatatatatatatatatatatatatatatatatatatatatatatctcgagatcgatcgatgtgatcagcattctaaaattattgttgcctagcaagctatatatagctaggaatgaaggctatgcctatccatgtgcaagcggatcgatcggaattcttacgtcaaaagttgcaagccgataattaaaacgggcagcagctacaaataccgaacgatatacacacacgtacgtacacgtatacagatcgacgaaacgtgtacgtacatatagtatctagctatacttgccaaagcttgcttgtttccactagtgacgaagcccaaattttcttgaggccagacaaatcctaatacggctatcattttttctaaaaaaaaataaatcaatcaatcaaaatgtacgatatatatgatgcgtgattgtgattggatcctccactgttttccaccgtcgtcatcatcgatcgtcgtatcatcctagctagcttaactaattgttcttgcaatatagtagtagtagtactatttactaacccattccaaaattaatataaacattcatacgtgttttctaaaatgaatctggaacggagtgatgtactgtttatactatgctgaatttctgatcagcatgcagctgcttgctccatctcacgattctgctgatctgctcagtttctaacctttcacatgggcgttttgtccctagcgagccggccatttcataatcccggaagtgacaaaactattcatgggcaggatagctgggtaggtagtgtaggtcgcgtgaaatctggagatggattctcggattctcctgtctctgttttttccagtttccaaaacagagcagccggcacggtgcccccaagttttctacaagtggcggtgaaccggttctaaaagagagagagagagagaacaaacatacgcagaattttagaaaattatctaactaattcaggtactatacgtacgggattgggatcatatgcagtggctatagccactgcaacttaagcagtcctaagtacaccattggattataaatcaacgtcctagatctttccttgatactgttcatacatgactgtagcaggtactgtagcaattactgtttaaaacaactgtagcatttgtttcggccgttgattgctttgatccaatgatgaaaaatggttccaactgctaaacttgcagtctcttctatccgatgtagtcatagaagagactgcaagtttatagaacaaaagatgagaaattttgccagaaaaatactgggttataaatatggggaaagtaactatattctttttcagttcgtcgttgcttcctatccttagataatgttctttgtgtgttaagcatcaagcatgaaactgttggtatggatttgatggtccgaggtgccgccactaaaccgcactcaccttatccaaatccggaccggtccttgtcaccgacccatatatatgtgcccattaattctcttctcactaattgctcgagtacacgcatactgtacgtatccccacatcctccacccagtgcaaccttgcgcgtgttgacacgatggttcttttcctgtacataccacccctgtacagtacacagacgcacattgaaacagaaacgcggtttcgcgaacagcgtatatatatacgttatacgtatgtatatatatgcactactggtcatatatgtgcggcagtgcgcccgattgcaacacgcgcacagtcggtgcaagccaacaaacacggagagctagcaacgagacctcgtttcactgtccgtatattgatctcgctgtctaaaatctcgtcgtatatatgcatgtacatgtctcccagctagcacggtgacacggtctactgtgtgtcgaagcgttgttgaccaaacacgtattcttctactagtaacagctaactgatcgtgctcagggcttgttcggtacgattctaacttctaaatttaacttcagtagttaggttttgagtggaactgtaaaacaatctaaaaccaactcaacatgtttagtttattttatagaaacattttagccaacctcgttccttttctgggtggagatttcgtaagaatattttagctaacttcactcttttttttaagctgaagccgttaattagttggattctggctctagaagagagataaaactaaaactagaaccgtgtcaaatatgcccatattattggattgaactgtcgatgcaatcactctggcgatggatgggagatgtatcgatcgatcgtcggcgctacgtttgcagctgtggatgagtggaaatttcgtttgcgacgtcgacgacgcgagaaacttacctgggttggtcgttgggctggccggcgcctccggccggaagcttcagaatatgcaggtgtcgggcagcgtttggctcgccggccggcgatcgaggcgaggccaggctgccaggaagtcagggcctcagaggggacattacgactgtacgagggcgacgaaattatcagtgagattaaggatctaattaagcattggataaaaagattgatcaggattaattacttacgtaacatcaattggtatgtaccctttttccatggtcaatgtgcaggatatatctttgcatgcatgtgaagcagatagagaaggataacattaacatacatgaacggcacctggcattaatttagctttgacctgcagcacgaatatatccatgacagatgtgtatatatggcgtccgttgcagggacgaccctgactccatgtgttgctatccttctttttatcttgtctccaccgtcgcctctctcctatggccttcagctacgtgcagtgtgcaccgatgatcccgttgcatcaaatgcgtgagtactagtgaggttaggcccgttcttttctccaacaagagttggatgaatcagattttcgtgtcacgtttttcaaattgctaaacggtgtatttcatacgaaaactttctatatgaaagttgctctaaaatatcatatttttttcaaatttgtaataattaaaactcaattaatcatacgttaataccacctcgttttgtgtaaaaaacttaattttcatcttcattttcaggagaaaagaacaccacctaattcatacgtaagatagatcttctcggcatcactgataattaatctgactctctactcatattgaccttgcagttttgctctattcacttaactaactgattctcgtgtcctatccacacaaaaataagagattgttcatattaatgttatttcaaactatactttttttaagttgttaaagatgtgcatacatttaaatttttttaccagactttggtaaatatataaggaatcctaccaaaacttggtagtattgctaacttatcaaattttttgcggtgctgaaatttggtaatgtttttttttctgaaatttggtaatgtttattttgactgtgatttgaatagcccctgaatcttagtatatcttaatctgcatcgtgatacatccaacaatctattagttgcactttaatctcgatcaccttcacatggttagttgaatttgtcccccatggccggttgctgatactcgtactactggacgcacacatgcatggcagaagtgacaaggtgcagatgagtatagtaggtaaggccgcgtgaaatcgggagatcgatagattctcgcgtgtgtggtggcgcacactgcacagcgcatacagctgcacgctcctcgaaattttctacaaatggcggtgaacaaggataccaacctgcaccaacagcgtgtctacacgtcgcctccaaaaaaggccctcctgccaagtgccaaccggccgacgtacttgctcctagccgggcggcaggatctgatctgccgccccctctcgcagcaatttttagaggccgtacgatcgagctgggtgtacggcttttggctagtgaatttcaggggatttttttaatcatgtaaccgcatatgcacataatcaccacacacacgtacaccacattatattcttgcatatgcgagtatgcctcgtaatacttcgtacatacttaaataaagaaacagaaatcaataaatccctacctcactaaaatcataataaaaatacacaaattttatcacacggaagacacacattcaaacatatcactagacacacatgtcataccctctaatacatacatgctcagatatttatatggttgatggacgattgatgctcgtaacaacgtacatatacatgctccggtcatttatgccacctatttaatcaactactgattttgaatctgagcatagtctatatgtagatttaaaagcaaaagttgatcattttagaccagatggccggatcagtacatactgctagtacttgaacctttgaacctctcctttggtacaccaccgaggttgcgacaagtaggcaagctagagcctatagctaagccaataatattcgtcgagaggacatgaagagttggaagtatacttacaaaagttcggtctggttgaaaaaaataaaagttaggctcatttgcgaggcggagcgcgcgcgctcgctcggccgaaacggtcttgtactctggatctccaaatcgttcgtgcggccgtgttgcaccacatgcacgcccacgccttgggagacacgggagtttgcgtacgggaaggaaacgtctcgcgaagcaacgcgtggtggtggcgcgccatgatatgccgcggcgacgtttcgccggctcgcgaggccgccgtacgacgtcgcagccgcgcgcctcgcgggctcggggttggcagctttggatgaaccgtcgctgtcaccgggatccgccgggtccaacatgtacacgggccggccgctggctaggtagcagctaagattagcttaccctgattagaaactactctctttgttccataatataatgtatttaaattttttacttgtactgtttaaccactcgtcttatttaaaaaaaattgtgtagatataaaaaaacaaaaaagttatgcttaagatactttttgataataaagtaagttacaaataaaataaataataatttcaaattttttgaataagacgaatggttgaacagtgcaaacaaaaagtaaaaatcatttatattatgggacggagaaagtaatatattatatattttatatatacatctgggacagagtcgtctcgtggatagatagctcgttaacgagggattaacacactatgttcaattaagctacagtaaaaaaatacttatgtactgaggttgtgtactgagtactgactgccttgataaaagaagggatggttacaggcaacgtcgtatgcagggagtagttgtttaccatatttcggggacagttcgtcgatcaccggctgagatgtttgcctaagacggagacacgattgcgcgacgtaggtagaacgtgaccgatcgggccacgtagtgcgtcgtacatggacacgcgcgcacggtggaaattaacaattacggagtactccggtagtacgtaggagcactacacaccctcgtatgaaaatcaccgcgcgcgcgtgccgtccaccgcacgtcagtcaaaacgctcaacacctgtgctgctacgtgcacccgtcgtcgaatcgcccatattaacctcgatcgagatatgcagtgatccgtcgcccatcgccacctacttaaccgatatccaataaccaccaagctaggaattaattatgagtcatgtaactaatgatgccgagattagtggtagtggccggcaatatgcatccatgaaaccgcttttgtttgtgtggtgtgcaactgtgcatgtatagaagctactagagagacgtgcagttgcgtgctataatgctgcctactacactacgaattagtgtgtgctcacgatcgatctccctagctatatgacgaccagggaccatgcgactgcgagcacacgaacatttgctacgcgtgttgtgtggttgccgatgaacaggcaggcaggccaaagctacaggctactgaaaaacacagagactaatcagatatccctcacctaattcttgaccggccagggcacacgaccagttcaacaaaactgccgtgtaattaggccaaagcgcagtgtgcacaccagcagatatataatactactatcggcagcacatagtactacaagtcgatttgccgtatgccgtcgccggagccgcattacgtgtggcggcgtgtgtcgacgtgcggccgtaccagctgcgggacgtggtcgtgtacacgtgcacgctgcaccctgcaggcctgcaccctgctgtgcgtgcccttcacatgcatgctcgtctctcggtctcgttcccgtacacgtcgcgatgtgaaagagagggggaaaaatgcgtatcgatacgtgaccgtgttgccgtttcttctttcttttttttttccgtgtgtgtcgtttcgttcttgtttgttcgggtcgcggcgcgggagacgagctaacccaacggtgatgatgtcagctgacgtggcgccccggagcggtccagctcagcaccagacaaaagccggagcggcggcgtcccgaggccggcctacgtggcaggaggacgtgggggcccaccgtcgccgcgcggttcgcatccaacggttctttttttgaccgtttgagctttgcgacgccgcatgatgccccccccctcctctcccatcatttctcacacacacatgtaaaactcccccacgtggcccgtactcccccacagccttccaatcctggccgtccgatcatctcacgtggcatctcgaagcggccgcattacatttttacaattttttagtgcattagcccctgctaattaggggattaagtcggggggcgcggtgattacgacgtgtgtgtgacgtccacatgtcgccaccaccggccaaacaccgcgcggtcactcacacggaccgcaccgcaccgcacaggctggctctatctagaccgttccggtgcggaagaagaaagcggtgcacgctaagccacacggatctcccaccgtccaagcgcccggatccgacggctcacgcgtctccccgagcgagccgtgcccgctataagttggccgctgcgctgcaccccacctcgtgactcgcacgcatatcgctttgctctgcttcgccttcgcttccgcttccgattgccgtttccgctttcgccgcgcgaagacgtaaagaaggaggcggcggcgacggcggtggtggggttgagggatggggtacgcgcggacggtgaaggcggcgacggcggcggcggcggcggtgctggtggcgttcggggtgaggatggcggcgccggctgcggcggggttcgtggcggacgagctgccgcgggcgcaggcggcggcggccacgtggctgacgccgccgtacctgtacctcgtcatcaacgccatcatcctgtccatcgcggcgtcgtcgcggttccagcctaaccgcccgcaggccgcctccgccgacgcgtcgttggtgcggccggctccggttccggttccagtcccggtggtggcggtgcccgcgccggcggtgacgatgccgatggaggtgcccgttgtgccggtgccggaggcgatggctcccgagcccattcccgtggaggtgacggtgccggaggtggtgaagacggcgccggaggcggaggaagcggaggagaacttcacgatctcgaggtcggcatggacgccacggcggaggagcaccgccgaggcggaggcagagcatgaggcgttgtcccccttcgcggacctgacgaactcgagggagaagccactggtgtccactcgattcggccggaagccggtcaaggcgagcccagaaggtaaacaacaaatcaggaattctcctctaatcccgtctcggttctttcgccaattcgccattgattgagctcgcgggattgggttttgcagggagcagcagggcgctgggggtgtcgcggccgcggaaggagcagacgctggagagcacgtggaaggccatcacggaggggcgggcgccgccgctggcgcggcatctcaagaagtcggacacctgggagacccggcccggccgccgccagtccggcagcggaggtggcgaggacgcgccaccgccggcgacggcgatgcggaaggcggagacgttcaacgaggccgccggaggaggaggaggagggaagaaagtgcggcgggagccgtcgctggggcaggacgagctgaaccggagggtggaggcgttcatcaacaagttcaacatggagatgcggctgcagcggcaggagtcgctcaagcactacaacgaaatgatcagcagaggcagcgtctactgacgatgcagagcagcaatagcagcaagcaagagcttgcttttttgttttgttttgtagttttggccttttttttcttcttttgggctccctttttttttttaatttcttccttcaactatcagttgtgtaagaaatggttttgttcaaggatgatagtgatagtacacaaaagacaagactgttcatattaggggcgacagattagtgaagaaaagaacaacccaatttctattggggtcttgtgtattaaatattaattagcctttgcttactgagattgttcatggcacatgttctgttcttctgtgttcatgtgtagcatatgaacctgtttcttagatgtgctgctataggttacactcgagggtgtgtatgttgtttcgtgtgcgtcttacataaaaggtgaactgccaaggcttcacaaatgcaccaaatattcaatgtatttgtttggttgtttactagtagcttacacaaggtggttgtacatatcacgagaagcgtcggtatcaaaatgttaaccacaactttgacaaaattagttaagaatatgagcttttagcatgtcatatgtggtggtattgataaaaggtacggttagccacaactgtaacaaagaaccgagcgtatgtttagaggcccggtttcattttgattattgacgatttgactataggaataaattttaaaaataaacctaacaaacatctcaaacaaactggtgtaacatgcagagagtaaagtattttgagatctttattcgaagtatgtagtaaacaattttttcaataatccgatgaataagttttaaaaaatagattccaacataaaatgcaataaattgatgtatccaacaaaagccgatgattctgtaagactgcagctaagagaagcaatcctcagtctagagcgtggaggaaagagaggatgagatgatatcatatgaacggaatacaccgacactatacatatcacgtcagaattccgtgatttgagtacgggtaaactttgatggtaaacattatcacgtcagatcacactatagatatgaatgcatgctataatgccaaagggaaaccaccccggtaagcaacatagtaaatcctctccttgcacagggatggatgatccggtacatgaaataaatttgcccagaggtacatgctgccgaagggcgccgctctcacgctacatcactacatacagggtaaagcaacgggccctaggcaaacagcaacgggttctactacaacaccgacgcctggttctatggtatgataacattaaaactggatctctcccgccacaggataaactagatctttggtatagaaaggtaacatctacagagctacactacaaatccgcccgccgcatttctccattggtatagacattatctttttcatcggttatctaccatcgccagtatgacttcccttttgggcaggcagccctaggttgggttgtccctgaggagtctcgtcgcatcggatttcggtgactgctcgtcttcccgctcaggctgactgttcaggtcaatctggttcttgacaggagaggaggtcctcttgttgtcaatggacatgtcttcaggaccttcgccgttggtatctgctctctggtgaggagagctagtactggttggatgagcaccagagccagattgtggaactggctcgctggattgacctggctctcttttgcgaggcaccccagagtccttctctgactgctggcgcttctcgcgccgcatcataagcgtcctgaaacggcgtcgcactgtcatacagacgttgcaagtgcacgtctgtttgtgctttggtccctttccgctgggtggttgtatgcagactatgcatgagcagccagggcgatggcggggatgccttgtggttggctgggaagggagagattcaccttcaccaagaattgcaagatttgcgagtgtgtccagcccatctgaaacatcaatattgtcagtatctaccttccctttggtcttttttgcagcacctgaaatgcaacaacatgaattttaagtaaatgctagaacagtaattatagtagatcatttagtgcagttatagcctaccacacagcaaagaaaatatagtggcattatgcaaacattgactactttcatactggtaccacagatagaaatatgtagccccaaagtaacattggggatgtgttggttcaagatggcattctcaacacagtggatcatggcaagtcgtttttgtagttcggcccattgccaactatatcatgtactaatactatgatgcttcattgtgaatccagccatcagtagtgatagatatcaaccagccttacatgcctcaggctggatcatggcaagtcgtttttgtagttcggcccattgccaatgcttcattgtgaatccagccatcagtagtgatagatatcaaccagccttacatgcctcaggctggatcatggcaagtcgtttttgtagttcggcccattgccaactataacatgtactaatactatgatgcttcattgtgacatccagccatcagtagtgatagatatcaaccagccttacatgcctcaggatgtacttttgtaggctctggcatgtagcacagtagcacatagttctatacagccaattgttcgtagtgaacctctccaatttattatccttttggaattcatatttggcatgctatttaaaaagaactactagcagaaatggagcttctacatcagcatagataaatcactagaacatatacataccaggtttgataggaatcatttcgccaagctcctccatatttatctcttgggcagaatcacaggaagacctagtgataagtagtggtggttattagctacgtgtgtaaagtaaattgagactatccccaccatcctaccaaccacacgtgaacagaaagaaaaaaaaaagctattcttgtgttcaaacatgctaaattccaccgtagatttaagaaacagacagctcaaacttcgtgattgcaatatttataaagaactgatgggtggaaatagggttaatagaattgaaattcgggtaacaaaaaagaaccataagcataaccctaagagctatccttgaacttaggatgcaagtggaccaacccgcgaaccctattataggccaaattagtgggtaacccagtgggttcactggtcaacccacttgcagccctaggtgtggcaagctgggccatgacacgggaacctacgggttacccacttatttgacctatatgtgggttcacgggtcagcccacttgcatccctacctagaacatttgtaaatacgtttttctattgtagctaatcataaatacagcatacaaaaggctgaatggttctaaaatagcaggtcacctttcagaatcccatttattgtcagagcaggtccacttagagggcaaaagggcgtccaccggcagtttacgccacttagagcaatcctcacattgagcccattgatgattctcactggtaaaaaatgatgatcatttgtaagcagtaaaaaagatgctactgtactttccaaaaagtaaactgttgggagtcctacaaatggaagtcaagagaatttatattgtcgtctcatcatgcaccaataggataattctattcagatagaccattaatggtttcaacaattaaaagtttccaaaacattgaaaaaaaacacataaaaaattaaggtagctagataagttaagcattatgagaaaaagtgttgagataaatgttactaaaaagaaagaactggaatggtctgtctgggtccttttccacatatataacaaatgcagatagcaaagctaagagcattaccctgattggtctgtcacaaaatatgtcctcctcccaagtattggtggctcctgaaaattataggacgtcaatatagaagatatgtgtttaatcttctataccaagaacacagtaaagcaagtcacgaatgcaaataagcttaagcatgctccaaactatgtctcagatagtaattgtcccataacattgaacagctgaatagggctcaagtttgcaggcctgtgcccactagccaagatctgaatgctaaaagaaataataaaatgcacagcatacctcatattcctcaaactcatggccatcaacaacaacaattgaaggggccttaggaggaggacgaagtaattcttgagcttcctcccatgttatcttca

SEQ ID NO: 46897 - DNA, 1233 bp, Oryza sativa
tttttactggtcatcattgcaccaaattgtttgtgtatattacaaacagagaacgtgaaacagctatgtatctgttttatgtttaattctttgagatgcatttctttctttcatgtgcgcctcgccttcaaatctatatcaatagcatgcggtttttgtctatttaatgaaccatttttttccctgacgcaggtaagatcggctaccctggatacatggctgccagagcaagttgcatttattcaatgtatgtattactccctgaccagaaatttttaatatttgccatcaaacaaaggggtaatgcagttctcaatgatgattgtattcccgtcttcacttctttcagcaatggggaatgaaaagtcaaatagctactgggaagcggagctgccccctaactatgatagggttgggatagagaacttcatccgtgcaaagtaatgaacctctccaactttcagtacctataaatctagtacaatccatttgtcttgctataaatctagtacaccaatgtaaatcacctgcctatccaaggcctcccatccccccgcgcaagcaaacaaatacaaaaccaaaataaaggtttaattttgctttttaatacttaccattcattaatgggggaatgaaaaggcagttgctccatccggttataaatatttaattctaaggacaagatttggtcaaatttctaaaattctgaccattaaaaaaaattctaaaatgcttagttttaaacacaaaaaatggccatcgatagatttgacttgaaatgtactgtcataatatcataaacttattggattttataaacttatcctaatataaaattggttgctggaattttaaaaggttgaccaaatctttgtgctaagtgtcaaacatttatgaccagagggagtaatttgtaggggtgtttatggatctaacctttggaacaatgtgttggactaatgttattaacttatgtctaaaatgtagatacgaggacaagagatggataccgaggaatgggtcatcaagaccatcatctggtgctagagatgagaagagctcagagtcacaaactagtgttaacaggggtggccataatcaaagatcttcatttgagcaacaccgcacttcaccagctgcagtgagcaaaattgctccagtggtttctaggacgcccacccaggtaatcctactggattatgacaagcttttcctaggtgttgattatcagtt

SEQ ID NO: 46898 - DNA, 2176 bp, Oryza sativa
atgaaatgttctgcgagtgcttcaccatattccttacttgcatactgtggagtatcttttaatttgggctcctgtgttctctttctcaattgttcagctgcagagccagtacctagctcagacaaaaaggattctgctaagccagtagaaagtaagccccagtctacatcaggcatagaggacttgtttaaagattcaccagctgtgacagtatcctcagctccagctgccccacaagtaaatgtgaagaatgatatcatgagtctgtttgagaaggtcagcgccagcattacttttactaatgcttttgtgaaatggctctgtcatttaaaagaaagagcacatctatggtttatctgaagaaatacgtgtattttgcagtccagtatggtttcgccatatgctgtccagcagcagcaacttgcttttatgaccccccagcagcttgcacttctgtctcagcagcaagctttactaatggctgctcttaaagctggaaatgcaccccaaatgattccagggaacgccagtctgctaaatggtaatggttctaatcctgccaatggaggcttgccttcacaaagctggacaaatcttgcttatcagaatcctgggttggctccagtagcagcacagaatggtgccaccaaggtaagggcttttagatcatctgtataaatatgtgttttactgtatgttcatcttttcatgtctttgttacttggcaggttgcgaacaacaatcaggaattctcttttgggaatttcaattttagtacacctgggtaagcaatattgcttgactagtttttggcaattaaaacttcataccacagcttacttggtcgcgaaagaaatttagatgtgctttgaggtcacaaatcatggcttagcttttctgatgcttacttttgttttgatgcagagcatacaacactagctcatctgtcccagcaaatggggccgcaagtgcagctgctaacaagagcacatccccgacctcttcttccctcccctctcaatcaggcaaagaatatgatttttcatcattaactcaaggactgttctccaagcgatgaacacttgctatacttggaaattaaacaaatgggcctgtatgcaacgatggacacagcagattttattagggggaaccgggggccttgtacactcttttatgaggcagcatttcttcttgtggatattacgacaccttgtagctgtcctggacaaataagaggaagaatatagcagctaattgcatatgttgtttcctacagctgaagagagtcgatattgttcatgatgccgatctctttgaatagaggacgccttgtggctttgttggacttacatttataagagcataatgcaactattttattctctttgttcatgacatagttacaatacgtgacgccgattattttctactgtaccatacttggattttgttattcaaaaacatttcattgtattattatgccaagtgagctattacacgcactgaaccaaacttaattccctgacatttgttcgtgtccttgatttttcgtgtgacgaatgttctaaggctccgtttggcattgcgatgaagtcactttattcatttgtaggatgtaacagtaaagaactgttttcatgtgtacttaattttttgtgtggtgaatgttctaagatcgtaacgtgatagccatcaactgaaaagccaagtttatgggccaaaactcagcggaccaaacggcccaaatccaggacctatgagccgaattcggcagatcgtccgaatggccagaaagcacgcgaatcatggggcccaagacacgtgctctaatcggtcgaaatcactctcactaatgggctgaaattcaaccgatctatgggccggaattctgagtacgagtgggcctaaatctctccacatatgggccaaatttacgcggacttatgggtcaaaagtcctcggcccaatgggtcaaaattcgagcagtgagcgaaaattctgggtactaacgactcgaaatttcccggacatgaaattccgcacggctgctcaaacttttgaaggaaatgaaattacccattctgaaatattgaaaaaatcgaaatacggatttcaacaattcaaccgctacaaaagagatactacaaatttcaggaacaacacgacttcttcc

SEQ ID NO: 46899 - DNA, 1560 bp, Oryza sativa
agtaataatgactcactcatgtgaattggagtataccccggtccaaggcggcgacaatgctttgattcccaacaggtggtttcactatcagctgactgatgagctctcagcattttcacgtaattctcaagcgtatgtgcattctcgtctatcttgtcgttggatacagtatcctcagccaacttgactgcagccctttgagatacctcaaaattgtctccagccagctgcacctgacgggcggtttcttctcttcccagttgtattagaaccacaagtaggcttttaagctcagttagagcaccggaggtcagagacatccctttgagatgctccacaagtgccatctcctccccagggctgcacaaataaagttgacggtgagttgaaaaaacaaacggagaattgacgtcttaagaaaccactcggattttattttattttatttaaaaaaaaaaactctcaacagaagccgcctaccttccagctcgtatcttgccacctttcttttgtcgccttgcccctcttgacttgctggcactgctagatatgacggaagcactagattcctttgttgacctgcacgagcagcatttagaatttcgtatgggttcaacaatgttactcaacattgattgaagtttcagttgatcctaaagcaggaggacttggaactaaatagtgaaaaaaagaactaaaaacagaagataaaattgggtcagagaggatgcgcagataaaaatggcagatgacacaccttgtggtatatgcactcatttcgctgaagctagtgctgacttctgaaatgctgtcgtcttcaacatccataaatcggtcttcagactggagcttggctgcaagtgacagtctcctctgccgtacagcaacataacgggccagatatttgcccacctttagcaatccttcctgatactcagaaatcagcaaagcagaacattccaaagctgcatctctaacagtatcaaccagatcttgcctgctgtgcatataagctacccgaagagcttcttcccattctcttgccgtgataaagtaaccaacacctctatcgacatctgagcaatactccagtgctattttagcagcatctccaggtttcccaagtgcttggaactcatcacataggtcatgtgctagttgaagaatttcttcctttttaaacttcagaagacctgcaacagtgaacacacctctccaatccccacaatcacgatacgccttcaaagatttctgatacgacgaacagcattgataagttattgcagcatctgcaaagcatttctcttcagaaagttgatcaccccatgcctcaagaatttgatgccttttatctgggtcagtgaataactggagccccaaagggaacaattgagggttagcgttgaggagtttcatacagtcctcatgatactcgtcgccagcagaaacaatgttcttgagagcactttcatatcttccgagtcttaaatcaactgtgtacttcataatagcaggaggaaggcattcaagactcttgagaaaaggaaggaactcttttgg

SEQ ID NO: 46900 - DNA, 711 bp, Oryza sativa
atgaaccagattatgagggagaggtatgccaatgggcatactcagcacaccaccctggatccgacgtacgcttacactctctatcacagagaaggaacaaatccaaatcttcatgaccatagtcaccatgcaggagaaaatgaccatttgactgcaaggaaaggagtaacttcagatccttgttcctctgtatctactaccttcaagcttgattcacaccatccgtccattttgaaagatgatccatcagccgtaccagctgggttgtcttctaatttttcatcagcaaatggcccaaaagaccatatcagaattggaccaactcagcagcagcagcaaatggcttcctcctcattgcagaaacaattctattcccatagtgtgattgataacgattttcaagcgcaattgcgcaatggaaggcctagaatggatgcaaaggcgagatctcagttgcttccacgctattggcctagaataacagatcaagagctacagcacctatctggagagtatccaaaaaattctatgtatcttcatcagcaatttcctctagataatatagatttactagtaaatactgtcatttttttcacgtgtttttttttgtttaaactcttgcctgttcttaagtgtttccttaacctccaacagctcaaattctgttattacccctttgtttgagaaaatgttaagtgctagtgatgctgg

SEQ ID NO: 46901 - DNA, 8070 bp, Oryza sativa
  unsure (1)..(8070): unsure at all n locations
tatatgtaccccgaggcttctatgaattccagaacactgcatgcatataaagatcccaagatttacacttgcccatcgaggacccctgaaaaatggggaaacagtcagttgacaagaactatggcacatgcaagtgtctacctatcagttctaacattacatgctcagagatgaatttacaggtaacattagacatgatggagaggaggtttaaccaactatactgactatataagtcaataaatagaacagaaaattttcatttccaggaatagatggttaacatgttggatgcaacaaaccagtgatgaagcaataagaataaatatcttaaataattgcttctagattactagaggccctccaaatgccatagaacttgctcaacacaaatcagcaagcggacaatgaatcagaatgttaacttctataaaaaacaacgtcatcaagtgaaagtactcttagcagcaaagctaatgataaaacataaacttgtataatgcatcaatagccatcttttggagaaccaattgcacaggatcactcactttgacttgcagtctgcacattctctattctcaggcagccgcaggaggccttccaatatctggaaatcaaggacgagccataaacatggtaaataagacagggtacttcatgaacaatacctaatattgttgaggcttgagcgggtcatgaaaaaatcaaaatggtaacaatatgttgtagcaacgaagatagctaggttgcttgtacagttgactgcgaattgtttaactttttattgccacgattgagaaggatacctactataaaattacaaacaatttttcaaataacgatttccaccagtcgaacaattcacaaaatccatataatcaagcttaaattagcaaaagcgcccgctccccgattcataataacggcaaaacaaaggaagcgaattccgatctgcgccacgctcttcctaacgccacaaaaagagttgcaaagcaaccgcgcgcaattcaggagcggggagatcaggaacccacgaaatcgcggatcccaaatctccctcacctaacaacaaacgaaatcgcacgccgaatcgactctgccgtagctttccaacccaaatcgaaagggccagcctccgatccgaacaaatcgacatataacggaacgggaggatatacgaaccttcttgtgcttggcgttgagctccttggagacggaggccttctcgttcatggctgcgcgcgcccccgaaatccctcgaccccgaacggaaactcctcccgaatccgggggcaaaccaggcgccggaccaggattcgccgtctccggtggggggcctcgggatctcagcctcccttcctcccttcccccctctcctcctcctcctcctgatctcgccgcgtcgaggggaagagagagagagagatgggcagcgaggagaggggagggatctgtgcgtgcgtgccctccccggcttgaccttcctcgcttcgcttctcctcccctcctccctccgatttcctttccttttccttctatatttttttaattaattatttaaaacagtttgggtttttttaaaaaaataaatgtgtggtgtgataatgacggcgcgttgggtttgctggcctaaccaatgcagaccacgttttactggtgttttaacccgtgatattctttcgaccggagtagtgattagctgtaactaatattctcggtagccatccagcttgttctcaatttctatttgatggtgaaaggaattattaggatattgtgtatagttgctatgctgtcgaaatacctaatgtttgttttctgttcgtgactattgcaccaatataataaataataaatcatggtgctgtagtttttacaatacaacaacaaacataacatcactatgaaaattgcaaatgaatattgtgatcgcccgaaaagttttcaactgatcaaacaagcttcaaaacacaatacaatgacgtgattttttatcttatagtcccgtgtatgttttattcagtacaaaatagatgcttggctctttcaagttttttttgttcttatactcatcgtattcaataattaattgcacgtggttatttttggaggtcagataacaatataagttatgtacgttatccctcattatatgttctggaacaatataaaagaaaataaaggttgagataaatattatgaagatcttacatatattgatcgtttctaatataagaattttacaagatttttatgagattcattttatttttattataaaaagaaggcatgatctgtaaaggtttttgtcatgctttgttaatgtttaattgcgcttcaaaccgctgtacgtcccaaaatcaactattgtaaatatagtaaattttatcttatgtttttgttatcattcgttggcaaccactcaagatgaaaggagtaacttgagagaagagagtgaaaatgattgaagatgacaggaacatacagtagtccaaagtggggactccatcttgaattgtccaaagctgaaagcaattgatgaagtgtgacctggagtggtgtactattgccactctttgatcagccgcatgtaatcacccatggctttgttagtcaaccatccactatgtattcccctttccattttatttctaaccgacaagatagtggtaatgatttccctttatttttcccttttggtttatttggtcttccatgtaatgcataaatgcatttgattagttggaacccatgtcagtatgttgcttatgcatgattggtcaggtgcagtagttggtcctccatttgccttttttcttttgtttggcttcccattagttttggtttggtggacagctgtcggatacttggggttagaatttttctttttaagtttagaggcttatctcatcagagtgattgtcagaaactaacgatgataaattgacattaatccaaagtctgtgatgtcacgggctcaaacagtgtcactgctatgtttggtttcttattcctttcgctttgtgccgactgaaaactgaacattggattcggttcagttttcaggtgaagaaaagcacacatgattttcggacaggcccatctccgtacatattgaaaaatctgaaatgaaaccgatgcatcctcgcaagagcaattccgttttcacacatttgctttccttttttttccgtttatgtgctatggcctcaagtttcacatattctttgttctcttgaagctgctacggtgtcaaaagttttcttgccaatgccgtcgactacatcgtttactttatagctgataagcccagagaaaataaacaaaaaaaaattaaaataatttatgagtaaaacttgtatagaagtgttttcgtgacttaaaaagccaatgctagaaaaggaaaaagtacaccgaaggtccttcaacttgtcatcgagttataaaatcgttcttggaccgcaaaactagatacaacgcattcctcaacttacaaaaccaatacaaactaggtccctcggcagttttgactccggttttatccgacatagcaactgactcagtgtgggactcacgtgggccccacacgtcaacctcttcttcccctcccatctccacctttctttctctctcctctcctttctcttctctatattgaccacaacccgctcgtcatgccgcccaaggaggtggtggccggcggcgttgccgctgtcaaggggtacatggccaggtggtggcgcgacgcccgcgccgaggcagcgccatcgccgagagccccaaggtgtcgacgcccaaggagtggctggtgtgcagcgtgttgtcgctgggcagctaggtgtctgacgtcacgaggtacggcatcgggcaggcggcagaggaaggaattgcgcgggcggcgggcggcgggcggcaggggaggagcggcatgcgggcggcaggggagcaattgggcaaggggatagcgcggcgagctgttgcctatggtgaggacgccgttgaggtcggagggtggcacggaggacagcggagacggggtgcaaaggacggcgagcaggttggagggatggcgcggtggcagcggatgtagcgagggacgacagcacgaagatggaggagacggggaagaggaagaggtggtgcgcgacctcctcctcctcctcctcctggaacccatcgccatcgtcgttgtcgttcgccaccgctctgcttcgcgccgttggcttcgcgcgccatcgcctcgtaggcctgcctgctccgcccgcgaccgccccgctccgcgccgccggcttcgcgcgctgccgctttgcccactgtcgccccacttcgcctacctgctctacccgccaccaccccgctggcttcgtgccccgtcattttactccgcctggcttctccgctcgttgccacctcgctctaccccgtccactgtctccccattccacctgccttctccgcctaccgttgccccactccatcccaccggcttcgtgacgcggatagatcagagaagagaggggatgagagaggagagcgagagaanaaagaanaggtggagaggggnaggggaagaagcaggctaacttnngtgggnacactagggncccacgtgggtcccacgttgagtcagctgctacgtcagacaaaactggagtcaaaaccgtcgagagacctaatttgcactggttttgtaagttgggagatacgttgtatctggttttgcggttcaaggatgattttgtaactcgatgacaagttgagggacctttggtgcactttttccgcttgaaaataaaatacggggaaaaagtacaccgaaggtccctcaacttgtcatcgagttataaaatcatcccccaaccgtaaaaccagatattgggcgtcccttaactaatcaaaaccggtcacaataggtccttgtcacgccggctcaaggacaagaccagctcaagaagtctaacagagagaggcagccctcgagaaggttccctgcaaacgagtggacccggtaactgtcacggggccactgttagagagtgagtgagaccttgtagtgctgtgctatttgtaaaatcaaaggtgtttttgatgattattctgtgatgaacaattgggcatcggagattattggttttgttatttggaatttattcacgaagtggttttggagatgattggatttcacaggtgatcgcaggattcattatttcatgtgaccggtcagaccgggctctggtagccggtcggaccagcggtatgcgcgcggtcagaccagccagcccacggtctgaccggccgacactgtgtcggtttcggtttcgggttgtttgtttggatatccgtgattatttcatgattatgacttctagatggatactatacatatgtaatactgttgtttgctactaatgagtcaagttggagatagcttggtctcggaatatggtttctttgtttgttccatgtgtaggtgactcgatgtctcgggagagtatttgcggtgatggaccgggagtcggcttggggataagacgacgtctgtggtgatcagagatcatgcgggatacttaggctagagttgatgcacgtggttgatggagattccatatggcatacgatgaagttattgtgtgcgtatgggatgtggagtcaaatttggaaggagtccaaatttggtacgattggttatgtaatgtttctttcttctactagagggtttcctaaggtgtttaggactcttagtatgagtttggttcgtggctttaggctgcctacctcatgtataaatagagggggagcgtgaggcttcccggtatcgcttttgagagcaattgagttgagttttgagttagagtttcgagtttagtcgaaatttttgtaaggagtgctgttggtgcactttgtaaacatagagagaagtaataaagtcgtcatccactttaagagttcttcgatttgtgtttcactgggtttcggcggtctaaccggcaacgcaccggcggtcagaccggcggcatcgcggcggtctgaccggcgggcacacgacggtcagactggcggtgacaggagtcgacagcaggcgttctcggcggttcgaccgatcaatctacatcggtcagaccgacgttcatcaagcggtcagaccgacagatcaatctcggtctgaccgcgatccatcgatttcgagggtaacttttatttccgctaaaagttttcggtttttgggtataccaaccattcatcccccctctggttggcttagttcttgtgattcgatcctacactatttaggtcggcaggagagagagagattaactttggagcaatgtacaaacaactttctccaaaatcaattccaatctctcctcctcttactctgaaactctctgttctttctctctgttcttcctctcgactccgttctatctcttccgctatctccaaatctctccaaaacaattgaatcgcagttgagaaaatcgagttcgtgacaatttggtatcagagcaaccaatcctggagaaaccacgctacacatcccggctgcaacttcaagtggaggcgatggagaagcaaaacgtggatttcagcaaggtgcttgtcgagatccaggagtcgatgttggcgctgaatcgagcacaaggcaagacgcaggccaccgtcatcaagatagatcaaggtgtgaataattggaggccacaagtggaggaagtgatgcaggaactgcgcgaggaggttggcgagctccgccagaaagtggacttcctcggcaagacgaagatggcttctccattggcatcttcccctcgagttccgttgacggacgaggaaaggaaggcgccgctgctttcccacacctccgtcgccgacgaagttgatgaccgcggcggaagaagcagagaagtgggcctatggccaccgctttgcacaacatcaccggggtagggcatcagggatggtcaccaccctgatcccaactccgggcaagggtaagttcgaagttactcctgtttcaatgaattctctgggaaattttgattcgggaggtgggaaatttgatggggatcctgatgagagacagtataatcaccgtgtgcctaagttagattttccaaaatttgatggttcggatccacaggattggcgtatgcgttgtgagcactactttgatgtgaacaacacatatccaggtctatgggttcgagtcgccaccatttacttcataggacgagcagcatcatggttgagatcttctagagctcatgtgaggtatcctgtttgggaagagtttagtgccactatgtccagtaaatttgataaggaccaacatgatttactcattagacaaatggatcaaattaggcagacaggaacagtttgggagttttatgagcatttgatgagttgatgaatcagctgttggcttatgatcctgaggttaatatgcgatacttgattcatcgttttactgagggattacatagagaaatcagaaatgctgttttgcttcatcgtcctcgcgatctcgagactgctctggctattgcgtctttacaggaagaggtgctggaggtggtcccggagtctaatcacagtaaaccctttcggcgctcggatggtggagtgcaaccgaaaaacagttctgctttcaagggagcatttccacttcctttacctccaggatcaggaggtgtgcgtgctgatgataagaaacatcaggatggccaacgtgctacaggactattgacaagatgtcatctattaaggctcatcgtcgggctcaagggttatgttacatttgtgccgaaaaatggtcacctgctcacaaatgtgccaccactgtgcaattgcacgcagtacaggagttgttttccttgttgcaagatggtgaacaatcttctttgatggattctaaaaatttagaggagcaatctggtccgtcagttatggctgtgtctgttcaagcaattgtggggtctgaatctggtggaaccatgcgcttgttggggtgggttcaaggttttgaagtactcatcttagtggattcaggcagttcaaccagttttgtca

SEQ ID NO: 46902 - DNA, 6640 bp, Oryza sativa
gatgaattgttgtatgaactcaatggaacgcagtggttcactaagcttgatttacgctctggttaccaccaaattcgtatgcaagtgcaagatgaacataagacagctttcaagacacataatgaacactatgaattttgtgtgattccttttggtttaaccagtgcaccagccacttttcagggcgtcatgaacagcattctgcacccttggcttcgccgctttgtgttagtctttgtggatgacattttgatttatagttctactcttgaggagcatattcaacacttgagaactgtgttccaggttttgcttaagcatcagctcaaggtgaaacgtagcaagtgttcttttggccagcaacgccttgcttacttgggccatattatttctcctaatggtgtgtccactgatgaggataaaattcaggctgtcagggattggccagttcctacctcagtcaaagaattgcacttcttaggattagctggctactatcgcaaatttgtaagacattatggaatcatcagtaagcctttaactaatttgttgagaaaggggcagctctttgtatgaacagttgactctgaaactgcatttcagtcattaaagcagctcttatctcagctcctgtcttggccatgcctaatttcaatctaccttttgtggtggaaacggatgcatctgacaaaggaattggtgcagtcctaatgcaacagaatcacccggtggcttttctcagtcgagctttgggatctcgtcatcaaggcttgtccacctatgaaaaggagagtttggctataattcttgccattgagcactggagctcttacttacaacatgctgaatttttcattaagacagatcatcggagtctatccttcttagatgatcagagacttactacaccgtggcaacataaggctcttaccaagcttttgggtttacgttacaagatcatttacaggaagggtgttgataatcgggcggccgatgctctgtctaggtgccaatcttctgacaccattgttttatctgctctgtccgtggccattccagcatggatgcaggaggtaagggatggttatgttcaggatcccgattctcgcagtaaagttcagactcttagtatcagcgctcatgatgtgcctgattacactctgaaggatggcatactgtatttcaagcagcgtatgtggattggtcataatatttcccttcagcagaagatcttagccaatcttcatactgctgcagtgggtggtcactctggtattcacgttaattatcagcatattaagcaactgtttgcttggccagggttgcgctcgagtgtggtccaatttgtgcaagcctgttcgatctgtcaaaaggcgaaatctgaacatgtcaaatatcctggtatgttgcaacctttactagtgcctgaacatgcttggcaagtggtctcgttggactttattgaaggtttaccacgctcatcttcgtttaactgcattttggtggtcgttgacaaattttccaaatacagccactttgtgcctttgtctcatcctttcacggccttggacgtcactgaagcctatatgcaattcattcatcgtctgcacggattgcctcagtcccttatctccgatcgtgatcgcattttcactagcacattgtggacaactctgtttcgtttggctggtacacagttgcgcatgagttcatcttatcaccctcaaacggatggacagacggaacgtgtcaaccagtgtttggaaacctttcttcgctgctttgttcacgcctgtccctctcagtggagtagatggttggctctcgcagagtactggtacaatacttcattccattctgctttgggcacaactccgtttgaggtattatatggtcataagcctcgctattttgggttgtcagctactgcagcttgtcagtcttctgagcttcaggagtggctacatgaacgcgagaaaatgcaagtactgatttgtgagcatttgttgcgcgctcaatccaggatgaaatttcaggctgatcatcaccggtcggagcgctcttttgctgtgggcgactgggtttctctcaaactacaacccttcgtccagcaatcggtagtgacccgcacaaatcgcaaactttcgtttcgcttttatggtccttttcaggttctagctcgtgtgggagaggtggcttatcgcttggatttaccagcgtcaagtctgattcatcctgtcattcacgtttctcaactgaagaaagcgctggcacctactgaaacggttcaacttgttttgcctgtacttcatccgacaactgatgctgaagctgaacctgctcacattttggatcgtcgcattattcgcaatggctctaagatggttgaacaagtgttgattcagtggtctggggaagaaccaacagctgttacttgggaaaatctgcaagaactgcgccatcgttttcctcaccatgaagcttggggacaagcttcgtttcaaggaagggggaatgtcacgccggctcaaggacaagaccagctcaggaagtctaacagagagaggcagccctcgagaaggttccctgcaagcgagtggacctggtaactgtcacggggccactgtcagagagtgagtgagaccttgtagtgatgtgctatttaggtcggcgggagagagagagagagagagagattaactttggagcaatgtacaaacaactttcccccaaaatcaattccaatctctcctccagttactctgaaactctctgttcttcctctccgttcttcctctcgattccgttctatctcttccgctatctccaaatctctccaaaacgattgaatcgcagttgagaaaatcgagttcgtgacagtccttcggtggttttggccccggttttgtcctacgtggcagctgagtcagcgtgggacccaggtgggccccacatgtcaggatgccacgtcaatctctctcccttcctcctctctctcttctcttctcctcacccgacgccacgagaagggcagcgccgcgacggtggccggtggcggtgatggcagcatggcggcggagaagcagcgcacgggcggctagggagcatatgagggaagaggtggtgcgcgtcctccccctcaaatccaccgtcgtcgtcttcggcggcggcgaccgccatggcggtgggaagcagatggggaagctggagcggcgaccgcggcgggagtggagctcggtggaggaggcacgatgatgacggcggagggagttggggcgccgaagctgtggagatcggcggcgacggcgcattgtcgccccactctacccgccgatagtcgccccactctgcccgtcggctccgcccaccactgtcgcgctccgtgccaccgacttcgcgcgctgccactccgcctcgtcatcaccccactccacccgctgccgctccacctcggggtcgccccactccgctcgccaccgagcacgcgcgcccgaggatggaggggagggtctcgacgccgaggtgccctatcgtcctcgctctcccctcgcagtgttcctgccgccgacgccctctccttctcccgcctcgccgctactgccatccctgcgtcaccggccgctagctcctcctctcggcgtggcagaagggagaatccgacctcggcgcggcggcctcccctccagcgtcacagcctccacgtcgccgcctcgtgttaacgaccaaatttggtaatatcagtatcggagaagaagattagatcgaagcggaatcaaagatgaggattgtcgcggaaacagagtaagaatcggctggagtccgaattggctacgatcgagatcggctaagtccgagtcagactgggttaggtgatacagccgattccgacaatacgacttggtgtacgacattgggtcgagttgatatgcttcaagatgattgccacgcatggatagagtcctgagaatgcaattgtatctattagttaggatgttttatgtaaattccttagagatatgtttgggaaaaagtctgccgcaaagacttatggtatcttagagtttgttagggataagagtcatgtccgatatggacatgttgtgtaattctcgggtataaatagaccccgagccctatgtaatcaatttaacacacacgttcaatacaatctcgacgcatcgccatcctttttgctttagttttatttcgacgagttcttgctttcaggttgagctgcatcggtttcgatcttcaacaagaggtaaaacttgttatgacggcttacgttctcgggattagtgcttccatctttatgatactctaatcttgtttatgtaattcgtcgagttatcatatatcttatataatctctgacaatatcgctatctaacctacaatcggctaacatctatcaatagagggcagccgattaggttaaatatcgatgttggcttagattatatatgatatccaccactctatgaaacttccaatggcttgattgtctagatattgtccttctttttatacttatagctgcatcaattgagtttgatcttatgagtcgtgattagaatctcaatctctagcctgcttcttggttgccgattagggtagtatcggggtttcagccggtcttacctggtttaactatatttgttttatatgctttactgacatattaaatctgccctttatgttaagatcttgccgcatttaagtatattaggctctttgtttggtatatcctatttgcgttgatatcttaatatagagcggtatcgaagtattagccggtacatgctagatctctctgatcggctatgctatgaatatatatagtcttgttgttagtatatattttgatctaagtgatttatactgtctcggcatggcaaccgatctatcccaatcacttgatttaagtatatatcaatataaggattatatattgttaatatctacagccgatcgaatagatttagttctttattatctatttataactgccgatcgatacatatttaacatcggctcaaagataaatgatatgtcatcggcacctagccgatcgactatcatttatggatttaaccacagtttttttgtctttatttcttgttgattgcaggatcaaatcaactggcacgctagcatacccgaaggcgagttttggatctgcactggagttaagcagacctcccagggctcgtgtttttcatcaacacctcatcacccgccgcctcctcctctcctgcctcaccccggcgacctttccccacccatcggccagcttgctgcttacacataaggagaaaagtgagattgagaaggagggagaggaaagggaagagagagggtgctgacatggcatcttgacatgtaggtcccacgctgagccagccgccatgtcggacaaaaccggggataaaactgccgagggacctagtttgtatggttttgtaagttggaggatgcgttgtatccggtttcgtggttggaggacgattttgtaattcgatgacaagttgagggatcttcggtgtactttttcctaaaatacggtgagaaaaacttgcatgcggcctataatagttgggcctcaacgggaatgcgggctacgtgcggcccatattagttgggccgagagctagaatgcggcccatattaagtggtgttgcgcattgctgctttcacagttcgcaccatccggcggaggaagatggaggcgcaggcgacccaccggcgagccggagaccgcggcggcggtggcgacggcgggagctcctccgcctccatcgccaagcacctcgcaaaccagagccaggtacctcgtgagcacgcgcccgcctttccctctccatcagatcgtttgctgcttgctgccccggaggttctgtgatgctgccgattcctgcacacgtttggctcaaattctccacgaattcgtggcttctcctctcggattttcgcccatactcatcgcaagaatcaagcgcgcgtagccaatcgcaccatcgcggttacagttcagcgattgcctcctcgattgcggctgcggctgctcttttgcgctgctagatccacctgaaccatgccggctcacagtgttctgcagaaacctgagaatgcgtgctggcatgctcgatttcgttgtctggctctgatttctggaaggctctgattgcaactgtacatctcagtatcttggctgctctcgtcatgtgttgtcgcgtttcctgctcaggtcttgaagtggctgcaagatttctctgataaggtggaggagagagctaaaggagccgctgcagaagtcaatgtgttgttagatgaggctggggcgctggagctggatatgaagaccgcgatgatctccttcaacaacctgacccgccaaaggttcattgaacatgcaagtagtggttccaaatctgtatattgcacttgtctttggatgcctctagtctagaaagttatgcttgctttgtgattgatttgtttatatcagatgacaatatacttaacttttggctgtagtacacccttctatggtcaagtgtcgtatacttgttttgattacttttgtaaaagacataaatttcaaatttacataaattcaaatttatgatatctcctcatt

SEQ ID NO: 46903 - DNA, 10909 bp, Oryza sativa
ccttacttgcagttcttgatgaaatatttacccccccccccccctcaaacttttccctgcaaattaatgccataatttgtcattactaaaattttgttgcggaggcttgtttaggttgatgccaactagttccagtttttagctgccaaatattatctgaatctttattatttttcttccaaaattctgtcaagattcccatccttttggcacattatggtaaattcattttcttgccgaaacacttccaattttcagcgacctattagatgaccaaattttggaacacattgccaatgcaatttttaccaccaaccctccccctggtcacccagatttcagaagcaaattaactaaaaagcttgctgtgaagtaaatattgccaatgtttttccagcaaactaattatatgccaaaactgacaaaccaaattttggtagttctgtttggtaactgcagctggcattatttcagaaattctatagttcacaagcgtttgttctatggtagcatttccaaattatctttgttgcttgactcttgaaggctatgtctgcatatggccctcttccacatataattggttctgaagagtacattcatgataacagctgtggtctggcaggtataagtattattcaattgtttttctttggaaacaattttatactttgtgaatatactcatgtgagcttttcaattttgtttcaaatagatgatatgcagcctctaagtgatgacttcagttggttgcgggagtttcaaagtgagtcttcagactcacggactgctgatatctctgagtctcaaattttcggggctcagcgaggttatgagaaggtacagtgtatttatagtttgcggcaagaatgatgtgttctggtactgatttgtttgctgtttcatatggagtttgtttaaactctaatcaatatatagtactcctagttgacgttgacactaatagtcttccagaccattaatcatgtgtgcgtgtttcaatccagggggaaactgactctgtggtttctgctgcacgagaattcaaggcaatgctggaggctgcacttgttaatccctataagttctgtatgtgattctttccctacttccgtcctaattttgacatcttataatacctgtatagtgtgttaactataatcttcttcatttattatgctttgtcctctctttgaaaagttatctttctttcttagtccaatttagatgtagtttttttataaaaaaaaatccgttatgattttccttttcattgattttagtagaccgtgcttttcacagatgatgatgcaactattacagcgcaagatgcttctgtagagaagaagataagcacaagtgaggtacagcataacctttctgtggcattgtagtttggactatgggtatcttcaaccgatatttctgtctggctaaaagttgtgtcataaccctgagtccctgatgacttgttcacatgactcacatctggagtcctactcccaaaacatcaaaaaaaaaaaaaaaacttgcatgtgttaattcttctctcatcttttaaatttccctttagttgtaagatttcatacgaagctcaacatgtttctaattgtgagctcttgcttttgattgttcactctggtccagtggatgtgtttttttttgtccaaaagtatatgctgatattgctatttggggaatatgataccaataaaaggagatatttccctcattccaaatttccagttttaaataatttatgaccctaacaaagttgccttgtgatgattctaggaccaagttatgctgacagggacaagtgaagcaccgagtggaagatcagcacaagaagataactctgaacagacaggactttttgcaagcttgcaaagcgcagatgccaatcctcatgacatctattctgctttggttagagaaggcctgtttgatactggtgatgagattctgtctatggatagaggggagtctgctgatactcctatttcaggcctagcgtcaggtttagcaaatcttggcactgctgatccagctgaaaggggctactcaataaacgagactacaaatgaggagggatacttgattgaaggggatgatccatcaccatcaaacaaagacgaacaagatgaccaaactgatgcacatggtgtgtcttcgccagagccagaagatggtgtttctagaccatcctagccatgctgatattggttgatttcttctcgagtgcagttcattctgtcaaaatctactgtagacgctggtgaagcaactgaatggcaatgatttagacgaggaacacacttttgctgccatgtgctgagtgctgtagactaagaaattatatactccctttgtttcaggttataagacgttttgatttttggtcaaagtcaggacaaatttgtagaaaaaaatagtaacattttcaagccaggacaaatttattatgaaaatatatttaattattgatttgatgaaactaatttagtattataaatattactatatttgtctataaactttgaaatagtttgactttgaaacggagggagtaccgttgctccagtgtatcaaaacaacgcattgaaaacataccattacgatttaattccatcactagcgcaacttattattgacgccgcgcttattagctcttttttctccctgatgaggatcaataattcgttacctcatgctgaaatctgcactgtagaatacctaagaccgacgtcgaggtctcgaggatgaagaatttggcacgccaaaaccatcctaagatcgagaggctgtgactgtgcctggtggcatattcaagatgtgatcaggttgatgaagacagcattgcacagaaatgtctcgattgaatcaatgagcacgatcattggcgtgttttgcacgaatgaccaaaacagagacgatgatcggacgaagagatgaaacgaatgcaactcttatcgatcaagacatcggcaccgttactaccaaaggttcttttataggaaaagtattggtggagaccgggtgtcttataaccggccttatctacagcctcgccccggatgaatgccaaaaccatcctatgagcgagaggatcagattgatgaagacactaccattgacgtgttttgcatgaacgaccaaaacagaaaagatgatcggacgaagagattaaactaatgacactagcccattcttttctccaacaagagctggataaagattaagatttttatggcacgctttttaaactgttaaacggtgtgtttcgtgtgaaaattttttatatgaaagttactctaaaatatcatattaatatatttttcaagtttgtaataattaaaactcaatcaattatacgttaataataccatctcgttttgcgtaaaaaaacttattctttattttcatcttaagaaaaaaaaaacatcacaaagatgaccagaagtagccctcgggcgtgcctagttgtctctctctctccccctctctgtcgaacactatgccagaatatgaccagtggaacgaacacaaggtgtttggtgctgtcaagtggcagcatttctgatagtgttgattgcaaatgtaaaggatacgttagcgggggctttaaccacgactccaactttggatttgtttggagagcttaagattttaagaaactactgattggcagtgtcggtgacatgggaccgggagtatcatgacttagagacttgaggcagacacgatcacccacgtggcctaaccccctcgggggggtcgggcccgagggtgatacggccgcccttctctttgtctccccgaggggtcggaccgctcccgtctcggccccgagggccaaggcgccccgaccccttgtgggttttgcgccgcgtatatagggtaggtgagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggagtggaggtaggtatgggccgtcccatcagaagggtcactcgggcagcagctgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggagaagtggtgcatgtggtatccccttgagatataaaaggaggaccttgcccacttaagaggcggggctggaaggggggatgatctggagagtagatcccacgagaggaaaaaagggagaagagggtttttagagtaagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcaggcagatattttataagaatatggagaagtttcgtttcttagattatggcttctagttagtttttgaattttataactacaatttatcaggatttggatgaaaagctaaattgtttggaaattttgggagaaactggagctaccatagactccccaaacaaaaccctttgtgcgccacgatcggttcgcagcgtgtgccatcccacgcgctcggttcacacaccacgcagggaggctctggctcttcatgcgattctaacaaacctaacaaaccttatctaaaagagaaaaaacgaaataaagaaagagaaataccgaaaatactggtttgacacgcaccaggattttctaaaaaaaaaatccaacagtatcgatctaagacatcgtcaccgttattataagaggcatttgtaaatttgttatcgattttttcaatattgtaaggatgccactcgaatgatagttttagtagtatttttacaattttttagtggcagtcttataataacgattcaaaatagtggcaaatttgcaattgcccgttcttttatacgcagagactccgagagtcagtgcaagcaagcaggagctcgtcactgtcaattgacaaaattcagtagcaaatcctactctgtctgcatcaatggctggcccaaccatcgtcctcctcccggcctggggatccggccacttcatgtccgcgctggaagccggcaagcggctgctcgtcgccggcgggggcgccgtctccctcaccgtgctcgtcatgcaggcgccgacggagatagaggcgtcggtggtcgaggcccacgtgcgccgggaggcggcttccgggctcgacgtcaccttccggcggctccccgccgtcgagcaccccaccggctgcgaggcgaccgaggagttcatgtcccggtacgtcgagcgccacgcgcaccacgtcaaggcggccatcgccggcttggcgtcccccgtggccgcggtcgtcgtggacctcttcttcacgcccctgctcgacgcggcgcacgagctctcgctcccggcgtacgtgtacttcgcctccaccgccgcgttcctcgcgctcatgctgcggctgccggagctccgggacgacctgaccgtcgggttcgacggcatggagggaaccgtggacgtgcccgggctgccgccggtgccgccgtcgtacatgccggtgtgcctcgtgagcaagacggtgaagaactacgactggttcgagtaccacggccgccgcttcacggaggcgaagggcatcatcgtgaactcctccgttgagctcgagggcgcggtcctcgccgcgatcgcggacggccgccgccccgctccggcgatccacgcgatcgggccggtgatctggttcgacgccacgctgccgcccgagcagccgcacgagtgcgtgcggtggctcgacgcgcagccggcggcgtcggtggtgttcctctgcttcgggagcatcggcttcctcgacgcggcgcaggtgagggagctcgccgcgggcctggagcgcagcggccaccgcttcctgtgggtcctgcgcggcgcgcccgccggcggcgtgcggtacccgacggacgcggacccgggcgagctgctcccggaggggttcctggaggcgaccgccgggagagggatggtgtggccgaggtgggcgccgcagaaggacatcctgggacacgccgccgtgggcgggttcgtgacgcactgcggctggaactcggtgctggagagcctgtggttcggcgtgccgatggcgacatggccgctctacggcgagcagcacctcaacgcgttcgaggccgtggcctccatgggcgtcgcggtcgagctgaggaggacgacggcgaaggacggcgacgcggcgagatcgctcgtggaggcggcggaggtggagcgcgcggtgaggaggctgatggcgccgcagggcggcgggtcgtcggaggcgagggagaaggccgcggaggtgagcgcggcgtgcaggaaggccgtggaggagggcgggtcgtcgcacgcggcgctgcaacggctcgtgcgtgagatcgttcgtgtcgtggcaggccacactaggccggaatagctggctggttgcggttggttggcccatctcacacggtactcggcccagtctagacgagaaaattatactagaaaccaagacgtcaaccacgtgatgcggcttaagggtgtgtttgattcgtggtagggtatagccatccctacccctatgagcaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggacgtttcgctgtcgacaagtacgtcacctaccactgactgaaagcacaacgtcgcgcttcgctgtcgacgggtacgtcacctaccactgaaagcacaacgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggagagattgaagtcaccacagacgtttcgctgtcgacaagtacgtcacctaccactgactgaaagcacaacgtcgcgcttcgctgtcgacgggtacgtcacctaccactgaaagcacaacgccgttaaatcctggaaaattcgctcccacagggagttgaacccaggacctcatgtactactgaggctcttgtaaccactaggctacaagccctttcacgggtatagccatttatatttgtaggaatatggtggttctgtttgttttatggatatatgaccatccggataggaacggatagagtaaaatcaataacatattaatcaatgataaatatgttaattatcatcaatatagtcatatctatactaattaacaataaaatggactaattatataatcaacactaattttgacaagtcaattactccatacgcttcaaaatataagaaatctataactggatgagatattaatcatttactaatgattaagattaccaaatgtggatatcctcatccggtcaatttaacccactcatctagtatcttcgtgaaacattttctctttagaccacccaatccattcttacccatcaaccaaacatatttaaaaactggatcgtcatatcccatttagtgatatcactctaaccaaacacaccgttaccttcctcccacccttaacccccatcgcattagaagctgagaagtagctggttgatagctattccctccgtcttataacatagtaatccaaaactgaataagacatttcatattagaacaaatctggataggatggtatttagattcgttatactatgaaatgttccatccgattatagattattatattatgggacggatggactaacttttgagaatctggaaaagttgaaaaactagaaaggctaggtttccaaatttttatctttatttattttctatattctataactacaacttcttaaatctaacttaaaaatttatattatcttaaaatataacttaaaaatttatattgtttaagggagctaaagatttaaataaaagctatagcggttaaaaactcatcaaacagagatactcctagttagcaaaggagggtggcatttcggcttgggaggcccatcgacctcatatctccggcgaaacggtataagccaacaaggcaacaatgtactactacacgtcaagcgaggacggtgactttcgtggaggtagaggactctgtctgaactgttttcattgaagaaacggaattgaatacaggccaagtgcgcaggtacaccatagtcacctattgatatatatacgtacagagaaaatgaactacacgtctatctacacttcaaccgtctctcaactcacatcagtaatttaatttccggtttatcccaccgcatatccgtttgttgacatttttccatcactacttattaagtgcgaaatatgatgactgctcgctgtaaactgcaaggaccatttaacaggcttagctggagcaggatgaactcagttgctcgttttgctcatttctcatttccttctatttaattttattacctgtaatttttctcatttttcactgaaattttagtgagtccttcaaaaattaaataaaaaaacagaaaaaccagctggagtcgaggagtggtcgctgcatgtttgtgtgcagtgggccaacgaaattaaaccaaggttttctggtaatgaaggtccacatcaaactatcctctcgcatggcacagttaatgctaccaacgggtggtcgggtacagaatttaaatgctgtgtgctttaagccaaatgtagagaaaaatgggtctttatttatttcgaaatatctcatggccagccgctctcaatggtgtgactaatcacgttcaagccatgatatgatggatcaaggcgagacaagaaaaatgtatgagcagtcatgcgagcaaaagtagtagtactgatgagtgatgccccttcaaatatcataacctccctgatcttttctataattctattagaagaaataattaaaagatcgatcacacataggctctgctaatgaaaccggtaacaaaaatttaatcaacttcctctcttcatctccagcatatgtacaacatactacatgcacagggattacaagctgcatgcaaagcttagcattttgcaagaaatcaacaaagccaattaattaatactcctccaatagtagtactagtagccaaggcccaacgcaacaagcacacctcgcagagagcacagagacgtacgcagcaagtaggtcgcctcctcctctctctctctccggccatcaccgccggcggccggcgatcgtaggtagcgtagagctagctggcgtagagcctgtagtggcggtaggacttgagcatggcgccgcagaaggtgcagatgatggcgcgccacgtggccctgtgcacggtgagcaggtagcagaagcgcgtcgccgtctccatgtccgccacgctcgcgcacccgccgcaccgcgagcagatccccgccgccggcttgctgctccggaccttcctcctctggtccaccaagaagcagaagaacaccatcctcctcgtctccggccggccggctcgccggaatctcaaataacacgatgtgtggagtggtggtctctgacggcggcggaggtggtggtggaggatggcgcaggggggttttaaggaggagagcatatggatcgcattgatggcggtggtagtgaggtagcgggtaggagaggagagaagggggtggaggtattaatggcatgtcggcttgatggctggacggctggaccatgatgcatgggcatggcgcgttgtatgccactcttgactcccggactccacttgtccggagtaatacaattacagttgttgtttgttaattttttttcttttgacttaatgtttagtacgagatagatcagaattgaacaccgccactccgccacctaaaaaaactgactggcaattctggatcttcgatcagccagaaataaactgtctgaatcttctttttttttttagaaaatttctgtctgaatctttgatcagcatgtttgtatatatgtgatgtggagaagtaggttacgatgtttctcatcagttttatactagcacatttaggcttcctttagaatggaggaatctggtgagaattttacgagttttgaaccgattcctgctaaactgtcgtaataaaatccctagtagtacattttaaatgagccgtcagtgtctttttattttccagaaacagcactagagcgactgagtggcagctataaacatcgtccagaaattaaaaacagggacagttaacacgt

SEQ ID NO: 46904 - DNA, 9367 bp, Oryza sativa
gatttcacacgaaagcgcctcgtgaagcaagcaaaatatgggtagagagagccttccctgctaagcaagcgagcagtcgatcgagcaatatattcatttgaccgatcactaacttctctttcgaagtaaatgatgggtcactaactaactgtctaactgtatagtaccatttgtaattgcagatcgtttcagagtatgacaaaggcaatctccatcagaaaaggcgccaacggtctccttttttttattctttttgaaaaagagaaggcgccaggcaacggttcttttaccaattcttacaggtttctcttgtttcagccagggatcaccctggagcttggggaggaggaccacctcctttgatgttggatgggatcatcactccaatactcagcatgttcatcaagtttgatttgatcccaggggccagggctcacattaaacttggtgaccacttctacgcaatgataggtccatatgaacacactactcttacggtcttgcccctcaagcggtcgattagttgggttgccgtaaatgaagtaccctttgaaaaatgtaattcacatagatgatggaataagataattcttatacggtctctaatagagtatttataaatatcaagttttacatgacatacaaatatggtacctcccgaaaacgataaaattacctatggaatcataatgaaagtcaaaattatacgttttcttactacttacttttttagtaatggaggaatgtacgtagtctgtctctgttcttactgtttagtgtactgctggtggaatcgaacattaaaaaataaaaacaccaatgctaatgatcttatataaaaaaacatctttttgaaccaaaaaaatgctaagaaaatatcatttccatcacattttgcatcccaatagcatgggacggaaacatatactctaactttaaatgattgacatgtgagcctcacagctcgtaggctcataggttaacgacacatgtcggagaactgtatgttagaggagcttcttcggtatgagatggcattttcctcctcaccgcttctttaatttcattttcatacacttttgtttttactacaacattcaactattgtataatcccaaatttaaaacagcgttcttaattaagcttatccaaacctttggatattagctagagaagaattatggtatggagagaagctagagagttcaaagaaccaggtgactagtcgttgtctttagtaaaggtggttctggcatctctagatgttcttccaggttttgactgccttctgttgcgtgaaaaatatactggtgcttatgtatacagtacataactataagtatatcttcttcaaatcttaatacaatcggttgtccgtttcttcggccaacccggccaaaaaaactagagaataattaattaattttcaataactagaaaaggatccataatatttaacaagcaataatgaattttatacattaaataaaatatataaataaatggatataacttttattgggttctatatatttgctcacaagtcacaactgctctctgtaattttggtcttcatttcatttatttattttagctgcttagaaggcatgacgagacataactacatagggtattgattattaaacttgtctgaaatgttatggcaccaaaagtagctgtaagagttgttgcggcgatttaagatgtgaaacgtgtgatgtcattagctttcttataagagtgtgttaattttcggtagtaaatcatggctgtcacatttgtgatgttatgttacgtacaggtcagctaccgcaataccgcaaataggatgaagcaaatgaatgattagcacacccaccatcgtccttttttcatcctactagccaagaaccaagagaaaaaaaaacaatgagttttagtattaattcgattaaacatatatttaagttaaatagtttttttatgattttccttattgaataaataggtgattttataatttaagaagaatcaacagtgaatcagccaggagatgaccgttgaagggtgtgggttgattaatggaatctatttgcctactccctccgtcccaaaatataagaatgtttttatattttgggatggaggaagtagtcagtggtgtaatataatactccctctggttctatattaattgacgttttggataagattaaggttaaacttttataactttgaccatcaataacattaaaaatatttagtttaaagaaactagaaaaacatatatagatttgtctttcaaaacactataataaaagtaaacatgcatttatttattgtatatattataatagaaaaataaggtcaaagatatatcttgtagagcgtgtcaatgtccaaagcgtcaattaaaatgaaactggagggaatattatataatactagtagggatggtgtggtagaaaaaccaccactacatatacatacagtatagaaattcttcattgtttacattattaaggactactcatacgtaccattcaatcttatcttcaaagtttccaacctcatgtatgccaagccaatccttgctccactacatggagtgcaaatgctacccaatgtatgtcaatcaataaagtgattaatgtagccatgtagggcaagtgatacaagtcatgaacagatcgatatttattgctttgctagttgctactgcaatatacatgctcaaatagtctttaattatcatcttgattcttttactatacctagcatatttcccaagaaattaaagaggggagctatgctggatgttgttgcccatgctgctggcagtataacttgggctgtgtttagttacacgctactaaaaatagaagtttaaagaaattggaacgatgtaacgaaaaaattagaagtttgtgtgtaggaaagttcgatgtgataaaaaaattaaaagtctaaagaaaaaaaagttggaatcgccttgagccatgactgcctccaaaatcggtgcttccttaactcggctgcattactccgtttggctgcattgctccgtttgtcacgctcgcactgattgtcttgtcgttgtagatcagtcagttaattaggaccacacgcaggcagcgcaattagagcaagtttaatagtataaccaactactagttacaattcaactatagtcagtctaatagctcgtccatacaatagttacatactgcactattaatacctggttccacctgtcatacacactgtgtcttggagtccgtgctacagctaggtataaatctgtagcccactgctctcttatttatcttcttaaaatatatttacagctgacttatagcctactattgtacctgctctgcctactcatcctcatatcctttccttccttcgactacagggaattagtagaagatgggtcggtctgacacgtaaacacgggtacattaagttttttggcccatgtagtatttgctgacaacgacaagttgccaatcctgccatcgatcggggcattgtacaaagtctcgaatactacaggaaaagtaagttccatgacatcgaggtttaaaagttcaaatttataccatcaacagagcagatcagagtacatttaaaacatttctgagaataaagcagtttaagcggcagcagcgacggcaaggaatcacggcgctgatcccccaacgccggcgaccggtcgattcctgaagccgccggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaatcatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgctcccatcaattccattgacccacggcccaggcaagcccactggcttagctagttagcttctccccaatcctgcagatcttctcgtcttcttcgacggttcaatccaacgcctggtggtctctcttcgtaggggttcgggacttgggaggtctgcgtcgtcgccgttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttcaccacgaacaccaaacacacgaattccaccactctaccaatataggttttagcattgcacgcggccactccatgatgcgcttattctacggtgactaacgaccagaaccgattgattgcagcccgacgtgcctgttgtcagtggcatcaacagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgactgaccaaccaacctaaggtttggttcttctgtcactgaatttttttgtggcaccgttgtacaattgctcaatgtcgattaaggtgtgattagctcataaaaccttgctttgattaagggcaaattaaactggatgattgagagagagaaaaaaaaaactcgtagggcatgtttggcatagtctccatcctttgtttggtttcacattgaattcccttcaaatctcacgaattaacagacctccctaggtaagagattggtgggaattggacccttaattctcccaaacactctcgaattttcaagtattccaaccaaactacaaacttatactctcgaaaataatactcccattttccatcaacaactccctccaatcaaacagactgatacggatactgatgcagggagtttttagagttattgtactttctagaagtgtggaacgaataaccattaaccaatacgaaaaatatcgtacttctagaagcgtggaatgaataaccagtatggaaaattgttttcatcattgaagaaatgttatttacatgtcagtcagataatcatcagaaaagtatccccatggtgtccgtagtctagtttaagataattttctccattacctactactcatagagtacaaccttacatagtagtttttagtgtaataacgggcgcacgggcgcgtgtctgcccgcaccgctgctaggggacacgcatgtaataacgggagccgtagagatcgcctcacccgacatgaattgattgatgagcccgcagagataatctcttatctgttcatcatcgtaaaattgaagttacgaattgggggagaaaaagatgggcctgtactttgacacctacttctcgtatgaccatgtccatgtaaagaagcaacgggaaagagagaaggagatgatggtattttcgtccaatacatacaaaatacgtatcttagtagcaccaatgaaattacaaacaaatagcagtggcatcgtttgaaatacgcaaaaagtaacagtatatttcaaaaccaataaaattttaatgatatagatctaattaatccattaataaatcatcacttacatagatgaaatttagttcagaaaaacaagtagtaagagagagaatcttccaatccctctcttccagaatgtgtggattattcagagaactgaacacacgtccagccaaatcccgaccaaaaaccatcatcaatcagccgatcctgatgttgtccctgccgcacacgagcgtggtggcccagttgaccgccacgtagaacctgttcctccagctcaccaccctcggcccagacacgcccattggctttagcttcttcccaatccaacgtctggtggtctctcggaggtctgcgtcgtcgccgttgttggtcggagcatcacctgggcggtgtttccctgtctgtcgagcatcacccatggcgcataaagaggtaagcctactactgtcttttcgcatgaatgtaaaaactcttagagaacttgtgtcaggattgggacgaccttaaagtgttcgatagaatgcccagtagaggggagtgggttataatctctcgagacgatagctccttattaccagagcaactagaggttggctgccttccactgctgtgctgtgtgttgcaatatttaatcaccaaacaagtactaataatctattgatttatctttgcacacaatatttaagtattcttgtttcttcgatattaaataggtagattattaatgataaatagattgttgtgagttcaaacatattagcaggtgctttggcttactatgcagtgtggtatggtaggggagcatattttagagggtatgcacataagggtacacatatgatctctttttttttttacgaaagccacctttggatgagcatagagtatagttgtgtgcgggttaccttgcctttaaggtgttcgttattttctatcagcacagagtatgaaactatcttaaggtgtacgttcccttcttgcctgttccgtgacgcacccatgcgcgaaggcgcgagctcagctcgtgaccacgacgccgtatcgcctcggcctagccagctcgcaagtcgcaaccgattccccatctccgcctctgctcatctccactcgcccgccgccggctcacctctcggcgacccggcctcagaaagcgtcggtggagcggggccgggggcccgtcaaccggcccatcaaacaagccgttggcaacaacgcgtacaggaagagggagaggtgtgggtgtgtgcagttaggtgcggcgccgccgccgggcggagtacatcacttcggcggcgctctcccggctaccgagcatcacccatggcacacaaaggggtaaccccgcagtttcctcccaagtacctcacatgtgggatttgattttgttgttgttgttgtgtcgaggcgttgagaagttgtgtcgatcttgggacgacctcaagatgttcgatggaatgctcagtagagccaatgatctgctgcttcggcgtacgcctacacaagcttcagcaacaacacatcactctaccgatatagatatcgactgtgcaagcggccaattcttgatgttttacagtgtaactttgactaacaattagaatggattgactgcagcccgacgcgcccggtgtcagtggcatcagcagcggcagcacggtgaagctcaaagacctcgccccggcggccaccaacaacgtgaacacgacgttcatcgtgctcgacaaggcggccagggcgccgccgccgccgccgcacggccgcgccgacgcgagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgaccccggcgaccccaggaggatggtgcaggaggccgtcgtctcgccgcactctcaggtcttcaagccgctgcagtgactgactgactgaccgaccaaccaacctaaggtttggttcttctgtcactgaatttttttgtggcaccgttgtacaattgctcaatgtcgattaaggtgtgattagctcataaaaccctgctttgattaagggcaaattaaactggatgattgagagagagaaaaaaaaaactcgtagggcatgtttggcatagtctccatcctttgtttggtttcacattgaattcccttcaaatctcacgaattaacagacctccctaggtaagagattggtgggaattggacccttaattctcccaaacactctcgaattttcaagtattccaaccaaactacagacttatactctcgaaaataatactcccattttccatcaacaactcctgaagccgccggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaaccatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttg

SEQ ID NO: 46905 - DNA, 1575 bp, Oryza sativa
aactcaaaagctaggcgctgctgcaagtcagactgcatggtggacatactccacatattattctgccgccactggcttgaaaattgcccggcaggaggtctccagctcttgacaaaattgtcttttctatcagctacattttgagccatatgcatggaagatgaccatatctgacttggtgcctgacaaacatgaggatcaaggtataatgataattaaaaagtacgaactacaaggtataatgataattaaaaagtacgaactacaaggtataatgataagtaaaaagtacgaactactcccaaagaaaacaaacccggttgcaaaagctgttgaattcaaaaaaaaaaaaatccatgcatagaagtagatgagaaacaccctttacatagttcactgaacagcttcaaagtaaatggcaagaaagatatatcaacagaacatcagctacataatacatcagactttccctaattaatgctgccaaccaagatagactgcaatttagttaatgatggatgtttctcagatttccatttcaatgagaaaaaaatagatgccagaaggtgacaataagtggaacacaagtgataaaacgaaccatccagtacttatgaagtttctgccaagcaatgcatgcaattttatcaatcaccaaccaaggatcaaaatacacatgaagggagcacaatactacataagacatctatcccccatattataccgtcaatccaattgttacagccaatattcacgcaacagtagcaacagccaccacaaacataccattgcagcatgcgacttgcgagcacacatgacgcactcgacccctccggcgtcgaggtgaacaaatgcatggaccgacacaatgcacccacagtgcagcctctgcaggataagaacagagatacaagggagggatcagccaggaagcacaaatcacgaacaccaccacaaggctcgaaagattagagaaacgagcatgcatggggcaccgtaccttcccgcaggattcgcagttcctccacccggcaacctccaaatggaaagtctcgcaaaagcccccatgctcgaacgagtgactgaaacagaacacaccatgcatggcatcaggagagctctctcggagtcgcacgcgagtcaaaccaccacgaggaaccccaaaaaaattttacagaaaacccccgcgtattccgcggaaattacaacgacgtggcgatcactccacgtagatccggtgggcgccataggcgaatccgcccgcgcgtggaggaggagaagagccggcctccccgcacgaatcgagcacgcgggggggcgccgccgattgcgcgcgggagggggaagggggagggaggcgattaagggggttacccgtacgtactagcatcggtcgcagagctcggcgaagtcgccgttgcggagtcgccatccgcggcggcgcgggccgtcggatttggggtccttgcagtgcgcgttgaagcagatcctgggccgctgctgcggcggcgcgtgaccgggggggccctgctgctgctgctgatgctgcggcgtcggcggcggcggcccaacccc

SEQ ID NO: 46906 - DNA, 722 bp, Oryza sativa
cctttgactaaagtgaattttggaattaaactcatgttggctaagcgtgtcatacaaccaaaattcacatgacagagtcgtgaatgccacacattagactcatcatcatcattgcttacatggttcacaactttattacacatatcatccaaggaaaagcggaacaagcctccgctgtcataaccttttccaataaacgttccatatttagatatgacacatttattggattcaaacacaagtctaaaaccatctctacacaatagagagccgctaactagattcttctttattgaagggacatgctgcatgttcttcagctgcacgatctttcccgaagtaaactctagatcgaccgtaccaacaccatgaatagccgcaagcgatccgtttcccatcaacaaggagaaacctctcccgacctgataagaagaaaacatggaaatgtcggcacacacatgaatattagcaccagtatcaacccaccaatcaggtgagtgacagacagagagaactgtaggtaaaaatttaccatacctcgatgttcctccgccctcactaataaccatgtttgcagacttcttgtccttgcgctcaggacaatccttagcccaatgcccagacttgccacacacaaagcaacctccttttgctttctcttgcctttcttcttaaaattggttgtagccttgggtttgacgtcaggtttgacttttttgttg

SEQ ID NO: 46907 - DNA, 12005 bp, Oryza sativa
gtgaaggttaccacataatgaatcttccatttgttatgaaggttacaacaaataaatctctcatttgttgtggatgttacaacacaatgaatctctcatttgttgtggaggttacaacacaatgaatctctcatttgttgtggaggttacaacacaatgaatttcatttgttaatggtgactttattctcatctgttacaaaacgaaagagcagcaggcaggctcggctcggtcggccgcctcgcctcgctacgcccacggccgaggccgactcggcatgcgcgcatgcgtgtggcagtccaaccatcacctcaaccggtcaacagggaatctctaatatcaccctatttaagttgaggttcttccacctaaattttcaaggcagtattattctctctaacattacttgtgggctcttgagattttagttgaattaaattgggacatatgagacaagaaagttcgcttcatttgatggcttttaacatgatttcacactttttcctatggttcgtccagatgagtacaggcctagcagtgacttccatgcatactcttttcatgtcatcctaccataccctctgatttggtcccgttagtggatacaagcctaggcgagattctcgctctcaggttcggtcctctacgagcggatacaaatcacggatacaaacataaattttgcataattcaccataaattaaacaagcacttgcttcggtcatgcttcatggcttcgagccatgctagtagtgatacaggcatagtgataaacaaaattaattgagcatactaattaattagcacgcacatttgctagttttgacatatgttcagccatatttctctaacaagaattaaaataaaatggcgtttattttctttccgtggtcagagataggaaatagatgtgcgcatgcatatattttctccttccatctattcatctacaaaatgttggataaatcacgaactacgccgagtcatgacggccggccataaaattaaccaacactcgcttcggttacacttcacggcttcgagccatgctagtagtaatacaagtggagtgaaaattataatctcaaaatcatctgcatacatatatttgcttaaaatagtgtatatatacttgttgcaccatatataaagtgcagtataaaaaataatctgatatacgcacatgcatgcatccatatactctggccgtgcattttccttccaattgcaaattaaccatgtacgcacgacaagtggcgacatcgtgatagtcgaccataaatcaaacaaatacccacttcggttacgcttgatggtataaggccatgctagtagtaatacaggtgtgccgcaccaaaatcccgtggcatgttgataataatggcgctaaaataaatactcgtttggttacgccccgcgagtgctcaggaaaattcatcaatttatatatgcgtgctacatataggaaaaaataaagtcacaatgccaaaaaaggaagctatgtataaatttgctaccatacacgcagtgatattaaaaaccaacaaattagtgggcatctaaaatacttggacgcccaaaatgaaataaacatataaatggaaatctacagaagattctacagctgcgacatctggagctttaggatagattttcctttttatccttttagcgctcatgtaattttattttctttcatgttggaattcctaatcaggggttttctctacggagatgtaattaacagaatttctatctaaatgtatgaattctggaagtaatggactcgcaatttctgatttttatttatttattgcatttaaattaaattgtctctaacgatttgcggataacggacctactataacgaccgtcccagttttcccatcgtcaattttctatatggatcatctatgtgatcctaatccatgcaagatttgggactaactatttgattgctcctgaactgatcttcagaaaatactctactgttaggtgttagattcagaaatgctgtcttttccggtttgttgaaattagttccaatttgaagaaatcatgtttgacttttagtgattgaattaatttagtggcagagaaattagaacaatagcctagttaactactttttctcaggaagtatttaggcccttcatcagtgtatttgcagaccttgctgaaacattcaggccatacctcctggaaggagaaaatgttgctgcgcagccttgctgccctcagatgttctttatacactgatgaagaacaaaaaaacatagagagcaaaaaaaaaagataaaattttgatagaattataacgttaaaactgttagatttttttcgacggataaaatataatgaatttgaggttaagattttacacgtaagtataatactattgaaagtacatgcattattttttctagattttttggtgatatttattagttggtatgtacggtgtatacaagtgagaacttgtgtggataggatatgtttccaacttgtttatgcccacatgttaatggaatagctcttcatcaatctatttatgtggacatatgttgtcttaaaatatgtattaaagtgactatatataatggtgaatgttcttaattattttttctagacaatataatatttttgcattttgtcttaaatatatttttttatatgatcgcttaattggatcgattctaagaaaatcaattttactgtcatcaaatttaatgatttattaactaaaatattatgtcatcgtagcgtagcacgggcatattactagtaggagtgtagttggtgaattatagggtaggtttgtagatgtctctctaagactgtgtttagatccaggagtgaaaagttttagcgtgtcacatcggatatacggacactaatttgaagtattaaatgtagactaataacaacacaaattatagattccacctataaactgcgacacgaatttattaagcatcattaatccattattagcaaatgtttactcagggccgtgccatcaaatttgtaggccctgtacaaggctctaagtgaggcctaaatcaagtaccaaatatagctaaaataatgtatatactgcagagcaaatgcgatatatcaacaacagtacatttttgaactcttgttttataatcagaaactgtcaaactgaaaatggagaatgttcgttgctgttgctagcttgctgcctagtgccttgcttgttggttgcttgctaagttgctatatgctagatgaatgaaaatatgaaattagatgagccggctagcggcctggcgctcagaagagacgagacgtcgagactcgagacgaactgaataagtcacagatacgaaaaagaaatacaatacaaaaagccgtgaggcctcggggctcggagtcgagaatacgaagcgccacgcatgtgaagtcgccacgcggagatatgcgcgtactcgaacggggttctggcgctctggcctcacacgaatacatgggccttctctggttgggctgattttttgaggccctggaaatttggagaccctgtacggtcacacaggtcgcacgcccttctgcatggccctgtgtttatgtgtttattgtagcacaacattgtcaaattatggactaattaggtttaaaaaattcgtctcgcaatttatacgcaaactgtgtaattaattatttgtttatctatatttaatactctatgcatatattcaaacgtttgatgtggtaggataaaaaaatttaccagggaactaaacaggccctaactctccctaccatacttgatactagtaccaaaagtcaatgtgcagtacaaccattatctgtaaaaatctagagaaagtgtagactctccctacatgtatgcagtgtagtagtactaggagagtactagctaggatgggtagatttcttcggcttctaccatagggtgtgttcgctattcatggatcccaatcggatccttccacacggaaaacggagtagttcattagcgcgtgattaattttgtattagctttttttaaaaatagattaatttgattttttaagcaacttttgtatcgaaactttttgaaaaaaaacacgccgtttagcagtttaaaaagtatgcacgcgaaaaacgagagagaggttaggaaaaggggcatccgaacactccaatagagtgtcttcgatactcacgtttgggaacggtactctctaccacggaaaacggattagtttattagcacgggattaattaagtattagctattttattaaaaaaggaacaatatgatttttaaacaacttttatatagaaatatttttaaaaaagcaccgtttagcagtttgaaaaacgtgcgtgcgaaaaacgagaaggaggggttgggaacccggaaaaaccaatgcatgtgtaagtgcctgatgatgtatccattcatcaaacaagcaagctactagtagggcctctcacagtgcaagctatgtcgcccgtacccctagcccaaaaggttggtccaaaaacacccacctcatagtgcaagcacccatatatgtatggtttaattggatgaaggcactagtaaaggtaccaagcccacagtgggtgtgaccctagacgtgttaccacacatttatttctctcaattaccctcgcctgctactcacgcgagtattcttctcctctcctcggcgcgaccgcctcctcctctctcccgcatcgccgcgcctcctcctctcctgccacgccaccgtgcctcctcgcctcccacgccacggcgcggtccacggcgccgcctcgtcgcaagaaaccacgcgcgcaccggcgagtctttcccctccctctctgtcccacgctctgcttctcctccctcacacgcgccgaggaggaagcgggcacgggagaagggcggaagcaggcggcgtccccggtgacggcggtccggagtagggcggacttcgccggcggtggtgttaacgaccaaatttgataagatatgaaccaggttcgacattggaatcgaagcagattcggcaaagagatggattcgaagaacagagtgtgcatcggttgtgaagacatcggttggggtatgcatcggctgagatggatcggttagaggatggctgatgcaaccaatagagctgatatagctgatttcgatggagatagcttcgaggctgtttctggaatcaatcgatgtgcttaacaaggattgccacaatggagataaagctctcagataggcaattgtatctattaattaggatatcttatgtaatttctttagagatatgtttgggcaaaagtctgccgcaaagacttatagtgtcttagagtttgttagagatagtagtcgtgtccggcaatgacatattttgtatctcgggtataaatatgacccgaacccatgtaatcaaacaacacatgttcaataacactttcggcgcatcgccacccttttactttcgttctattttgacgagttcttgctttcgggttgagctgcatcgattcaatcttcaactagaggtaaacttgtcatgacggtttgcgttctcaggattagtgcttccatctttataacactctaatcttgtttatgtaattttttgagttatcatatatactttataatctctattagtttcgctatataacttgtcatcggctagtttttactgttagagagtagccgatagagttagatctcattattaatctagattataccgtatatctaccatctcttataggttttcatcatcttgtttagatcttacagttatctttatgcttaatgctgcatcggttgagtttgatctattaagtttatctataattgtgatatctagcctgttttatgatcatcaatagagatagtatcagagtttcagccgatcttacctgatttagttattcttatctcatatgcttgtttgttatgctaaatctgccctttatattaagatcttgttgcattgaagttatattaggtttattatttaatatatcttgcttgtctcaaatcttgatatagagtggtatcggagtattagccgatacatggtagatctatctgatcggctatgctataaacttctatataatctttgctttaatatatatttcgacttaagtaatttatactgtcttggcatgatgaccgatctatcccaatcacttagttcaagtatataccgaagtaaagattatatgttgttaatatctacagccgattgagtagatttagttttatcatttttattcattattgccgatcgagtcaaacatgacatcggctcgaagataaatgatatgtcattggcaactagccgatcggctatcatttatggatttaaccacggtttttcttattcttgttgattgcatgatcaaatcaactggcacgctcatgaacctaaaggcgagattttggacctgcaaaggagttaagcagatcttccaggccagtgtgtgtttttcacatcaacagacgactggcgcactggcgcggcggcgggaggcgtccccggtggcggcggctggcgcggtgtggcggcgagcagccggagcgtggggctgcagttccggcgccgccacaaccggatccagcggttcagcgttcgatctggccggggtcggcaagagtggacggctcaacgccgacgggcggctggcagcaggagcggacggcttctccacctcgccgatttcccccttccttttctctaccaaattactcaagaaatattgttggtttggtccgcatctgtggtggtttccttccttttctctaccaaattactcgagaaattttgttggtttggtccgcacctgtggtggtttgggagggaatttgttgtgcgtttggggggatttcagttcgtcgatgattccgttggagggtgatttggggttttctgtaggtggattcggcgcgagggcataaggcagtgaagaaacgctgcccacagcgcgcgtgcctcgcttttccctgtccgctcgcgccctcgccgcaacaaagtttcgcatagctcaggtaggggacgagaaacctagctaagggacgggccccgtcgccacgtcgacctgaatccgagctggcgcgacgaggtcccggtccagctcaccgcactgtgagaggcctaaagagctgtctactcttgagctgtccactcttgcatcacacttgctcctcctccagtacatcctctgcttcagaacgtgctcaacaaatatttaagcaccaacatcctctagtttggaagctgtgttcggaagccttggttgagaacccaacttctatgcatggaaaacggagcattccattagcacatgattaattaagtactattagctaatttttttaaaaaaaaaatggaacaatatgatttttttaagcaactttcgtatagaaacttttttaaaaaacacaccgtttagcggtttgaaaaacctgcataccgaaaacgagagagattaatgaaccctgagttcctctcaacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggatggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtaataggtggccgaatcggattccagcacttggaggacttgatcttgatatcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatacaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaaatgacatctcaaacatatcgttcttctcattttggagacttttctgaacttcctgcaaaacatcagtgataggaggcacaagcatatcttgttgctccattggattctccaaaattttgcgctcaacaatacaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacacactcaagcttttaaccaagctcttacaagatcttaccaatgcaagtggaatggtgatgtacaccgactcaaccaagcaccccaatagaggttggatatatcgatgcctcggcaaacacttgccgtacggttgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttctttttttttccttttcttttctgattttttttggtgcggctttttttttcttttttttttcacctttctgccttttttttctcactttttttcttattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcaaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacttctgaaaactacaaaaatagaaccgtggcagcgagccgattccgttttcgtaggtcccgacaacaacagagacacggtggcagcgacgactgtggtacaaaacgtgaccagaactcgagactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcaacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagattttcgagatgaggctggatccgttggaaggaggacttcgagagcttt

SEQ ID NO: 46908 - DNA, 9185 bp, Oryza sativa
aagtcagcagtgtagtaggtggccgaatcggattccagcacttggaggacttgatcttgatatcttcttgttgattcatgatgtgagcaatggtcgtatccatagtagctatggtcacatcagacatgagttgggaaacttcggtgtacttttttttccaaaagaaattagggaaggcccaaaaagtaagatggaattgaacgggatcagatcgtccgcgtgcgagccgtttcgatccccctacctcctcctcgtacgataagtacgcaccccgagcgctcacgcgcttcgcatcccgcaaaaccccggtagaacccgcacccgcacccgcacccgcaccgccatggagttccggtaccgcgacggcgacgaccgcagccggtcctcccctcccccgccgccgccgcccacggcgagctctggatccgcccgtgtgctcccggccaacgaaggttacttaattaattattctcgatcgatcgatcgatctcgctatctgcgtctttttttttggtatcgtttcctttcttgatcagacgatgggcatcgtggcgcagacggcgggggcacgggagactacaacgggggtgattcggccgtgtcgctggggcagtcgtcttcaccgtcggcggctggtcgcgacgagctgcggcaggcgaagaagcagaagataatggagcggatcctgcgggaggaggcggaggaatgggagctcgagtcggaggtccgccgggagatcatggagcacatcttcccgttgctgaggagatctgggaatgcacggccgccgacgccggcggcggcggcggcgctcctgcaggttcgatcatcatgtcttttttcgtctacctcgattttgggttgttttaattttgatcgatattgaatatttgtttctagattctagcttaccttctcctactgctccgactagccgcttggactaatagcgtaccactaaatgttccgttaaattaatatagaccgtgtaatgaagaccatacccttagacattttacaaaagctatagagatcaaataataatattgtatactccctccattccaaattgattattttataggtgcaccaaaacaaaaaaaaataataactctctcatactatatttactcgagcaacaaactcaatgtatgcaccatccccactatttcctagtcaataacaaatcaagatattgcatgtgggttatatatacttagggggtggcccctctctcccaaacacccccttatgtgcatggatgcatgcatcaatgtccatttactccaatgcacaaataacgaatagacttaatgaataaacataaatatatatagatcatttaggaataaccttaaaaaaacctatatgtagatcaatttggaatggagggagtaacgtgtatctcgatcgttcatgtttttccattacatgtcttatttgatgacaatataacttttttatgaataatatactaataggattgataatccatatatggattcattactatagtcatatttcatcttcacaatgacctaagaataagtaattctatttattatccatttaaatattctactagttattccttgtaaacacgcgattcattaatatttacgtttctcaatgcccatgtagccaatcatgtgtagaagaatagacaatcatgtgtagaagaatagagagtcacgcattaaatccgagaaagtcaataagaggataggtggttggattgaaatatgtctatcaaaactaaatttttcagatttggaaatatgtctatcaaaagtagattgagggagtataatatagtacatttttatgtaaattgctttgggatttgcgatgacatgccgatgaagaagcacaataggaagattaatactattgtttaaaagcaatgaatttcaagtcgtgtcgtttatggatagaaattaatgcaatcaccgaaatgaggtgtgctatgaaacctcaaggatatatgctctcctctttagaaaactcttggtcaaaaaaaagttagaaaactggaaaagaaaacacttagaaattgtgtcaaccacctattgttttagaaacatacactgtcaaaatactaaagttgtggatggtatttcacattattaattatatggtcgtactcacaacatgagtccagttgtggatgatatttagaaggaaaaagtacgaattacctcccccgaactatcacagtcgtctgaattacccccctgaatcacaaaaccggacattcttcacccccaactatgcaaaccggacgaattaccctctcgacccaatccacggtggttttggtctacgtggcgtacgcgtggcagctgagtcagcattctattcattaaaaaaataacgggacctacatgtcatactcttcctctctctcactcttcctctctcttctcttctctctctctcactattcctctctcacgggcgggaggcggacacggagctgcggcggcggtggccggcgggtgacgctgaggcggcggcggtgggggatgagggtgacacggagccggcggcggtagcgcggcctcgccggagtcggacgtcgctacggcggaagaggagaggtcacgcaatgtggaggcgaggcgggtcgtgtcgcggcggcggagcacggcgtgggcctcggcgaggagctgcttcagtgcttgagcaccaggggcagcggagggggaccgaggacggcgacggccgggggcagactagttgggggcgacggtgccgcgcgcgcacggggaggcacacggcggcgtcgctttcttcccgcgctccagggccgcgctcgcacgagggggcaccggcggcggcgacagcgcacgagggagaaggctgggccggcgagcatgttcgtgcgggaccggcggcggacgggggcggaggccctgcggatctggaaagacgatgcgggacccagacggcccccgtgcaccgccgtccgccgcctgcccccacgcgccgccgttgtccacggcgtcgggccgccgagcgcacttgtgccgcccttactcgccgccgtccgccgcgcgcccccacgcgccgccatcgtccgcggctccgcgccgctgtgcgcacttgcgccacccccacttgctgccgtcgtccgcagctctgcgccaccgtgcgcacttgcgccgcccctactagccgtcatccgccgcgcgcccccacgcaccgtcgtcgtccgcggctccgcgccgctgtgcgcacttgcgccgcccccactcgccgctgtcgtcccctccgcacttgcgcggttgttgcgcccgcgtgcaccagtgagagagaacggagagagaaattaggaagaggtgaagtggaggcatgacaggtggaccccaccaatttttttaaaaaaaatggtgactggactgccacgtgtatgccacggggtcaaggggggtaattcttctggtattgaaagttcgaggtgaagaatgtccggttttgtggttcagggggtaattcggacgaccacgatagttcgggggggtaattcgtactttttcctatttagaaacaaatctatttggttttctcaacattggtgaccagtctacaccaatccatgagttgtaactgtatgaacaatgacatgaactatctaataccatctaaataatcccaacggtcgattttgaaggtcggtttcataggccataattatgcttgcaagtgcgatataattcagttgtttgtatggcttgccacatcctcgtggatctatttttagagagttcatgggtaactaagatggtcacagttcctgatttgttgtatattggcccccgatgttcatgtatctgaataaactagtttctattaatctacaacatgcacttctattatcgagatatgatcaaactgttaaaaaactaagaaaacactttgaaattgcagcaaccatctattgttgaagaaacatgcaatgtttgtggatgatattttgcattattaaccgtgttcatactcacaacatatgagtcaagttgtggataatatttagaaacaaatctatttggttttctcaatgttggtggccagtctacaccaattcatgagttgtaactatatgaacaacaccatgaactatctaataccgtctaaataatcccaacagtagattttgaaggttggtttcatagtccacgattacgcttgtaagtgcaatataattcatttgactgtatggcttgcaacatcctcgtggatctatttttaggctcagttcggtagtacaggtacccaactcctcgttttccgcgcgcacgctttttaaactgctaaactgtcagggttatgataccacatacctaatagtagttgactaaatctcggcaggatccaccacataccatgtcctatacagaagcaaccttcggatataggaggagttctggataatgaaagacaaccagagttctacatgaaaatgacaaggactactcggattgtatccatattggtttccctagttctacttggacaaggggacaactatgggtataaatacaagcccccctaggaggacagggggacaaccatcatgagacgatcaacacccaatacaatcgacatagaagccacaatatagaagcctacatatgccaagacacgccgccggatatcgacttcagggataagcacgactagtaccctacggtgtctccagatactgtcaggagagacgaaagcgttatctctgatctcgccgggcgcggattcgaggaggaagactaccctgttgttgactacgagtcagatcgtcagaccgccatgtcgataacagttagataggctaccccaaacattgtactggtgtgattatcatgaataaaagcaataccggctttggccaacaggatgtagggttattacctaacaattcaggggcccgaacctgtataaaaatccctgtctccatctcttttgcctcagtctcgcgtatatcctagcaccaacgatccccatactgtccaaataccgtagtcgtgacatcaaacgtcgacataaacggtgtgttttttgcaaaaagtttctatacgaaagttgcttaaaaaaatcatattaatctatttttgaaaaaaaagctaaaacttaattaatcacgcactaaaacgttgcttcgttttgtgtgccggggagtgatggttcccaaccctcactcccaaacagagccttagagagttcttgggtaaatgagatatgatatatagtcatagttcctgatttgttgtatatcccccccccccccaatgttcatgtatctaaatagactaggtgctattaatctaccacatgcctttctattactaggatatgatcaaaactgttataaaactaaaaaaaaactttgaattgcagcgaccatctattgttgaagaaacatgcaatgtttgtggatgatattcccattattaactatatatttatactcacaacatatgagacgagttgtggttgatatttagaaagaaaatctatttaaccttctcaactttgtggtcagtctactccagttcataagttgtacctatataaataataacatcctgaactatctagtactatctaaataatcccaacagtgtgtttgaagtcctattttataggccatgcttatgtgcgcaagtgcaatataattcagttaccctgtaaggcttgccacccacatcttcatggatctagagatcaagcgtaattgagatagtcattgttctgggttgtactatatggcttccaatgttcacatgtctaaaaagggaaactctattcatcactcgaagggatatcctctcgattttcatgctacttaaaaggtcataaaaatattaaataaattaataagataaataaatatatgatatatcacttcacgaacatgtatattcaaattcaacttatataagtagaaacaaaaataacaaatttgattcggaatagaactttcaatttgcagtcaaatttgttatttttctttctataattgtttaattccaatttgaacttggcaactttgtgcaatgacatctatcttgccaagtttttaaatattttttgatgactttttaaataaaatgcacaaaacaagagaatattctctggatggataaaattccatctctgtctaaatatattactagttcttactatttctacaacattcggttctgtttttaaggatggctctaatattaatttatgtatgtgttgttgtaccttaatttctatctccatctttgtttcaaaatataagtattaaaatataagtattaagtacgaaggttagttaagttgaaaaggtggtactgtgcactagaatttcttttattttgtatacttgattttggatttaaaattttttatgtcttactatatcgatgttgtcaatattcactattccctctgtcctaaatgatgaggtttatatttttttctacacgatctttaataatatactttaaccattaatttattacgtgttatgtttccgacgaatatgaaattagcttaatataaaaatatttaaaatataaatctagtaatataatatgtatatatatggttagtataattattaatcaaaaacttaattaggacgccgtataggacggagggaatacttccttccgtgttgttcttatatacgtgttctaaaagttgacgagcgtgttcatttcacgcagggcgccgtcacgaatgcaaacgcatcatcatcggcggccgccttgccggccaagaggaagaagaaccccgccgcagcagcgtccgccgtctccgccgcgacgagtagcaagaagcccaaggccgccgacctgacctgcgccgtctgcggcatcacgtcgaccggcgagaaggctatgcaggaccatctcaacgggaagagccacaagaagaaggcggccgcgctcgcgctgtctgcaccgccgccgccgccgccggcggaacccgagcccgagcccgagcaggacgaggaggatgcggcgtcgatgatcccgccggcttcggacggcggcggcggcggtggcggcggcttcagtccgacgaagctgagcatgctgacgagcgccggagtcgtgtacgaggtgatgcagatggacggctacctcctctgcgagggctgcaatgtcaggacggccgaccgcgtcaccatgatgtgccacctcgacggcggcaagcacgtctccaaggccacgaagctgaagcagcagcaagccgggaagccgccggcgccagcgacggcgactgcctctcctatgaatggcgtgaaagcagcgggggcgccgccaacaacagctgctgccgccgacggcgagcatggaacggtggtggtggaggtcgacggcgagccacacgccatgcggaggctggacgaggtcttcattatctgcgatgtctgcaacgtgaaggcgccgtcggtgactgtcatgcggtcgcacctcgccgggaggaagcacaagtccatggccgcggcgacggcgaaggcgaagggtgccgaagctgccgcctccaccaccatggccgctgctggcaaagttggcgggaaccttgaggcgggagccatggcagtagcagaaggtgtcgccaccaacaacgtcgccgacaacacttgtccggagaagggaaccgtcgacatcgtcgtcggcggcgagcaccacgccgtcaagcagatcggcgagttcctcgggtgcgcgtcctgcaacgtgatggcgacgtcggagagcggcatgaggctacacctagccggaaagaagcacaggaacaaatcgatggctgaaaaggcggccatggacgacatggagattgtgaaggccaggtcgaaggaaacggcggccgccgccgccgcctcctcgccatcgtctgcgccgcgagctgtcgtcgctgcacaaacgggcgatggctctgtggcgcccatggaagtcgaccaaactgcagaggccagagatggcggcgcgccggtggccgccgacgccgcggcggcggcggctgccaccggcgggcagcagcaggtgaaggtccaggtggaggggaggatgttggcggtgctgcgtgaggcgaacggcgcgctgctgtgcgagccctgcggcgtgcgctgctccggcaagaccgacatggtgctgcacctctacaccaaggagcactcggacaagtgcggcgcgcatccaccggcttgagtcacttcacgcgaacgtggagtggatttttaaacttttggacgtcctcacattatttacatattatctaaatgaatttcttttaaaaaatttcctcttatagataggacgaacaaagaacaaagttttttgatcacttacttcgctcgccctttttgatcggggaagataaattaatatgtgatgtatcgctttataaataataagttaaaatttaacttttaaaattaagaaaataaattaaacgactgttaacatatatttattgttaaatttgttttttaacatataaaatttaaggaaaaagtacgaattacccccctgaacaattgcggtcggccgaattacccccctaaacccaaaaatcagtcattgctcatcctgaactttcaataccggacgaattacccccctcgatccaattcacagcggttttgtcctacgtagcgtacgcgtggcaatccggtcagtattttctttcttaaaaaaattgtgggacccacttgtcatactctccttcctctcttcctctctttctatcttcactctctctgtgtcacggtgacggggagtgcgagcggcgcgtgggggcggactggcggtgtgcggcggcgcgagcggcagaggacggcggtggaatggcggcgagcggcgcgcgggggcggacgggcggtgggcggtggcgtgagcggcgcgcgggggcggactggcagcgagcggcggcgcgagcgaggcacgggggcggactggcggtgatcggcggcgcgagcggcgcgcgggggcggactggcggcgagcggcagcgcgagcggcgcgcggggtcggactagcttctcccctccgccgcctcctctcctagcctcccttccgccgccgccgccgcctccacgctgccatctgccgtcgagagccccggttctccacccacgcggcgacgatggcgggcgttctgcgcggccacaacgacatggtcatggcaat

SEQ ID NO: 46909 - DNA, 16491 bp, Oryza sativa
  unsure (1)..(16491): unsure at all n locations
ccccgcgcgccgctcgtcgctagcccaccaccgtcctccgccgctcgcgccgttacccaccgccagtccgcccccacgcgccgctcgccgccaagcccaaccggccgtcncnaaccgccgctttggcgnnccgccgcnntcgcagccagttcgcccccgcgcgccgctcaccgccagcccaccgccgtcctccgccgctcgcgccgccgcccaccgccagtccggccccgcgcgccgctcgccgccagcccaccgccagtccgcccccacgcgccgctcgcgctccccgtcaccgtgcagagagagagagtgaagatagagagagagaggaagagaggaaggagaggtatgacaggtgggtcccacaattttttagaaagaaaatgctgaccagattgccacgcgtacaccacgtaggacaaaaccgctctgaattagattgagagggtaattcgtccggtattgaaagttcagggtgagcaatgactggttttcgggtttagggggtaattcggctgaccgcaattgttcagggggtaattcgtactatttccaaaatttaaatacgatcttgtattgtttatggagtgatttatcatatattaatatatcttttttttaaactgtttggataacatataacgagagaattttcttttcgagagtttaaaatagtttcgtgatgattccttgatcgtctcatgttaagatgactaatgtgatcgtttagttccggtgatataggctgtgtttagatcaggggtgtaaagttttggcgtgtcacatcggatatacggacatatatttaaagtattaaacataaactaataataaaacaaattacataatctgcctgtaaattgtgagacaaatttattaagcctaattaatccgtcattagcaaatgtttaatgtagcaccatattgttagataatggagcaattaggcttaaaatattcgtctctcaatttacacggcaatctatataattagttatcttttccatttatatttaatactccatgcatgtgtccaacattcgatgtgacagggtgaaaaattttgctagagatctaaggcccaaactttttcttcaaacttccaactttttcatcacatcaaaactttcatacacacacaaacttccaacttttccatcacatcgttctaatttcaaccaaacttttaattttggtacgaactaagcacaccctaaacagagccatactgtttgtcttgttgggatggatttctggccatctgcgatagtctggacgtgtggcggcgcactaggccatttggttggggataatgccggtggaagtaaattacttgtttctaattgtgagatgtctgtcaatcgaaagtgctcgttttaaattgtgtttgtggatattgttccatgattcactattatgtgctactaaggccctgtttagttaccacgcaaaatttttttatcatgtcacatcgaatgtttagacacatgtataaagtattaaatatagaaaaaaatagttacacagattgcatgtaaattacaagaagaatcttttaagcctaattgcacaatgatttaacaatgtggtgttacagttaacatttgctaatgacggattaattaggcttaataaatttgtctcgcagtttacaggcggaatctctattttgttttgttattagactacgtttaatacttcaaatgtgtatccgtatatctgatgtgacacttttaccctggatctaaacacagcctacatgagtcgataaaatctgcacattctccattcatcgtcgaataattcattgatggcgatgtcttaagataatcgtcaaatgattatgccgtccaatacggtttctcagtactaaaataaatcaatccaaaattattctaattgtatatcacatcttacctttgattaatttattataggaatgaggctcactgacttataggccccacagaccctcaaacccatataatagcgagcagtactgcagagaggatcaggattgaaactagaattgcatctaccactgattccagcaacacgagaggaacagcatgatagtaggtgacatgagtcttcaattgcaataatctcttgcccgaaatcatggcgacaagatgagacaaacttgtagaagcagccataaatcataatgccaccacatgcgaacccatcagcagagaaccagtattcctggggttagaatcctgctgaactacactacctaaacatcagttttaaccagcaccacagttgtactgctgcatcttactgtaatactaattcttaatgaaagaccaggaaaaagaacacatatggctgccagaactagcatggcattgcatcacagtagccaattagccactaccagaaatataaaacatcactatggagtgaacatatatgctgacattactatagtaatattcacacatggatataatctacaatggtgatgggttccatgacttccattctattccctagtgtctacataaaacaagattgagctcaagaatgaattacagctctacaagaatataaacatatgcagctgcagcacctactacaaggcatcagacagcatttgtattaattattcatttgctcaaatactattagccctagagtagttgttgagatggcattcacgctaacaaaacagacaagtgattgattatacacgactacgatctcaacaagtgccaggagcattacacccatccaccgattcctcttaaggattcttttacaactcgaggaacagggatgaacgaaattcagttcctcttcccaactatctcaacactgttattattaacctatactctgagagctaactgatcctgccatgatatcttcctcttcccagctcgggaggaggcggcgttccggacatcccagaatgccgccattttcgcatcactaggaccggcggcaaaatcaccctccattgggtacctcatgaccctgccaaccctaacaggttcctggtaaccatgaagctcctccatctcttctgaactctggaaagagcaaattcaaccacattcagatgataatttcttcagataacggaacttaaccgagttcgccccaaatattaccggctcgcaggcctcgttgaggtcaatcaccggagatgctcttggagcagcattcagcctccggtgcgccgatgggcctttgctagagcttccgatagcccgaaccgtgtggtactcttcaccatgagaccaaccaggttgccgcaatgtgggcggcaatgccggattctttactctatagacaaacgtctgggatggattttcggacatggatttgtaccttttccgcaaaaacctacagcgcggcacaattatgcgcaggataatgagacaatatcaacatgtttgcattgtcgtagagcataatcatccaggcatgtaaatcacactggagaagatgatgagttcaggcccttacttgacttcagccaaaagcctctgtttcttgagcttctccatctgtaatctcttcttctttgcttcagtttcctgggtaacccaacacagctaatcatcagcaaacatcataatagaagtaactgagatggacactaaacaccatcaaacttgcaagaaccacatttgtggaaatcctcctagattaagagagttgcgatccttggaagaaagtttaactacgaaccagaatgaactgatacacttattagctgacttggaacatatcaaaacatgctaattcattcaatattaggagaagaaggataataaatttcagaaccccacagatctaacccaaaatattgtcacaagtaaaaaaaaatccagatccacaaaatacaccaagaaaacccctcgaataatcagaaaaccaagaacaccgaaaataaaatcgatcaagaaacaaagccgccaagatccaatcggaatcacaaaatccccaaataccgagaggaaaatcaaacatcacaaaacccccttccggagagaaaccgatcgaaaaatcgcaaaacccccaaaaatcaagatcagatcggcgaagccaaccacgacggcatgactccaagaaacgccatgaatccacccacccacccacccacctcgaggagctccttgtagtcctggagaagattcttgtacttggccctcgccctgtacgcctcttccccgccaccaacgccgccgccacggctgtgccccggcgccctcggcagcagcggcgacggcggcgccctcgccgccggctgagccaacaccaccttagccttcttcatgtccgcctcacctcacccgcgaagaaaccaacaaacgccccgcaagagcaggagaccaagaaagccagggagagagagaggtagaaggagataggaacaagcaagggaggaggaagaagaagacaatatagaaataaaggaggaggggaaggtggacgtggggagggaagtttcttgcggccgctgcttcttggtgctctcgctgctggctggctgcagctgcggcgccgtggtgaggtgtgaaggagacccatggatgtggtgccaaaaaaacccgaaaaggcccatgcatggtcatggatggtgctagagtagacggactggacggcaagatagagagagagagcaagggaacaccaaccaaaccaaaccaaacaatctctcatgtgtttctctctctagacttgtagtagtagcggtggtagcggagagggagggagggtgggtggtggtaatggcgtggcgcatgtggtaatcaggtaatggagtggtagtggggcgcttgcttgctgctgctgctgctgctgtctgcagcgttggcttcgtcgtcggtccagctccgtctccaagaccaaggagaggagaagagagagggggggcattcttggaatccgttggggttgagaggtcagaggtgtccaccatgagtgaatgctgctgcagctaccccctctctctgtgtacacagatgtcatggtccatagggaaaaaaaagcgagatgacgatacgggacatggacatggacatggatgtgtgtgtgtgtacgtctctctctcctggcgtccatggctgggtggctccatggatccattcttttgattctttcgtttcgctttcttgctgtcctcttgagagagaggccgaacgctcccgggtcttgtgcgagtgggtggtggcagcagcccagcatactacaagcgttgcagtggttgggaggaggatgatatgatggcgtttgcagtttgcacgcatttgatgctttgatagtgtgggcggaggaggaggaggagatgatggatggcgcagaccgtagaggcggatgggccagtgcgtgcggttggtgtacaacggcgtgtgtgcgtcttgcagaggctctgcggcgttgctgtttgcttgctgatgttgttgtggctgtggctgcgagtgaaatggcgagattgccatcccattcccaaacaaacaacaaacctacctgggtttctctccctgccgttgacacggtcgcctccgctcgtttttaagatgggggatttgggaagagaggagaattcttgtgtgagatgaagatggcgatgaaacgatgataggtggggtgggtgactgggacgtgtagagataagatgctgtggactttgtggtcctgtggtttgctcgttgcatctgtctgcccggtgctttcgtatgcataatataaagtactgtatcatattaggtaaattttactgtatgatattaggtaaatcgtgatttcatagttttagctctagaacatggtaaaaatcgatctttggaaaaagacacatccaacatgtgattatttgctgttgtatcccgtccacattaaaatattaattttcagttcactaagagagataaacatcgtgaaaggtcaaagtacctctagccccatttgtcatcttcttcctctttctcatttccctctttctcatttcccctttctgggagccgatatcgaggtggattcaaggtggcttggaggaggcgaggtggagcgacatggacgagtcggggtgaagaagatcgacacgtcgagtggtgagctggtggggtggtcgatggggtctgtgtggaagccgaggatgagccggttgatggcgcggttgcaagagagggcgctggccggaattggaactgaagaggatgacggagaaggcggtattatcctcgatccggagaagcggtggcaaggagtgctaggcagagctagggtgccatgcggtgatggaggcggaagaagacgacgccgtgctgccaagactgatttagagctggcgaagcctagcctgaatggtttgcatcaaaaggacggcgtacccgaaggcggcccttgcaaacgcggcgaagaggggcccgtcagaggcatgcagtgcacagaccaaagttagcagcggtggttgttattgatgcgcccacaacgcgaggtagtgtgtcgatgacgcgggagaggcttcgcccacggatctgccaccccacctcctccaggcgggaaatttaactatttgccactcttgtgatatggcaattaactatttgccacaccctgtcaatgacatgtgggccctcatgtgtttatgacatctgggcctagtgacaaatcgttaagcaacattcgtaagagtggcaaatagttaaaagcccccctctaggccaccacctcgatgctgactcctctgttccgtcaacactggggtgggggggaagaagaatggaagagaaacgatagcgatttggtcactccgtgtaaatagttgtgccccctatcaccttgtcagaatgaatacattattttaatcgacgtagttgtaggatcgagatgtcgactagaagggggtgaatagacgatattaaaaataagagaaaattggaaccatgccattataattttgcaaaatcgagatatgccatcctgacccacatgccattgactcatgtgggtcctacatgtcattgagataccgatgacatatctcaaactttgcaaaattataatggcatggttccaaattaccctaaaaataaatagcgcctaattaaaactaacctgagttgctaggcttggtgaagggtaagactaactaagcaactaggttatgttttacaatcctaaggtgatagggtctcaagtacgtcattatgaatgtaaattgcacacaggtaaatacaataaataaatgagacaagagagaagaaaattttcacccgaggttcggaaactcgctggttttctaattcccgttgagacgagcctaactttaccgcttaaaaccatagagccacaacaattctactacttaaaagatctgtagtggtgatggtgaagctaatgtagactcatgatccaacttaaaaacgtagacacgtgaccgtgaaaaaaaaaaaacgaacgcttcacagcgacgcgcaacagaagcgatccgaaatcagcgcaacagaagcccccaatccatcttcgcgcatccccacatcgccgcgcccgctccactcttccacccccggcgccgctgacccctccccagctcccgcctcccggtctccctcgacccatccccgccgcttgaagccctcccgtcgcgcctcacggtctccatcacgccggctcgccctcgacagatccccggaagccctcccgtcgccagttcgtcgcacacacctaccttgccgatctgctcctcgccgccactgtcggcgcccgcatccacgacgccgccgtcatcccttggtagttgatgtcttctccttctcctcaagatggatccaaatgtgccaaatgcgtttattagcaaagcgaacaaactggggatggcgccacgacctgcttgtgctggagacagaggaccccttgtcctcctcctcctcctcctcctcgccgtgcctccttgacccgccgccgcttccaccctcaagcgccaccgcacgtcgcacgagaccccacttcctcccgctccccccgctgccgcgcctcgctgacctgtcgcctttaaaccttgcgccggttccaccttctccgaggtcgctgcctccctagagggccggccagaggtcgccgtggagtccttgaaagaggaggaggaggaggaggagagacggtgccatatgcgttgcatcacacgcgggcgccgtcgctacctcgagcaccgtatgtgcgattgcagccgcctccgctcgccatgagaacaatagcgtgtcttggtgctaccatgccgagtgatctaggagtactcccttttttctgtcagtttttctttttccctgtttgcttgatttgtggtcaggcctttttcctcgtgctgtttgaaatttcatggtgaattatattcctaaattatatctactttactttctaggtggaatttctccaggttttagttgagtgcttgggactaaacagtactgtagcaagcattatcggcctattttgttcgcagagtgaagaccatggatgcagcatgcatgcagagttgcagactgaagacaggccatcattcttcagtctaccacgagatagcggcgcaaatgcttgattcacttgtgagaatcacttctttcaacttccaacctgattttagagcaacagtgcctcaccaattgaaatcaaccgatcaacatatatgtcactggttctcccatctattagatatagttctgaatttttaaacaaaatgactatttgtgtgctgtgagtacaacaaaaatgagctcaagaaaagctatctctatcaacattagcgaaaaaaaagcacacttaaagcctttacaaaaaaaaaatatatgaagtctttacaagtgtaaacatttctgaaattgcctggtgagcgattaaaatgtttttcttgtggtgccttcagagagtttgatatgtttctatatatttttacatgtgtgccatttctgctgccccgaacattgatctgagagtaatcaaattccttgaatagtttaacttctaaatgttcaaaaataaagggagcgccatggaagtcaaattagtgaaaatcttaggtatcctgcagtgtgtatgggggcactgtgcaatatgatgttgcatgcagtatactatcattcttttaaaagtatcttctcggaataatttcttatttccaaatattctcagatacactttcaataatgtagatatgagatattatgtgcgaatggccaccccaagataatatacttcaggatatgcaaaatcagttggagaatgcaaattcggttgttctctttcatccctcatatatgcatatgtttcttaaataatttacaaaattactgttcagtagtggagtaaataaatatgaatgacggtacctgtcattatgcacatgttctctaaacacatttcatgaatgacaaggtaatttttggtaatattgtttggcagcgagtatttgggtacaatgtactaaagttaatcaatatgtgtggcatatgcattgtttttcattgttaaggttcgaacaactgaaggcaagtaagatgaaagaccttgtttgaaaagggaaagctgaactggaagagcatagaagatgcgctcatctaattagccaggaaggttatgcagctgagtttagcattgaagttattgaagtgcaggtaagatattctcctatcttactgacttccattgttcttgaaaattgtcattccaaacatgttcatgttttggccaagatggccgaatgatccactttggttctgaatattttgtttgtcgtttttgcaatggcagggacgtatgcgttttgcaggctgagcacatgaagaatcccagttaatgtctctttaacttccatccataaggagactcgtgcactttcctgacaccctagcacaagttattacgctgtgcagacttttggctatacattaagcaagatgcagcaagtattttggattgatgatctgtaagatttgagttcagctcatgctcgttgatagcacatgacacatcggttgaataactgtgttcatttaactctggacctacatatacataatttcctcttactttgattccttggctcaaaaggctcacagaagcctatattttgcaattaagcaacaagaagcagggcttgatttgcattccgattcaggtaaggtaacagctgacttcgagtttttttttaattggtgcattatccatgaaacccttttccagtttccagtattcttttgttaaattttctgataacttaataggaaagacattaattaactatgcatcacctgctctatatataatataactataggacattgaatattttatttcattgcactaaaatataatcaatgttggcctatttttatgaatatattattctggcatgtcactacaagatctaagtaatactgatattttgatccatgggtgctttataagatctaagaaattaattatacttgatctcagggtctgaagaaattaaaccttaacaacattgtgaaatatagtgagactgaatcttggagataaattactgaagaactgaactattattatgagtataatttactttctgatcttttaacaaataaggatattgtttattagtggttctagatttggttaccttgcgtccttgccttttattcatcagtgcaattagggccaagcttttgcgtggccttgtcagagagatgaaaaagtacatatgcagtgcatcacttataattggttgtgcaacctcctcatccgcatgctaagtacaatgagttgaagatgatgtgctgcaagtacgccctttccaccatctgattatgtacacatttttatatatttcggtacatccgattatatacacatcaatataaattgtttttacgcattcttatatatttccgtgccacctactatgtaaatgagcaaaaaaaataatttgtttcttacatatattatttacaattatttttctccacttctataggattgacatattgttttccaaaggaaacataatagatcgggcagtttctgtgagctggatcagtacgggcatatgtgctaactgcctcctatgcagttgtgctttgcacaacgaagtgagtgtggttcatctttagagccatgttcaaagagagtttgggtgttgatcaattgtgagaaaatcatgtgtagaaatgccttgggatgatgtctaaaatagggcattgtattcatttcccgtgaattgctgcacaaatattttttgatgtactttatggtgcaacatgcatctattgacactttctactttaaacatattaaaaatatttgatgtattgtttcgtgctatagtttttttcctgttgcaacgcacgggcacctaactagtattttaataaatccctacttattataaaaattgaagatatttttgtcggtattttggtacatcaactgtgtttgagtcgtttttaagtccgtccgtttttgggaagacatatctgtgtttgagttgcattttagtcttgtttgcttttgaaaatacaaaaggagttgtataagaaatcttaataaaaaaactcacattacttgagatgaaatacaaactcataattgcagcccacgattttctttaaaaaaaatattcatacgaattcccaaaatgaattttaccctaactaaaccgtataagaatgataaaattaaaatagtatttacccgttacaacgcactggtattttttctagtctctactattataaaaattaacaatgtttttgccggtattctggtacgtcatccgtgtttgagtcggtttttaagtttgttcgcttttggaaatactgatccgtgtttgagatggattttaagttcgttcgcttttgaaaatacagatctatgcttaagttggattttaagttcgtttgcttttggaaataaaaaggggtcgtataagaatctttttaaaaaacacgcatgctaacttgagatgagtgtcgaactcttaattgcagctcatgattttctaaaaaaaatatccaaacgaattctcacagtaaatttcaccttagctaaaccgtataacaataataagatttaaatagcattcacccgttgcaacgcacggacatcttttctagtctctactgttataaaaattgaaaatgtttttgccggtggcttggtaagtcatcgtgttcgaatcggcctcgcatataatcactgccaatttaactattttatgtgtccaacatgtacgagctttaaacattagattttccataagaaaatttgcatgttcggatcgtgcctttggccgattgcgttttgtcctgtgcattgtcacaaaccaaccgcctccgcgaggttgtcatcttgccgatacggtctgttgggcaacacggtttgggacctgctgttgcgcacctatatcaacaccaaccagcagcagtcaggtgtgttgccgtgcgccgaggcaagcagcacgacgtaccattgttgattattctctacacgcacacactgtatcgagaagaattcctaccgtgttcatcagaaactcaattcaatacggtctgctgtgtatacgtgttccaaaaaaattaaaaaaaaagttcaggagcgatatcaaagccgagatctattactacccacatattgaatatccacgcgtgcagcaagacgatcagcaacaacagccgatcgatgacggttgccaagagaaatacaaaaacctaatcagagaaatattcaatcaagctactgcgcacatatatctttatctttactattatatctctatctctactattataaaaattaaaaatgtttttgtcagtacgtcatccgcgtatgagtcggttcttaaatccgtttgattttagaaatacaaatccgtatttgagtcagtttttaaattcgttcgcttttaaaaatacagaagaaatcgtacaagaaatctctttaaaaactcacatactactaacttgagacgttcggacacctaattgcagctcatgattttctaacaaaatatatatccaagcgaatttaacacagtgaatttcatcttaactcgatataataataagattaaaataatcttcacccattgcaacacacgtgtattttttctagtaaaattaaaaattttaaaaattctcatctggagcgttgctgggctcgcgcggcccacatacggcgcagatcgatcggggctgtggggcctgcgcgggagagagcgcatctagcgcgcgaggctataaaacacgccggattctgatctcaccgcccggcaagcacgaacacgatgacatcggatcgggtcggtttctctcttgctgtcttctcgatcgatcgatggctcccacggcggcggcggggctggcagcgcgcgacgcgtccggccacctctccccgctcaccatctcccgcaggtgaaacttcaattatactcctatatatatctagatagggttctctagatagtagtgtaatgttgcgaggggctagctagcgctgttccgttcgtacacgtgatgccgttcgtgagcggcgccggcgccggaccgagtagggaataccgttcgtgagcacggcagcggcggcggcgttggcgtgcgtggagatggatgattctgttgaaacctctattcccatcgatattcatgatagttcatgattctgttcaggcttgtttcgttcgattttgccgacatgtcgtagtacatggtactacctccatctagatttgggcacatagaattaaatggtggaaggttattattgattaagaagtgcaggtacatggggaaattaaatggtgaagggttataattggttgataaaggattgttggtggagaaattgtattttgggataaattttaaaggctatgttatattttgcgacggaaacaaaaatatccaatccaggttctgaccttgggattaatttcttggcatcacacaaattaatttataggaaataaacttatttcagcaacaacttaattatattttagtactgtttgtcctagaaaataatcagaataatatatgatatagatagatagatactagtagataggtaggtaggtagtcgtactgctgtttagggtgcatgcatagtaggatgatactatcacgtacgtcccttcatgcgacggtttaatttgtcgatctagtggcagtccaacctattacacaccaaaatcgatcaacatgtggttttgcactgttcttttgtgaggtacatgcaccgggaggcttatgttgacacataatccaaaccgcattgtttgtgattacgtgatcagatcgatcacctcgtagtcttggtctcttggatctgtcattttctgtagtacgtactgtttggacttttagaggtacgatgtgttgagtacaactgtatatgcacagtaattggccattgtctctctgttcatatctagtgcactggtagcgttgcacctaggactttaccgtgtgatgggttgtatttcttcgactattgtcacaatctgtataattcctagccatatacgatttgccttttatgccagagtttagattgagtacgtttttaggcctcgttttaaagatgataataatttgagagcataaataataatattgatattgaaaagctgaaaaatgatttaagaacatacaaagaaaataatgatgaacaaagttttacaaaagacgcgccgtctagtagttggtgcctgtgcgtagagtttttctttaatcaacaatataaatagcgtttgtgctaattacttgaaaatctgtaggagcactggagatgatgatgtggtgataaagattctttactgtgggatctgccactccgacctgcacagcatcaagaacgagtggaagaacgccacctacccacttgttcctgggtaattattaattaagcaagctagctttacaaacaggttttgtacgttgttacatactccctctattccaaattgatctacatattttataggtacacaaaaaccaagaaaaattaataactctctcatactatatttactctaacaacaaactcgatgcatgtaccatcaccactattttctaactaatagcaaattaagatattgcatgtgtgttataaatacttgtgtgcatccatgtgcatggatgcacgcatcaatgcccatttactccaatgcataaataacgaatagacttaatgaataaatacaaatatgcagataatttaggaataaccttaaaaaaaaactatatgtagatcaatttggaatggagggagtacgatgcattattctgaattaattctgatcaaacaaacatgcactcgatggcgcaggcacgagatcgccggcgtggtgacggaggccggcaagaacgtgaccaagttcaagggcggcgacaaggtgggcgtcgggtgcatggtgaactcgtgccactcctgcgacagctgcaaccaggggttggagaaccactgcccaggcgtgatcttcacctacaactccgtcgacaaggacggcaccgtcacctacggcggctactcgagcatggtggtggtgcacgagcgcttcgtggtcaggttcccggaggccatgccgctggacaagggcgcgccgctgctctgcgccggcatcaccgtgtacagccccatgaagtaccacggcctgaacgtccccagcaagcacgtcggcgtgcttggcctcggcgggctcggccacgtcgcggtgaagttcgccaaggcgttcgggatgacggtgacggtgatcagctcgtcgccggggaagaggcaggaggcgctggagcggctcggcgccgacgcgttcgtcgtctccaagaatgccgacgagatgaatgccgcgacgggcaccatggacggcatcatcaacacggtgtctgccaacattccgatcgcgccgctgctgggtctgctgaagcccaacgggaagatgatcctcgtcggcctgccggagaagcccatggagatccctcccttcgctctggttgcttgtaagtgcttaatttgatccggatccattacagctagctactagctagctagctgctctgtgttgtgatccattacattctgtctgtggcatgcatgttgcagcgaacaagacgctggccgggagctgcatcggcggcatggcggacacgtaggagatgatcgacctggcagcgaagcacggcgtgacggcggagatcgaggtgatcggcgccgactacgtgaacacggccatggagcgcctcgccaaggccgacgtcaggtaccgcttcgtcatcgacatcggcaacaccctcaaggacgccatcgagtgatgcgtccggtccggtcactgcttaatttatctctctgtccattctggaaccggccagactgtctaatcgaacgtttgattagaaaatgaacatttaaaataactttcgacagaaaacggaacagaaatctgtcggatttttttccaccacaggatacgtacccaaagaaaagattaggcctcaagggctgcaggaa

SEQ ID NO: 46910 - DNA, 1316 bp, Oryza sativa
attaaactataactacactataatttcctctctcttttttaaaagaaatacggcaggggaggcccccactgttaataaattttattaataaaaagagaggtataaaaatattacaacatagcaatccaattgatagctgcatctttgtctctctcaataagacgaaacagcagaaggaggagatcacccttaaatagctgcctccaaagaggagattttttagtaaaaaatggaaccattcctttgcttccagatgtttcaagccccatatagaaacttctccatgaaacacttgccttggtaactattctttgtatgcagggtagtgtcccgagagatacccagcatagcctagtagaattgagcaaaaggccattggaagaacaaatgcaacagatcttccagaatatgagcagaacaaagaacacaattaagatcgcaattgggtggcgcacaatgtttgtgatctaggtattcagtctattcatcagcagcaaccaaccaaagactttaactttagaagtagttttgcacttccataaccaaaggaaatgagagggtggttgtaaagctctgaagttaagggcataaaatttctgagaagaatatttcagattacccaaaatgtaaacccaaacatcattatcctgagaaagattgacactctccaaaagagttaacaagggttgcaactcctgaaaagcttgcgcaaaaagaggcagatgaaaattttcctccaaatcaaaaatttctgactgatatctttgcattagcaacataagagaataatctttacatatggaaagacaaaggaggtttatcactcaaacatcttcccaaaaatagcaagcgacaccatcacccaccatacatctagcaatgcccatggaaagatccatcagtttgcaaacatctttccaccaaaagtaacctttgagattgctcactccattcccataataagggttccaaattaaattaacccaaggtagatttttttctattatagaacttgtccaggtatttcaagagaagtgcctgattctgtatagaaaggtttataacccccaagccacccttattttttggtatgcaaaccttgcccgatacagccaaagattttcggttacagttcacatcagaacccctctatatgtaataccttcttgccctatcaatactagtaatatgcatgtgctaaacgctacagtgcaattatattcatctttaataaaaccttagaatggattcggatgtcacgaatagaaaaatatatagagtataagaaaatatattttccgcatgtcacaaattct

SEQ ID NO: 46911 - DNA, 1670 bp, Oryza sativa
cttttgacttataaactttgtatctataaactttaggtgtataaactttagatgtatagaaatactatatatagaaaatatttgaattcaaattcaaatttgaatcggatataattcaaattcaaatttgaaacttttgacttgtaaactttaggtctataaactttagatgtataaaaatactataaaaatatttgaattcaaatttaaatttgaatcggatatataaacttttgatttataaactttgggtctataaactttaggtgtataaactttaggtacataaatttactaaaataggaaagtaatgcggtgccaaaaaatgaaacatggagggagggaggggggagaggtggtgatcgctacccgatcgcggtagcgatcgatcgcgcattagagtttccgcgttgttttgccgcttcgacttctgctatattttcatgaatagcaaccctcagtgacgggatttgaacttctataggtaagatcgcttcccctccaaacactaaagagtaaggagtcattccggtcggcgtgcgtgttgttgttctatatgcccacagggcctcgagcagcttatcatgccagtctcgcttattctttgtaaccactttcttcaaaagtttacagagagttttattgaacgcctccgcttgtccattggccgcagtgttatatgctgtggagaaattatgcttaattttaaacttcgcgcacaacttttcgatcagtgcatttttgaatggagaaccattatcggacataatccgagaagggatgccaaaacggtatatgagatggtcctaataaaattttcaacattttcagctttaacctctttcaatggcacgacttccgcccatttggagaaatagtcggtagcggcgaggatgaatttatgtcctttagatgatggcggttgaatttgtccgactacatccattcccccacatttggaatggccatgccatgtaagtaggatgcaccagctcatgtggttgatggataaagtcagcgggtatttgatactcatgacattttttcgagaatttcatagaatcctcaaacatagtcggccaataataacctaagtgttttaattgatagtacaatttagatccagactgatgtgcaccgcaaactccagcatgcactttatttaaagcgtctacgacctcatcacccgcgatgcaacgcagtagcattccgtcgtatgcacgtcagtacaacgtgtcattaatgcacgtataacgagtcaccctttttctaattctagatctttcggatgcttctaaaggtaaatatccgtgcaataaatattccaggaggggagttctccaatctcctgcctctatttcgtgaacatcggttatcatagctgccgatggaatttcttcctccttttcaatgagtaccggtaatactctacgctgctcaacttgaatgtccattatttaataagaattgactgacatgctagcagccaagctggttagagcgtcaactctctcattttacttctaacaacatgttcgatatttagatttgcgaacatggccatgagttgttttgctctcgtgaaatactccctcctttcctaaatcgacgctgttgatttttttaaacatgtttgaccgttcgtcttattcaaaaacttttgtaaaata

SEQ ID NO: 46912 - DNA, 1450 bp, Oryza sativa
tttctatcgaacttatttacttctgtaaagcaactcaaaaccaacaaccaaacctttttttttgggtgttacaatcagtgcctcatattcagcagcattattagacactgccgtcgttaaagtgaacgaatatggaattatgctttcgttgggtgtgacaaaaaccacacccgcgcctgcccccgaccggcgacgcgcgccgtcaaaatacattttccatgatgggttaaaaattgaggtcgcaaatacttcctcgtcaggtaagtcgtcatcaatgggaaactcatccggaattggatgtgcagcgaggaagtttgctaaggcttgtccttttattgatttttgtgggacaaatataatgtcaaactgcgacaaaaacatcgcccatatagctaatcttcctgagaggaccattttactcaatatatatcagaatgggtccgcccccgacacgaggtgtatggtgtgttctagcatatagtgccgaagtttttgtgctgcgaagacaagcgctagatatattttttccacgtctaaataattgcattctgcccccactaatgtgcggctgagataatataatgctgtcttttttccatcatcattattttgtgccaacagtgcacctagggaggtaggcatcgcagccgtgtatagtatgagaggccgccctttaactggagcacttaaaactggaggattaattaagtatcttttaatatcttggaatgcattttgacacgcttgatcccactgaaatggaactccttttttcatcaggcgggaaaaaggtttgcatctccctgataaatttgagataaaacgcctaatatatgctaagtgaccctgaagacttttcagcttatgtaggttcacgggtggtggcattttcactattgcttgtatttttgtcgggttgatccgaattccttgtttcatgactataaatccgagaaattttccggacaatacaccaaatgcacatttcatagggttccttttgggttcgtgctttctgagggtctcgaacactatggctaaatgttgcagatgatcttcttcgcgttttgatttcatgacgatgtcatctatatagcattcgacaatttcatataataacccgtccaagacgactgtcatggcgcgctggtaagtagccggtgttttttaatccgaagggcatgacttcataacaatatatgcccttaggcgttcggaacgcggttaactcctcgtcctccggtgctaattttatttggttgtatcctgaaaaaccatccataaaggagaatatttcatatcccatagtggcatcattcagaatttcggaaatgggaatggggaagtcgtcctttggacatgctttatttaaatctataaaatcaacacatacgcggatctggttatttttcttccttacaggtacaatatttgagacccatgtagggta

SEQ ID NO: 46913 - DNA, 1426 bp, Oryza sativa
ctgcacccccatcacatagagatggtccggtaagggtgtcatatcccatttgctttgctagcggatggcctattcattatacgaaatattggctcaccctcctttctccggttgcttggtatatattggtatattttccggtttgaagacgattcaccataacttccacttgtgacgaaatgttctgttagcgactttgcttttggtttctgtatcttttcgatgggctcaatgtagaatttagcatccgtgtaaaaggattcagccaccgtgaatggcctttcatcggcgaaaattctcacagtttctcctgatttatccttatatttgatgcacttatgtagagtagatggcactacttggttctcgtgcagccatgggcgcccaagtaacgcgttatatgaagtagtggcatcaattatacggaaggtcacataggtggacaatggttccagttttaggaccaacgatatagtgctcaaggcttcttggcctgcttggttgaagccgtgaatgactacatttgaccggtttaggtccctctccttgagtaaccgatctggttctgtaaaaccatagcatgcatataataatttcataaagcgctttggatgaagcacatgagtacgtgaatttttctactaaggatatgtgcatttatctccttttttttttgcatatttgcggtctacatgttggaactcagagatgaggggagaagtatgtcccaccgggcgtgccagaatctgacgacgggaaaaccgggacagtcgtaatagtaggtctgctatctacaaatcattacagacaatttgatttaaatgcaataaataaataaaaatcagaaattgcgagtccattacttccagaattcatacatttacatagaaattctgttaattacatctccgtagagaaaacccctgattaggaattccaacatgaaagaaaataaaattacatgaccgctaaaaggctaaaaaggaaaatctatcctaaagctccagatgtcgcagccgtagaatcttctgtagatttccatttatatgtttattttattttgggcgtccaagtattttagatgcccactaatttgttggtttttaatatcactgcgtgtatggtagcaaatttatacatagcttccttgtttggcattgtgactttattttttcctatatgtagcacgcatatataaatttttcctgagcactcgcggggcgtagccaaacgagtatttattttagcgccattattatcaacatgtcactggattttggtgcggcacattgcattgcctattttgattttcaccacacctgtattactactagcatggccctgtaccatgaagcgtaaccgaagtgggtatttgtttgatttatggtcgactatcacgatgtcgccacttgttgtgcgtacatgg

SEQ ID NO: 46914 - DNA, 4959 bp, Oryza sativa
  unsure (1)..(4959): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtagggtgtttaagagagttttcactaaaatctactcagctcttatcactttcttaatctaatttgtgttttcttgactgtcacgtgcttgaagaaaaatatcatataatccatccgtttcataatgtaagactttctagcattgtccacattcatatagattttaatgaatctagacatatatgtctagattcattaaaatctatatgaatgtgggcaatattagaaagtgttacattctaaaacggaggaagtagtaatttcttatatcccactctaagtttacaagtttacaacgatacttttaatttgcaagtcattgttatcttcatcttccacctccaaaacaccactattgattgaattagtgttcattggtgaagttgttgtcatttggtgattgggttgcagaaggagtcgtataagaaatcttttaaaaaatactagaatgctaacttgaggtgatcataatcctgattgcatctcatgattttttagaaaaatatatatctaggcgaattcttacaagcgaattcttacaataaatttcactttaaaccgtataaccgttgttgcaacgggcatattttccagtaaaattaaaaaaaattcgccctactaatatcgttgttattgttatgggccgaaatccatgggctggcaaatatactcgtggagaagatcgcccaaaaataacctaaaccgagcacttgaagcgcaaaacggcaaaacccaaaactcccctgccccatcaccgccgtctgcccgtcttcatccacccaaccatggccgccgccgccgccgccgattccacttcggcggtgccacccgccgtggtgtccgccgccgaggacaccctcgcggccgccgagtccgtcggggaccacctcgccgagatggtcgcggcggcgggcgaggaccccgacgccatcgccgagctcccgccgctgcgccgcgcgcgcgcgtttctcgccatggcgaaggccgccgcctccctcttcgcaggcaggcagctctcgcggtgacccccttcccgttatgactgcgtgacccgcatcgcttctgaccaattgtttttattactattattattattgttgcagtgcggcttaggtgttcgggagttgatccggatgaacaccctatcaagaaggagtttgtaagctctctctctctatatatatatatatacacctgcctagaatcctatctacttctacattgttctcacattctatagtagtagaaattcggtttcagatttgccaataagaacaaaagtttgggtgtatccttatataggtttctaatttatgttaacaatttctaattgggaatctttgtaccatgccatactattgtaaagaggagtcatggacttattttataccctgtttttagacaaaggcaaaccaccctgctttcatcccaagcaaataacgaggttcggcacagtagcatcagagaaaaggaaaaggaaatagctggttttaccagtgccctataaatcatagtaataactagtaagttcaatcttacaactaccattatcaaagcatatcacacagttaagtcacccctacagctgtctttaaagtggtggactgaaagctcatttagccagctcgtttgctcggctcacagcagccctgattatactcgtttatattccacaataaatcagtcgatgttaatttttgaaagtagactctcaaggagggattgattggactaggatggcgcaatctttattctttaaaggtgatatctcctgattatgctctggaggccgcgaaaccaaccagccataaatatatctcactcgaaagaaaccatgtagttttgcatgccttttcgatcttgtttgtactgcatgtatgctcgctccccttgcatccttccggttcccacatgcaaaatcacatacaaaaactgtttgcaccatagctcagtggaaagatgtcgtgacggtggataccctcctgtggcatgtgcacaagaattgaaagaaatactcaaataatcagtaggataatttgggatgtatcagtctgatcgttatctcatttctaaatttgctacaatgataataaatcaaaataagtaaaacacggtgcaaaactaagaaaagtaaagttgatccaatatactccctgatctttgaactcttgtagccattattgccctttgccctttgattacttccatattattttgcctttcttgatgtagcaattacctccagttttgcgtattggaatttagaaagaatgtgtacgataagttcctgcctgaggaaaaggctgctttcaatttccatgatcccttgccttatagattgtaaaagaaacagctgcaaaagaaaatagtgtaagatgataaacagattcacccccatttttcattcacatatataaggtgctagaggtttggcatggccgtgaatcccaagcaactagtgagcatattacataaaacttacacaatagaacactaaaatagcaggcacaagagcccccaagtacagttaaccacccaatgcaccatttaatgcataatcggggtggctacctggcgcctagcacctagggccaagttttgaacacttcattcacttatacaaaagatgtcaaatagaagttgacatcctgtcccactcgagagcctctatagtaatccagacaaaggtagctaagagacaggatgacaaaatattaataccatcctccatacctgaatacagcatgcactttcctggccacaaaaggaacaaacttacttccatgggatattgctttaacaaatcccttcattcttgtgtttctcacacaccaaaccaatttttttttcagtatagccatctaggaattaattttactgatctgtccagggtgtagtgagccacatcctgttcctgatcaagctgatcaggggataacaagatgcaaaagctaacactataatatactggattttcactttgtgcacttcttcccaaacttgtgtgcctcccataggatcagtgctgaataagtttttcccttgctggtattgtgtacttccttttatcctatctaatatctgaagcaacttaactgagctaccttctataatcccatatcctgatattcatacttagtaggcacaaattgatgatcctgatatttaagactaccactctacaatcctttggcagcttgaacattaaatcatccatgctctatgctcatttcacgaattgttatccagtttttcacctgattttggctagagcttgtaggtttgtaattccactcgtttatcctaacttctaatatggttttataactttggtgttcctggggcagtaatgcagttaaagattgaagtcttggatagggaagatttgagtttattcttagttagaaattttgcatggaacaatctaaaatggaaaatccaatcaatatgttttttcaattccaatgctgatactgtcagatgtttagttccacttctgcttcatttatttcaggagaggttaagcttgtgggaggaaaagttaaatcgatttgaggactgggacaagggtacttgacaactcattaactattggtggaaatatcatatctatgcacacgtataccaaattactgcttgtgttctgaattgcagcaccattgcgcccaaccactacagtgaatacacaggcagcagcaaggttcattggtcactcattgccccatttgacaactggtacataattgtttattgaaagttttcgaacggtttggttttttatggtgtagtgttgaggtttcatttgctatttcagatcagaagaggagcatgcaggcaatcagtagaggagaaggagggagttactctgggaacaagagaaaaccacaaccaccgcggccaaataagaagtctgttcgtgctgccacggaagaattccttgcaaaagcagctctggagcttagtgggcataatgatagcaaggtgaagggccctattaggctcctctctgatgaagatgaggactaagattgtgtattgttggttttatccagaggtattccttgctgcttccttgcattcatgatttctatatcattgcaatcaaggtctgaactggcttggataagggtccagagccctatagggcactagccctctagtagctctagcagggtctccactaagagaagctctgaggcttagggctaactttagagatttgattgattgattaataatagagtacatactaccacaccaaaggaaataatgtctaaaattgtagaccaaccaatctctatctctaatttactatcagagctcatttatttcctaactagataatcgcctacctttaattgatgtttttcctaatctgttatgcctaacctgctgcatgggcctggcccatgtctataacatattgctccatagtgacaatatgatgtaatcacgatact

SEQ ID NO: 46915 - DNA, 7889 bp, Oryza sativa
  unsure (1)..(7889): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaacatcccagtattggttaaatgcctctaataacacagcatcagaacaaatttctacatccctacccactctcttgtcccagaaagtcactctaagctcctgcgcactaccacggatgatttcatcatccaagtccttcatcaaatctatcaagcttattgtgtctttatctacaacccacttatgtggagatgatacatgataatcttggctaccattatccatatactcaacataagcaacaaccctaaccacaactctgcatgcagagttcggatccatcctacaatgcaacggcaaatgaagagaaaaaggggatcccaaatcagatccaccaaaccatgcatcctaatgcatcccaatcgaatcaaagagaggaaaaacgaatcaaagagaagaggaatccaaacttaccctttcggaatccatttcggcattggcggcgctgccgccagcgcagattccaccgcctcctacgacggtgaagccatcaccgccggtcaaacttgcatcccaccagcgacaatgcctgggcacagccagtatcgagggtgacggaatcggtgggaatgggcactgtttggatggaatcggtagagctagggttctaccacccgtactgcttgcgagtggataagaggagataaggcgcaagggtatttacgtctgaccgtgtcaaaaaacagcctcccgtcagccacgtcagcacggcaagtctacgctagacggcgcggtgttcatcaacaaataaccacgattatgggatgtctttccccaaagcttcactttcgcggtgtccctgagctaaatacacataatcgcgatgtcctgtagcaaaatttcccaaaaaaaaaatacatccagaatgcatgcacacgaaaatctgacatatctggagagaatataggagcggctcgggcggcgatccgtgatggcgagctcgccgttcttgccgtacctgaggcggaacgtggtcatgtgcagctcgcacttgtcgccgtcgccccagcaccgccagtatcggggccgctctcacgacctgccctcgacgaggcagaacttgccgccgccgcccatagggacgagcgtcgcgtcgtcctcgactgtcgaggtcatcaccaccatctcgcacagcttccagttgggctcctcctcgtggctcccggcggcgacgatgtcgcaggagcagagtttgccgtggcggtgagagtcgcaatggaggccgacccacgcgtcgagctcgccgtcatagtgcgcctcgccacggaacggcagcagccagtcgccgtggcgcgtccactcgccgcgctcggtgtcgtaggagaaggtccccgccatcttcttcgcctccgcctccgccgcctgcgcggcgacgtggtcatcaccgtgcccggggcggggcacgctccaattctctatggagacgaagatggcgctgcctccggggcgcacggcgtgcgatgtgatccggcggtgcgcgtggtcgttgtcgaacgggaccggcgacgggtcgtggctccaagaccaccgctccgtcgccaacggatcctcttcgaggcggtgcatcgccgcgtcgatgcgagggcggcagtccactgaccggtcggacggcgtgaacgcgtacagcttgttcccggcggcgtcccaccgctccagcgcctccgggaggcggtgcacgaaggcctgcgccgccgtcttggtgtcgtacacgacagcgaggccatctttgtcgctgaacgggtagcccttggccacgatgttgctgcccagcgcggcgaactgcgcgctgctgcccatcatcttcaaccgggagtgcacgtactcgaatcggacagccggcgccggaagacgcctgtaggtccgtgccggcagatagtccgtggcggcgacggtgacgagctgatcgtctgcgtcggcctcgttgccgtcaaggtccatcttgtgcacgctgaatcccctgctccagtcgtcgagcacaacgtacaggtgctgcctttgcggcggccaccagctgcgacgcgaggacccctcaccgttgttcaccgacgacgttgttgaggtcgtcgtcgtcgtgggtgtgggtgtggagacgacgaagtcatcataatcgtcatcgtcgtcggtgtaactgtaatcatcgcaatccgtgaagtatctccgtggtgaaaggagcacaccgcctgcgccggccagagcagccaacaacacagcgcgtggatggtggcttgcggcggcacatggccggagatgacaattagatcggcggagaagcgattgcagcattcgaattttttgcacccactctcccgaggattccggaaaggtaaaacctaggtgtatatgactcggacctatatatagcggatggaaattttacagcactagaaaaaaaatgcttccatgatatgagaatttaagaaaatattgttggcaactttttttgacaagttgacaagcacgatcgcagcaccttaagctttgcggtgatcctagagtcgccaaccacctcgatctagcaaagagctaaacctagatgtgttttgataactaaaccggctagcggagccgatttctagataactacccgtctcgtgggcaaaacggaaggttttcaggacaaacctacaaagagatgtcgcactctcgcagcggcggcggacggtttacggcgcaaactgacaaagatggacaaactaagagaaaactaaaagcaatatgaaaaaacgattcgattgattgattgtagattggttttttacaatgaaccggccatgtccattatataggggttggtcttgccctctacaggctctcctccaagtccaactccgggtagaaaccaaaggaaacccgaaacatgccttcccgagcaaggaaacctcaagacccgacgaaacacagtcggactcggacctgccggtcagaccggccacacaccgccggtctgaccggccctcaactggcagtctgaccggccaacacacggcggtcagaccggcccactcggaggaaaccggtagatttccaaattttggcaatctttcctattttaatcctaggtgccaaatttgggtgtaaacacatgccccctgccttttttatgaacaacgtgaatctaaaagcatagaacatgttttggtctaaggacgataatccaattaccggccatagtacctcctaagcgtcttgccaaacgctcgggaagtatttcttcaagtatttcccgttgattgctcgctaaaaacgctccccttgaagtgtctctaaaaaatatgcgttccctcgaacaatgccgcatactcgataaggaccctcccaactaagagaccacataccgaactccttggatcgagtacccaaaggcaaaattgtcttccaaactaagtctccaactagaaacaactttgctttcacccttttgttgtacgccttagccaccctcttcttctctttctctatttcttccaatgccttcaagcgcttgtcgatgacttcatcaagattgtcttccatcaacgtcttgtaatcttcacttgacaaaccatcttgcttgatataacgaagagaatcaagatttacttccaccggtaaaacggcttcttgaccataaaccaactcaaaaggagcgactttagtggcatcatgtttagaaatcctatgcgcccacaatgcttcggaaagcacctcatgccacctctttgggtgttcctcaatcttcttcttcactgatttcaacaatgtcttattactcgattcgacttgtccattagcttgagcgtaataaggagaagaactcaacaatttaataccataagattcggtaaaactcttcacttccttagacataaaagaagcaccttgatccgtagttaatgtttgtgtaataccgaatctatggataatatgcttcaaaataaagtcaattacctccgtatgagtcatattcttcaaaggcatggcttcggcccacttggtgaagtaatccgtagcaactagcacgaacatatgcccctttgatgacgaaggataaatttgaccaatgaaatccaaagcccatcctcggaacggccatggtttgattatgggattcaacaaggcggcgggcgccaattgaacattgccgaaccgttgacaagcctcgcatcctctataatatttgaagcaatcatcaatcatcttcggccaatagaaccctactctcctaagcaaccaattcatcttgtgggccgattgatgagttccacaaattccttcatgtacctctcccatagccactttagattgatcttcatctaagcacttcaacaagacaccatctatatttcggcgatacaaatctccatcaagcaatgtatatttgaatgcttgccgccgaattttccgatcaaccttaagtgtaggatctttcaaatatcgaatcaaaggaattctccaatcctcttctgttcccttggcacaaatgtccgaattcacacttaattcggcctctaaattgattgaagcgtgccccccagcgctctgcccagaaccggtcagactggccacgcagggccggtcagaccgctcggggtcgccggtcagaccggcggcatgcggccggtcagaccgcccctgctcaccggtcagaccggccgtgcaatgccggtcagaccgcccctggtctccagttttgccaatttcgcacaaagatttaaaatcaagcaccggctcttctaatatcagaaataatcccttcttcacattatagccagatgcttgttgtgacaagtcatttgctctagaattatcatgcctagcaatatgtctaatagcaaaattatcaaaattggcaataatatctaaacatgaatcgaggtacctatttagtgatccgtccaagcatttgtagactccagcgacttgttgcaccaccaattccgaatcaccaaaagcctccacgtatttagctccaaccatctccataacttgtaagccgaataatatagcattgtattcagcttgattatttgtacaataatactccaaatgaaccgatgcttcatcacacatgccattaggtgaaaacaaaactacccctatgccctgaccttctttgcaagaagaacgatcaaaataaatcttccaaggtataactttaactaagcaaacctctccctcatagcaatatctatatgatggtctactataaaatcacatacaatttggcatttcatagatttcaatggttcataaggcaaatcatattctatcaaagcatatgcccacttgccaattctcccacttagaattggcctttgcaacatgtgtttaataacatcggcttgacaagtaactatgcatgtactagataacaaataatgcctcaatttgctacaagcatagtataaacatagacaaagtctctctataaaaacatacctcgtttcggcatccaaaagagggcggctcaaatatgtaatgatatattccttgccatcttcctcttgcgccaaaacggcaccaataactttgtcttcggaggcaatatataaccgaaaaggctttccggctttaggtgctcgcacaacgggtggagtagacaaatatctcttcaactcttcaaacgcctcttgttgttttgccccccaagtaaaatcggcttcttttttcaaacaaagtataggaacaaaagcatcgattttacccgctaggttagaaataaacctcctcaaataattcatgttacctagcaactttttaacctccttcttacatgtcggcgctttgaaatcacgaatcttttctatcttcttaggatcaatctcaactcctctctcatgcaccatgaatcctaagaacttccccgccgacacaccaaaagcacatttaagtgggttcatcttcaaaccataccggcgcatcctctcaaaagctaacctcatatcggctatgtgtcattccataccatccgatttgacaacaatatcatcaatgtagacctctaagataatacctagcaaatcatgaaagattaaattcatcgccctttgatatgttgcaccggcgttcttcaacccaaaagtcatgaccacccactcaaataaaccaacaaatcccgggcaccaaaaagccgtcttgtacatatcctcttccgccataaagatttgactgtagccagcattaccatccaaaaagctaatcaccttatgacccgaggcacattaatatcatgtcggctataggcataggatattcatctttgggattaactttatttagatctctaaaatctatgcaaactctaatcttaccactccccttcttctccaccgcgactatgctagagacccactctgcataacgacacggcctaataaaccccgccttcaacaaccgatcaatctcctctttgactcggtcatatagcaaaggattaaaacgacgaggtggttgcttataaggcctaaaacccggtttaattggaagccgatgctcaacgagctcacggctaagacccggcatctcgtggtactcccatgcaaaaccatcaacatactctttaagtagctcgattatcttaaccttataatcggctctcatgtttttgtttacgaaagtcggccttggtttagtttcatcacctatatctacttcttccaaaggatcggccaatgtaaacccttttccaagcttctccacttcatcaaaatcttcaacagtttctccaatatcgttctttgtagaccgatattcttgcaccctcttttgtaaccactctaaattagcctctttactcattatacaaatttatatggcttagccgtgctacactagccggctttacagagataggtacaaatttgccatcggagatactaataaaatcatagctagagagatcctccccgataagtattggatattcccatgacaccactcaaaagtagcatcggccattgcaacctcggctgatgtatccgcttgaacaatttcaacatcatctccgtcccattgaattaaacattgatgcaaggtagaaggcacggaacaattggcatggatccaacaacgacacaaaataacattgtagttaccttgcacatcgacgatgaagaaagcggttggtagcgtcttgtttcccacggtgagctccgccgaaaagatacccttcgcctccgttggttcaccattgaagccattgagaatcatgttggtcttcttcaactcatcatcctcacgccccaacttcttgaataatgagtacggcatcaagttcatggcggcacctccatccactagcatcctagagaccggcttcccatcaacatggcctttgagatagagacactacaagatatgtgtggctttttgacgtatttaataagacacatgccataatgtcactatatcatataatttatgatattttatttcaggcatttcaacttaatgacaataaaaagttgtgtgtcacaataaatgtcatatagctagtctaatgtcatccagtgacaatatttagtatgtcataagacctatttgtgtgtcacaaattattcggcgacgatgaagagatgttgtgtccatgccgtcagtgtttgaatcgggttccccaatttaaaggacgggtgcatgatcacttgcatattcatgggatggctactgcttacactagatggatacatcatggagaaccattggaggttgtaccacatgaaattgatga

SEQ ID NO: 46916 - DNA, 7160 bp, Oryza sativa
gactaagggcattaaattggatttttgagctgctactattcatttaacttttcacgtgcttttagttaacttctttaaaaaaaatatgcttttagttatttatttttctatttgtatgtaatttcaaaagcaaaccaaatttaaggatgtgccaccaactgcgattgatattttcaaggacacccactgcagtagcaagtcaggttttaatgagaacgcaaaggatgccattgtgagtacctttccctatctggttactatgaacaacacaatagattactacatatctccatatggacatcagataatacctatatatattctggacactatcatagaaggttttattccaatcatttcatttcttccactaggttgcatttctatatggacatcattacacatatattgttctgggtacacatacataactagcatagaaaatctgattttttttttggttttattgttgctaggctcaaatggaggcctatgttgctcaaccaacagaagaaggcaaagatccaaagactcctgttgaagctgtagctcatgttctgccaaaatcaacttttcttcgcaatgttggcatgcagtccacagagatgaagaaaaatgccaaagctgctgcaatgaatgatcatgtacgtgagctagagagtgaattgcatgctgagaagatgggatcagccagaatgcaattgcagatagctgatctacataagcaattagaggaccagaaagaggtagcaaggaagaatgaagaagaaactgagaagctgaggcatcaaggaagtgaaatccaaagcttccttcgctccttgtttggcagcaagtttgcatcatcagatgctcagcagtaagctctcatactcaattaggttctagatgatattttggtaacactgaacttgcaaccattgtgattgtgggatgttattttggtgctgttgtgcttctggccgttgtgctgttgctgctgtgcttttggccattgtgctgctgctgctgctgtgaagctattgcaaatatgctgttgttgctctcaatgtagcaggaagatgaaatttgatactttggatatgtattgaattagtggatagatgtactgatattgaattttaagacttgtggaatgtgaaatgcatgtgacattgcaatcatttgtggaatgttaattcatttgaatctgattttgtatgtgctgaaatattgtatctgggctgaattgtatgggctaaaaaaaattagttgagttatgtgggctaaaaaaattatatgggctggaaaaatatatgggctaaattgtaggggctggaaaaatcatatgggctgaattgtgcgggctagaaaaatcatatgggccgaattggtgtgggctgaaaatttgtacaggctgcactcattaaaaagaagcaaataatatgctgggccaactagaaacaacccagaaaaaaaatatttgtggcccatgagctacatgggctttagcaggccgaatcttattttgtgacgttttttttcaaccatgtcaactgccaagtcagctgccacgtggcaagccctaggattttgtgacaataaagcaatgtcatatgcttgtgacaatagatgtacaaacgtcacatactaaatttataacggtggctttttgacgtttgaaattacgtcaaccgtttgtcacaaattgtaatttttgacataaatttcacatattatgacataataaaatgtcaaaaagccacacacctcttgtagtgagaggcttcatgtgacggtttgactcatcgggcttctcaaaaaccgcgtctttatgacctaatgagaattgagcaacctcggcttcatccatagcacaaaactccataggcaacatacataccatgttgatatccatgtcttcttctggagatgattcacctttatcaaccgattgctcctccttctcctctacaacaaccggcttttccttctctatggatttatgcctccataccgtggtggtcgtaactcattaaaccttttatctctttgttcttcggcttttttctctcttatctcttgagcccgaagacgttgcaaccttctcttttgagtagccgtcaaatccttaggcatccacctaggattcggctctgttccaggaggtaaataatgtcctctattgattttgcttagagacgatgaagccctcacatcaccctttgcaatcctcctatcaaaccggcgctggagcccggtcagaccggacgtagaccaccggtcagaccggccagatgcgcctgtcagaccgacatttggtgcgggtcagaccggcctgaagcgtcggtcagaccggtgtcggttgggcggtcggaccggcctgatggcccggtcagaccaaccacatggctgcggtcagaccggccagaggacccggtcagaccggccgactgcgatgagctggtatcggcttcggattttttgtttggggacactccaactccatctccagaaggtattggcacatcatgagaccccactttgatagtaatcacctccgaagtcctcacctccaccttgacgcgctttccttcccttttttcttcattagcccgattcttaccataaaaccggctattgtttggtgaagacaaacgctcatgaattggcctcctcggtcctccccacccttgattgaattgcattggaggcatatgattgaacattggtggcgtcgccccccatggcatgaagtaaggataaggataacccagcggtggcattggataagaaccccatgacatgtcttgtggatgatgatatgaaggggaatgtgaccgtcttggtgaatgaccaaatcgctccctaggaggtgatcttggtcttttccctttgttgcgagccctctcaccaccttgcttagctccactcttattctccttccaaacgtcaacctccggcttctttggcactatcatcttaggccttggttcgccaatgaccactcctttttccttagcagatttggcttgctccggccgaatcaactccttatcattgaaattaattgtgttcaccggaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatctaatttgtttttcttgtaaaagataatcaaaaatcttatcgcacttggccacatcaaaactatatttaacctcactttgccaatctttgcgaggagtcggcattaggttggagcaaacaaaaggcttgtttttgttagtccatgaccattcagcaacatatatatcatgatcaccctcctcctcactatcgctagcctcagggtaatcaatcacattaacattaggctttttgtcatatgttctaacaagttttttattatccttgacccggctttcttgagccaaagccatttgcataagttgactaacatcaagaaattgttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagaaaacaagcgcaatttaaaagtatcactattagcctcaccacattgcgccaaaaattgacctacatgctcccatgtggtcttaccatcctcaccactaaacttggtaaattcggaaactctataattacggggaaacggcacattatcataataatcaggatacggctttttgtaaatcctagcacgattcctagtttcaatcccgaatctattcctaataatctcactaattatatcctccatattattaggcccatgttgatttggcggtggatttggtggcctaataggttgtgtttgtggcgcaatatgattatgttggccttgtctaggatcgggaggataccccctagcaacatcattataagcattaggaacatgtgggggaacttggggactacttgtagcagtagatataggcggatcaaatgttctaagatgatacaaataactagcattagtcattggatctattccctgtatcggaataattgtgccggtctgaccggcccagggcctggtctgaccggcatccagaggcgcggtcggaccggcctgagtaccggtctgaccgccggggtaatacccggtcggaccggccgtttggccggtcggaccgacggctaagtcgcggtatgaccggccgtcaggcccggtcagaccggccgtgtgtgccgctccatcggtttttctacccgtttgatctataggaggttggttagcagtggtaaaggctttatcctttgacatgtaatcggccataagagggccgaatttaacccttaaaaactcatcaaacttaccctcaaaagttgcatctaacttatctttaaaagaaatcatagatgaatctattgtagatgctacttgttgttggatagattgtgttacctcatcattacttaccaaatcgggggcgagcttaggacgtggcccgggcttgatgatcacgccttgacgagtcctagtgcttgccctcatcaacgcctcccgtgtgagttcgttgatgtactcctccatagctttgtggtcctctccttcgaaatcctccaatgtgaccagtatcacattggatggctctacctccgtcttggatggcggcttcgtcatggcgaagtcgaagttgagttgacgatgaacggatctcctccctagcggagtcgccaaaaatcgtgttggcaactttttttaacaagttgacaagcatgatcgcagcaccttaagccttgcgatgatcctagagtcgccaaccacctcgatctagcaaagagctaaacctagatgggttttgataactaaaccagctagcggagctgatttctagataactacccgtctcgtgggcaaaacgaaaggttttcaggacaaacctacaaagagatgtcacactctcgcagcggcgccggacggtttacggcgcaaaccgacaaagatggacaaattaagagaaaactaaaagcaatatgaaaaaatgattcgattgattgattgtagattggttttttacaatgaaccagccatgtcccttttataggggttggtcttgccctctacaggccctcctccacgtccaactcagggtagaaaccaaaggaaacccgaaacatgccttcccgagcaaggaaacctcgagacctgacgaaacacagtcggactcggacctgccggtcagaccggcggtgtgtggccggtgtgaccggccctcaaccggctgtctgaccggccaacacacggcggtcagactggcccactcggaggaaaccggtagatttctaaattttggcaatctttcctatttttatcccaggtgccaaatttgggtgtaaacaaatatattcctaaaaaattaagaaagtttaaaaaaggaataaaaaaaggccactttgtaccccgccggcctgctagggcatttgcgcatgcagcccatgtaaaccacaggacccaatggtgctgcggcccaagaatggaggcccacccgacgggggatcgatccgagtcgttcattttgatggacggcacggattgatgctgaatccatcaaaacaatcgatgacaagaaccctaaccctaattcacattttcccctcccctccgccttccccactacccccatcaatgctctccctcccaccaccgttggcccctttcctccttgtcgggtgctgctgcctccccgctcctcgccatatatggccttaggaggcggtggcagtgcagctcgaccgagccaccgccggcagccactccgcgcccccttctcgttgaatctggccataggaggcagtggtggcagcttgaaagcgacagcgagggctgaagctcgacggtggcaagctcatactgctcatgtctctggtgaggtttggtgactggattttttgttcgatttgtgtttttttttcccattcaccattcttcaatttttgtattttcaaactgaattttaaagttgattttaagatattttcaatgtagtttctattttagtattaaattttaagtcgctagcaatacatatataaatgttttagctataaattaatttttatctccaaataagttgtttttttgacttattagagaatactgacaaccaatgaggaccttaatctgtgttcgacggtgtgagaaagtgaaaataaatcttgttttctgcatgcatgttacccgaattgataaatgacgtgttttttcaaaagaaaaatctgtagattttttacttaaaaatcatattaattcatttttcaggtttaaaatagttaatactcattaatcatattgtaatgacttagttttttgtatcttatcattgttatcttttctcatttactcaaacactctaaggttgtgttcggcacttagggatgggaattaatccctcgcacacgcaaaacggagtaactcattaacacatgattaattaagtattaatcctattttttgaaaaaatgattaatatgatttttttaaagcaactttcatatagatttagcagtttgaaaaaacacataatttagcagtttaaaaagcgtgcacacgaaaaaaagagagaggtgagatgggaaaacttggaaactaactcagcctaagtggtggtaattttgggataaattttaaacccaaaatagcagcttttttttttggaagggatggagtaaattagcgacctcatattttcgcttatgcttatgcttatcaaccaaaatttgaattttcaacctcaaatttgaagttaattttgaggttttttcatcgaagtttattttagatcgctaagaacacgta

SEQ ID NO: 46917 - DNA, 7264 bp, Oryza sativa
ccgaggggtttttagttcaagggggagaaaacaaagtattctgacttaagaagacattatacagattaaagcaaacacctagagcatggtacagtcaaattgataagtactttattcaaaaaggatttgccaagagcataagtgaggctactctatatgtaagaggctagatatggacattttaattgtctcacactctcactatatgttgatgacgatatataccagtaatagtgagaagatgatgcaatattttaaaaaggacatgatgaatacatatgagatgagtgatatgggcttgttgcactatttcctaggaatggaagtgcatcatagtactgaagggatatttatatcacaaagaaaatatgcagaaaatattctgaagaaaattaagatggataactgcaagtcagttacaaccccttgttgccaaatgaaaagcaaaaggcaagagatggtgctgataaagcagatccaacaatttacagaagcttggttggaagtttattatatttgaccgcaacacgaccggatattatgttattatgtttgcggcaagtttattatcaagatatatgtttagcccaagtcagttaaattttactactgcgaagagagttttgcggtatatcaaagggaccacaggttatgttatatggtacaagccagttaagaattaaaattaattggctacacggatagtgattgggctggatgtcttgatgatatgaagagcacatccggatatgccttctcacttagctcaggtatatgctcctggtcaacaaagaaacaaaatattgttgctttatcttcagccgaagcagaatatgtagcaacatcaaaagccgtgtcacaagctgtttggttaagaagaattatggaagacatagacgagaggcttacacaaatttattgtgacggtcaatttgcaattgttatcggtgaaaatccagtcaatcatgacaggacaaaacacattgtatccgggaaacagttgatcgctaggaagttaaattgctatcggtgaaaatccagtcagtcatgagcagttggcagatatatttgccaattctttatccaaagaaaaattcatccacgattgagaaatgattggagtatgcatgaagtgaattaacggggagtttgatagagttaattcacttctataaactagtaatatgcccgtactaaacgctacggtgcaatttcatttctctttaataatttttagaatttcatgttagcaaaaaaatatttttatatgatctatgcatttgaactttaattcaattcatatcgtacataaaatatatttcatgtaaagtgcagaactatgatattgcgtgggcacaataaaactttacaaggtgaggcccacatgtaagtgataagagaaaaactaaaaagcgtagggcccacttgttagccctattctccctctctatcctttcccccaaaaaaacagcagagcaagcggagacggcggcgatggcagtggtgcgggtgatggcagtggtgcggtggatggcgatggcggtggtgcgggctgtctgcggtgcattatccatttaagttgtatggataaccatataaaaaaataatccagaacaattttgtaagcatatatatatatatatatatatatatatatataatacagaccataattacaatctcaaatgacagcctagtgcaaactgacgcatctagtgcgagatagtatgtagaagataatcacacgacattccatataaaaggtgatggcgtgctgtacaaaacaagaggacgatggtgagtaacattccgatgagcaatttactatattctgcaatatttttttgaattaatttagatcatgcgaacctacctttgctcaccagtcaagaacatctttatacacgatatttctagtgctcttccctgttgaatcaacttctttctttggctttgccaaaatccttgttgttagccttgacacaccccttgacaatgcgacatataggtgaccatgtgaaaacacgggctctggaagatagatcccaacatttgggatggtttgtccttgtgatttgttaatggtcattacgaaactaaaacgtattgggaattgcttcctcttgaatttgaaaggtagagatatatcgtcggagggagacaaagggatccgtgggataaacacccttttgctggcatgttgtccaccaacaatctcagcatcaattgcattatcttgaaaagctctaaccattagtctagtcccgttgcacaatccattatttggattaaggttgcgaagaagaatcacgggacaattgatttttattattagctcgtgtggtgggagaccatttagagtaatagagttaaggtagtctagaggatagctattgtgagggtcatcatcaacagagtcaaagctgtgattaaccttggcctgccctggaaatctgtcaatcatattaacattcagcttgtccacataatcattttttgtggatacaatggcacgtgtgctcatataagatgcagagcttgcattctttttatcatcaaacgagggaaacacatgattaatcaattcgtgtactaaatcctcgctatccccataagcaatcacaatttcatcaggcaaacgaacattatcatttctgatagtgttttcagtgccatttccaattctaaggagatattccgaaaatcatgtatcagattgagccctatgttcaattattgatccaattctaaggagatattccatcaattattgatttgtttcatgatattgaagtatattattcaaagggattgtgactgtttggataacagggagaggcggtgatattttgtcacatcaaattgagattttaaatagcatccatgcattcaaattacagaaaaaacttgcataccatgacttataagcagctccttaatatgtggatatgcacatatacacgtaatagatatgtgacactatagttcacaatcacatccactatttaccagcaaatctacatttgtacttgaatagtattaccttctctgtcgtgcagtggagagggttccggagatcactttgtggtgtcgcagtagagaagggggcacaggggcaaggagtcctggtagttggcatcggcgatctggaggcgaaaatcggcgccaacatatgtttagtctatattggtgtaagcttgaatgaaaagggaaatgcaaataaaaaacatatgagcctataacatttcatcccaaaatataccactgattattgtctagtaatttgttttctcatccttctccaattcaatacatattagagcccaaccataattccataatctgaatctacactaaataacttgaggtatttattccaacacccagcaattcaaggtagctgcccatccagcttcttttacttagcattctactgataaaagaaaaactatcgtggatctctaaaagaaattagagctagcatgactaaaaatccgatatgttttattatttcagaattaattcttggcatgtaatactcaattgtagcagaaaatagcaacagatactgatcattcacgcaataacaatcacaattgaactgtatggtaaattgatatggatcatgtccaagaacccgctgtcaactggaatagaaaatatgaatgaaatgctaatacagggaaagtgctcagttcagagtgaggtaaaaacatgaccaggcagcatttttgggcagaacctcacaaaaagcaccggttgtcctactattcataataagaatatataatgtattgtaattctaaaacactaaccatgattctattaaagcggttgtcaacgtccatggccgccagtctccatccagactacaacacgcacaacagtaacagccaaaatccgtcaaaacaaacataacaaagaagtcagtctctgtatatggctcaaataaggggataaaatcaatattctcaaagatatatggctgtccttagagagtaatagaaaccctgaaaaaaaattgtcctatcaataaaacaggtaaaataatactcctacctgagaagctaatagaaaagagcattcaataatatacacggtcggcgtggaggggcgccggcggcgtcacgcgcgaaggcggggtgtcggaatcgacagatcgacggcggcgcgcggcggcggcgggagagggaaagagtggagcggcgacggttagggttaggcggcgaccggcgttgcgcggggtaggggtgaggagatgcgacgacggcggagaggcagaggggcggcgcgggagaggagagaaatcgaggagcggcggacgcgggatcgacggcgaactggcgttgggatgaactcaagtggggaggggcggcgctgcgtggggcgtcgggcatcgacggggaagcgcgtgattcgggcggagatgggggagcgcgattctggacggtgtttgcgtggacgatttcagccgttagattagatgattctggatcgttggatttgataattcaacaactcattttactcatactcatccatcattggacaaatccgatggcttacattcatctgcgttgattcaacggcaaagatcggtccttgtccacccgcacttttcctttccttcctcactctttcccctaatcactcccggatttccctttcctttccaaccgcgcacaccgacacaccagtacacgaccaaccagcccaacactgtcatgcttgtggcactccacgccggcgagacgccgccgccgtgtcacctgctttgacggctccgcttctttacgatggcctctatcgacgacgcagcttctccgcacgccgctgacatccacggcgagagtccgtcgccgacaccaagtctcctttgtcggatcgtctccccataaccgcgagtccgtctcctgcagccgcacctgccgtcgactgtgtggggatcgattttggagatgaacagtgggcatggcggtggccgtcgttcgtgcttggggggataccaattgcgagcagtgagcctggccttcctatcccatgggccatggcgccgctgattcccggaacagatacccggcggcgcccatgccgcccatctcctgacgtttgcttccacgagtccccacgcgccccagcccatggcgccctcctgtgtgttaaaaatttggttataattcgacatattttaatccaaaatattaagacaataaacatgacatacataattagaagcgatcttgtgataaggctaaacataaacatgagcatgcttaagataaaataagcatagccatcgttgacattcacataagattgaaatcctatggataacattgtgaacatgtaaataacaagaagaaaatcaaataaagttagaatcttatatccagagaatggtgcagaagatattgaggcattcgtattgcttccgttgatgttgtctcctccgttctctcaagtagaagccatggtgaaccagaagtagtggaagatgaaacgttgtcgtcgaagaacgaagaacaggagcagtcgcgcttcaagcgctacccaaaaacttgatcgcccacctacccgtgcaagttctcaagcggacggagtttcggaggcacctgctcgtcccgtacacctgtgcgcgcaggtgaacagaaccggggaaggattctgcagctcaggaacagaggaggaggaactcgaagtgcaagagttgggaagaacttctccacgtccttcacgtcgctgcagagtatatacatatatatatatatatatatacccatatgggactccatggtgcccgggctccaaggtataaaacacacaaaatctcttgaaatttttttaaaaaaataaattgtgagtatatacttaggtatatgaatttgattcataccaatacctaacaacaaaataactcaaactcaactttatttcacaattcattattacatacctagcgaattatatgctttgatgttatataactagaaccaaaatctaacaaaaagaaaagttcaaactcagttcaaacttgtttgaacttgttagtaaagaagttaaagttcatacctaaatatttaaaaaaaattcatactcattcaaattgggtatatactcaattttaatcttcgagcccatactccatgtagcaccagttaaattacctatatatatatatatatatatatatatatgtgtgtgtgtgtgtgtgtgtgtgtatgcgagcgcgagagtaacgttcggagtcatcaaccgccgtgtttaatttcgtaaccgacgcgctcgttagttcggaatcaattcacggcgtttaattccgtaaccgacgcgctcattaatacgaaatcaattctccatgtttattaccgtccgttacaaagtgagagagagaaaacagctgtagctgcctgcctcgcctcgtcccaccccacctggctgtccgcacaccatctcaaccggtcaacagagacttttcactagttccgtatttaagttgagacctcttcacatagatttccaaggtggtattattacccatagcacttaatgtgggccaatggaatttattaggatttaattgggcctaacccattaatctaacaatccccaccaaatttcatggctcacaagaaatgctctcgattctgatcctgtttgttataccagtgtttcggtggagacttttaagttggacatccacctaggaaaagagctacaccagatcacaactgaacagtggactatgccttgaattatcagtcttgtgcgattcaggtttcactcaaacccttaaatggtactggactatcgtttgcatcccctctgtttggagcatataagtcatactcctggccttttcatgagtatctagagatcaccaagatctcatagactgtgactagcagtcggactcatataggtatgttccttctaagatgttctgtaggccaacatctctgctttatgaaaagccactcggatcacattaaagtgtataccatcctaccatacagattagaagagaagtgcatcatgaagataggctcattttagggtctcttctctcagctacactatagtttgttttgccatccaaattcacgggatctccgatcacaatggacaggtttccactattgtccaactctaagtgggtctcaagcccatctccctcgatgcacagtctatcacattacgtggtagccccttggtaaactgatctgccagattttttgccgtctagacatagtcgaatgctatcact

SEQ ID NO: 46918 - DNA, 1153 bp, Oryza sativa
gtccacatagtgagattgcacaagtgtaatcccaccctcatctcctctcagtagtttaatgttaagaataacatgtgccactcccaaatccttcatttcaaagcttttggacagaaagtccttgacctcctcaatcacattgaggctggtcccaaagatcaatatgtcatcgacatataaacacaagatcactccctctaccccaccatagcgatagtacacaatttgtcagcttcgttcacaacaaagccagcagatgtaagtgtattgtcaaactctcatgccattgcttaggcgcttgtttgagaccatacaaggacttcaacagcttacacaccattcccttctgaccttctagtacatacccatctggttgatccatatagatctcctcctccaactctccattgaggaaagctgtcttaacatccatctgatggccgagtagaccatgagaggctgccagagcgagtagtactcgaatcatggtcaagcgagcaaccggtgaataagtgtcgaaaaagtcctcgccttctttttgggtacaacccttggccacaagccttgccttgtacttttcaattgtatcatcaggcctaagctttttcttgaaaaaccattcgcattctacaggcttgcacccatatggacgctcgacaactttccaagtaccattagacataattgagtccatctcattgcttaccgcttccttccaatagtcagcgtcaggagatgaatatgcctcttcaatggttcttgcagtatcatccacaagatatacaatgtagtcatctccaaaagactttgcagtcctttgtctcttactctttcgagttgctacaatgttatcctcctcaggattttcctcaagcgtttgatcaatatgttcttcggcacaaagtgctcaggggataaaataggttcttgactagaagtgctaggtgcatttttcataggaaattcattctaaaaaaatgtggcatctctggactcagtaattgtaccaacacgcatgtcgggtaatccagaatttactattaagaacctatatcccacactgtggatagcataaccaaggaacacacaatctacggtctttggtccaagtttacgctttttggctataggtacatttagcttggccaaacag

SEQ ID NO: 46919 - DNA, 750 bp, Oryza sativa
ctaagtctgagttattacaaaacgaacgtaatgttgtgcctattgctttggatactaatattttgcaggatctaagaacaacgaaggtaatgaggaagagaagaaagacgaagagggaaaaaaacctatacatagctccacgcatgcttgagaatgtttaattgaccaagtgcctacaatttctgaagatgagaaaaaaagtaatggtgctacaactgctcaaggtatgcatagttatgatgtgccaactatgtccactacttctgctaagttagagcaactcatagtggaaacaattgttgaaatacctttgtcacaaaacaaattgcttgatgtctcttgtgataaagaagagttgtgcgatgcttcacttatatccatgccacaactagtgaatgaacatgttagttctatagtagagccacctagtgttgagtttaaacatgttattcacattgcttgggagaatgaagagcttaaattgctatgttctttaaatacttggggatatattcattttgatgatttttgtccactcaactatttagagaagaaattatttgctagatttgaattgccatgtacttctgatgtgatttttcatgtcattggcaattatgatagtaaaggagaatataatgtgcatcgagtatatatttgtcctaatttgactatacctgcttttcatgatgaaatgtattgtctatatgaccgcatgcgcacatgtaattatctatctagttcctctag

SEQ ID NO: 46920 - DNA, 10814 bp, Oryza sativa
atcccagcgaggagacggcggatccggcgccaccttcgtcggatctggccatctcctggccggatccggccggagggtgtgtggttggtggcggacaaggccgtggcgcggcggcgcgtgaagggcggcagcaccggcgcgacaaggcggcggcaacggcgcggcgttggcagcggaggcggcggtgacgacgcttgcacggctgctggcggcagctgccgcggcgaggacatgtgcgcgggagacggagctcgcgccgccgggccgggcggcagcggggcgagcgacaacggcaacatggcggcgacggcggcgcgaggctcgacggcggcggtgccggtggctgccgcggttgtggtttgaggcagccgcggcaacacacgtggtggcggcggctgtggctgacggtgcggaggctgaggcctcggagctcggcgcagcggtggtgtcagcggctgaccggtgactgctgtggcacggtgggaggaggcacggtggtgtgttcggcagcagcggctgcggtggcggtgactgcggtcaccggaggcatggcggcctcggacggctagctgagggtgtggcagacggttgcatctggtcagtgcggtatcgtttggaggaggggtcggagaccggcttggcgcagagtggcgcagccgatggtagcggaggccggctcggcgcgagaggcgcgggcggcggagatggaggccggcttggcgtgagaggcgcggctgatggagggaggctagatcggcgcaagaggcgcgtccggtgaaggaggccggcttagcgcgagaggcgcggccggtggtggaggaggtgacctcggtgtgaggaggagttgccagtgggtgtgcgtggtcttcggcgctcgaaggctgaccagcggaagacatcggtgtaggggtcccacatgtcagtagagcttgagtggtgatggagcatcggtgcgtcagccgtggattcgcaggtggtgagcggcgggtgaaaatcctgagggcgttgtcgtgctgtctcaccccctaagggtggttgccgggcgaaagcctagtctttggcttctttgagccccgacggacggcggcggtggtttttccgtcgcttctctttttgaagacgtcgttttagcatcccctagggggcgatctcgtctgtgtacctttgttggtctagcggcggtcggtcacgcttagcggcggccggtccggtgctagtcttctcccgggttatgtgttggcgttgtcggtgtgtgggtggtggtatattttttcttttttcctggttacgaccctccagggttgtaatcttgtatttttagctttgtacttgatccacactagttgctctctattaatacggtgtactagaaatacaaatgaactttattcactaacatatctagaatttttatataggttatctaacttgtatatatatttttaaaataccctaaaaataacaagttaaaagcatacattgatcaaatgtgcatcacaacatactatcaagagagttgtttttttgtctttttccaaaagtttctttttgctatgtatatatccaggggcggattcactgttgggcttgttggagcgcaagccctagctccagcttctagccccaagtgttctcccaataagttcaaagctagtagaagacactgggacagttagagtatacatgttggggcctgcagcgactagagaggaagaaaacttgcctatagctctgcggtttgattagtgctcaatctgttatccagtgtttattaattgctaaatgctataccaagcccaattcaattaccaaaccggtgaggacaattaccaattcaattaccaaactggcgaggacaagacaacacagatattaccatctacaaggagctcttggtttgtatctgattagggcacattaattggagggtttaattcaactgagcatacatgtttttccaaaatgaaacatggatatttttaagttcatatttttcaggaaatatgatttctagtactgagttatatttttagctctatgcattagcaccatctctattttcatcttagattcgccattgtatatatccattacatattggccatgttttgaaatatctcatagtactcctcattcctctcgaatatgagggcatgttcatagtagtaccttcaaatagctacaagctgaaaaaaaaatcagataatccggctgcgttcggcaacaactgatcgagaaaaaaactaaacgttttgtgttttaccaatattttctgtaggaaagttattttaaaatttcaaactaatatattttgaatttgaaataattgatactctattaattatacgctaatagttcacctatcctctcaatgttctaattaatcctatgctgtataccgcacagagcaggagttttgctcagaatcagaaatggtggagtgtaacagtagtacgtacccggtccgtccatcgcatgcagaccgtatgtgctcggaaatgtacgtacggtgtatatatagcactagatatgctcactccacgcacgccaagaaccatacaagtcagtcactaccagtaaactccgttccatgcagtgcaccaccgtcatattatccccatgtgcttccatggccgtgcacgagcctcgccgctgttgcccccaactgcggccatgagcaaccacgtctccacgagcgccataaccgtgagccatggtttgcaagttgtggcttaacccaggaagaagcagccagcgcgtgggctagctagcttctggcgatgcactccatcagtcgcgatgcatgcccaggtgacggggatcgaggagagggaaagcaagcacacactactgggaagagtgatctttgctaggttggttgttttccacattaactaaatattatttttagtctcgattcatcccctatcagaggcttgtcaggaggtcgaggatctttagtggagtaaagatcaccactttagtcccggttggttagatctttaatcccggttgataataccaaccgggattaaaaatctatctttagtcccggttggagggagtaaatatttctctcccatctctgatcggttaagtcccagacgagactttactcctcaccgagatatttagataagatcaaatcatcccctcacctcctacccctcggatctcctcccctttctcctcccctcccctcccttctcctcctcccttcctcctctcctcccctttcctcccatccggcggccggcggcggcgggcaagcggcctgcggggtagcgcgcagcggcagctggcggggccgcgcccggcggcgactggcggggcagcgcgtggcggcgccggcggggccgcaggtggcaggcgctggccgtggcgagcagcatccatggcgggcgacagcgcgctagttctcctctgtcgttttttttctttcttttttttgataatttgtgatttatagatgtataattgatctgtgatgtatttgatttgtgtgtaaattttttaagatttgtgatgtatttgatttgtgtgtataagtaacttaggatttatgatgtgaatgatttgggatgttacattgatttggggatttggggtttgattaaccctagcaagtagcaaagaaacaatgaaaaaagaaaagaaaaggggaccaaccgggacggcgctaccctctctttagtcaactttactcccggttatttcacccgggactaaagatgtgcatctttagtcccggttagaaaaccaggactacagggggttcccaaccggcactacaaatggtttctccaatagtgacaggattctgtttgacggaggagggggggggggagcagcaatctccacatcgatgtgaatatgtgatgcccggtatcatgtggatgtgtacagaaatccttggacgcgagctccactgggagaaaaaaaaaggatgttcaaaatatgtgctcagccaagaagatcgacaagtttataaatagatgagggatacatttatacgtataggtaatgtatcccagttttaataaactaggaatgtagcccacgcatttgcgcgggcatgtattgtagaatgtgttgcttagataaaattttaatctgtttgttagctttttcggtataatatttaatcattctttaagcaattatatgtaatcttcttcatcacttaaaatataacagacttagtttgttcagaaaacatatctaacaaattaaatgtaaattaaaaagtaggtgtttttttttaaaaaaaatgaatgtttaggagctatgttttctctatcaaatcttaaaagactattattgctaacaaatgtgttttatttataccatttagctagccctccttttatttggtttatattgatgcactttaattactacttatatatgaataagacagaggatatatacatacatcctaggtctcgattccctatgatatgtgtgatccattgtacttttaaaaagaaaaatctaatcagcttgacccttaaaaattaaatttaatagttatgaatataacttctaaatcaactatatactgtaaccttaatatttttgcttatacttgcaataatatgtggagaaaatcataataccatggtgtaggatagagaaaaaatattaatatctaagcacttaattaaaaaaaatgatgcaatggttatggcaatggttgtttcaatttaagtgcaagtatgaatcaaaagaaataataagattttctccaattagttcaattaatgcagttcatattggcccttttttttctattttctgttttgttttatacaattcttattttaagtttaaactttgtgatatgttaaatagtgacggtgcgttacacattttatgtcatttttttgaaaaataaatgggctaccttttgtataagcatgtaagaccgatataggttctcactattaattgaatgtaacctatctgaatgcatgagtttgttgagtgattgcatagtgtgggaaataacctatatgtggacgttttatgtagagtgtgcgaggctctctatagcctagcgtgaatacaatcggagggctaaatataattgtgcacacatttttttaatgtgatttattatgaatacatgcttgaatatctacggatataccaaagtgcattaaacaccatctaaaatcaattagatggtaccttaaaaaatctattagatgatttagagcgcttaggctactcgaattatttgaccacattaattttaaaaaacataaagtaattcgatttgttttctataactaaagccactggattttttatgaagtgatttggactatttatatttgagttaaagtttcatttcttaatttaattcatgtttgcaaaacaacgtatggtggctcaacttgtattattgaattattttataattcttttatggcaattcggatgacatgtaaaaggccaatggtatatgtcccaccgatttttttatttgatatatttttcttaggcattgtatatttaatttagtttttatgtttacagaataatatatgatggtgcatcctatgttgctgaattatttcatagttattttatctttggatgacatgtaaaaagggcagggatgttgtccgtcaaaaaaaaaatactgttttatactttgatgtataaagacgtaatttgtgttgataattattgatagtgcacgggtcattgttcccaaatttcatatttcttatataacaaaatataggcatatgcttgcatttttttttcattataatacaataaaagttagatcagacatcgcacatgtatcttataactattgactatttcactttgatagcttatgattaatgaagagcgtagagttcgggccaaaagagagaggggtgggtagtgttgtgggcatatgagcgagggaggtgaaggtgactttctatttctattttcgtgaatgatttaagtgaaatccaataatcaggtgtcctttttctcagatttctcattttccccctatttttcaagacatgatatgtttatagtgcttgaaaataataggctatcgatttaagtagaaactaatgatgctcgaatttctaagaattttttctagttttaaaatgtgacacatggtgacttaatagaacgttagatgaatctgtattgcgtagaatgatttaagatgacactaaaatattaatgtttcgtggttgtttggttgttgctggtacgttcaaatgatgtattttaacttttatatagaaaaatagtaatatagatgttgatttacttaattaattactccctcctccgttccaaaatataagcagttttagcatagtgacaagtcaaatatttttaactttaatcattaatgacaaaaaaataaaaaagattaatcatgtaaaattgatgttattagatttatcattaaacaaactatcataatatacatatctttttatttaaaacattttattattgtagatatttttggtcaaaaataatatctcaaaaaccgtgttagagtttaaaaatacttatattttagaacggagagagtacatcccatccaaacacccatcagtccatccactgtctcccacctgtccatcccactgtctcccacctcccacgccaaaacacttccctcctctcccacgccggcaggctacgctacacgccaaactatctacttagggttttcccaatcctccgccgccgccgccgccgccgccgacgacgacgacgaagaatgatccgcgtgttggccaaggccagcaacacggcggcagtgccgtcgtttgcgcgcaccatcgcaacggccggggcagcgtccgcccgttccgccgccgccgaccaccccggcgccggcggcctcgtcgccgaccgctggaccctgccgaccgctccctccgccggcggcagcagtggagcggctgcggtcggggtcgtcctgttctgggccatgcctggcaaggggaaggatgtcgtcgtcgtcgagcaccacggcggcaggaggaccgcttcggaggcagctggcggcggcgcgctgttccaggcgacggcggtgaacggcgtgccgttccgcggcaaggtcggcgtcctcggcgagccgattcccgtccaagtcaagataaagagctctcttttcaccgccaccaccgaccaccccggcgccggcggcctcgtcgccgaccgctggaccctgccgtccgctctctccgccggcggcagcaggggagcggctgcggtctgggtcgtccccttccgggccatgcctggcagcctcggcggcaggagcaggtggaccgcttcggaggtgcccggcggtctgctccaggcggcgaccttcgtcgtgtacagagccaagtccacgtcggcggtcgccggcgtgaaggacgcggccaagactcgatttctggatcgcgccggcgccgcgcttgccggcgagcggcttgtgcggctgctgctggggccgacgacatccccggagaggatggctgtcgttgctgccctgaaaagggtgcacaagctcttgtttggcgatggttctgtgcggctgatgcctcctcagcgtcccctcccgtcctccgccaccaaccgatttgccgaggagctgcgcgccgcgggagtgatggatgtcaatggcaaagtcaatcaaggtgaagctctgggagcagcagtgggtaagattgtggaggccttggaacaacacaggtgattctattactgatgcaaatcatttgctttagctgcttgcctactaacactgagacaaagttataacacgttttctgaattgtgcttacagtgcttatatgatgaagtaccaccagagagcaggcgccaaggacatggtgctccatacacttttcttcgtagcacagatcctgttgatgacttactccagcttatcagagttgcttgaagacgttacagggcacaagacatgggagagtttgtccatccaggttcagcagaagctccattgggtaaaggatcgcacactactagtaaaagcattatcgcaagcggccgaaaagggtcttcgcaggtggggcggccgtccacctgtaagccaacgactgtgaagatcgccgatcttcgcaggcggggcggccatccgcctgcgaagataattttcgcaggcggacgttggctagtctgatccgcctgcgaaaataggaatcggccgcttgcaaaaaaaaaaaacttcagcatgcgaagataggtagaaaatattgaaatttaataataatttgcccgtaaattacttttaaattatttaatagaaattcttgcaggtagattattatgtacatatattggaagattatcaagcatttggcactgataaatgtacatatattacattacttaaaagtgttgccaaaatatatatattacaatatttttttacattgtcacttcaaatacgccatccagttaatacattatggcatagcactgttccactcccgaagatccttgaattcgtcacttgtggctagggcaccctctgggtcgaagaaatctcctttcacatggcagcactcatggtggatgaagtgccacagatcacgctggacatttttgatgcctgtatcgtcaaagcttgttcgacgttctaatcttggcaactgcatgcattgaagataaacaatatattagtatcataaatatgtgaagctgtctagcatatagtatagagacttacatcctccgcattagtcttgtacctcccgttaactctaaggaattcgcaagcgtaatacccgcaaaggaccgttcctcacggttgcttgtgacacttcaggacatatcataaaaaaatagttaaaatttgcaattagtgaaataattggtatacattaagtgagtggagtattaccggccaataggtacgtactagcagcttctccctagttcgggtctgttctccatccttgaacttgtaatactggtacgcactgtatggatgtcgtaccgtttcacattaaggaggatatttatttataatacattcatataaaaatgcaagagtcataatcacttactactgtaagattgctagaaattctttgtatgactggtgtctgtaatcgagagggtccaagactaccacggttccgtctttagggtggatgagtaaacagatataatgatcgctacatattaacaacagcatagttagttagtaccagctaaaataagacatatgtgtagaagataaatgtaccggacttacttaaaattataagcggccatgacgactctcttattttgaaagtgcaagaaggcttgtccaatgtactgtgcgacagtaatcaatttctccttgtgcaagcctttcttgtattcagctatctcttttggattcatgcccttcagctggtcagactctggtgctagcctcacggtatgttgtgtttggcagatccgagttggatccaagaagccgataggttcttttttcttcttagcatccatgtattgcatcctacagaagaagtttgttagtaacaatcacatggatttgtattgtacatatttttcatataattaattaaaactcatactcacatgcaccaaacaccgacatagttgacgtccatcttatcccgacgacatatggcgtggagatctgagaaatctagccatacataaccttcttcgccgaaacaatctgccggtaatcgagctgttatattgcccaagcctttcttgctggcctccatgtagaaggtatgtaaccttttcatctctcatggtccttcattcagtgcccattcaggcaagagtgctttcccatgttggtacttttccgggcaatcatcggttgtgaagtatgttggcccggctagttcagcggtcttctaggggtcatcatctctgagcttggcacgttccttaccccctctgaagacggttaccatgaacttctccttgttctcatctttggacttggagtcgtggctcctaagcactctaggcacctcagaactggtagtggccttcttagggacagtggtctcttgcacctcggggtctttcgcaggagaagggtcttcaaatatttctggctctgtaccgtcccattccaatcctggtacttcttctatttctgacccgactgatgccacaaattgcacctctggttctgccactgtaatctccatgggcatttccggcactggaatctccatggctgcctctggcactacaatctccggtggcacttccggcactagattatccttttgcatctcgggttcctccgccttatcagtcaccttcctcttaggaggtctcagaggttttcccaaccccggttttggcaccaaaggtttttccgtggcatcggtgcccaatccaaaggatatgtcattattgtgccagagaattacaagatcgaccgcatccccaagtacggatacaccatctgcagtcaggaagtcaatgtcgtaggactcaaacccttcgtggaccacttgcggctgcaccttggcatacgcattgggtatgaactcttcgttgtatgttctcccagggatagcaatggttgtagcggcctcaagagttttcccggagcgtccaatgggaacgtgcaatctgcagggcgtattctccttgaggtcatcgaaggggtaatctggttcaggttctttggtttcgaggcgaggcaaaatcatgtgcttgacgcagaaatccatcatttgcctttcaaactccgcagccccttcgtctctaagtttatcattgtacgcttaacgcttcttgtgggggtcatgtttgaacccttc

SEQ ID NO: 46921 - DNA, 10352 bp, Oryza sativa
acgagaaggtatacatgacagtttcaaattagctcgggctaatagttatcacggtgaacagttacatattatgtttacttaccccttctttagggggaatgtagtctttgtcgccttcttcaccgtcgccctttttccttctcttcgggcttgggcttggacaaggatcgcttggtgatgagtactcatcgtcttcgtgagctacgtcgctgccggaactatcttctggtgggaccgttggttccggagcaaccacaatagtaagggactgctcttgctccactaaacctttctcttcagtccctttagtactatcggccatagtttcaaacctctaacataaaagaaaaacaggctgacggggtccctgtatgaggatacagagtagtacgtattttcgcttttgacagagccaggtaggaagattatacatggtgagaagcactggccaagtactatatgagctgctcatgtctccaaaaggattaactccatcagtactcagggcaaatctaatgttccgtgggtctttagcaaactctctgtactgagcatcaaagtttatccactgacgagcatctgtcgggtgttgaatcatcccatcctttttgcgcccttcttcatgccagcgtattagttccgcatctcgcagatttgagtatatccgtttaatgcggtctttgacaagaaggtaccacatcacaagctgcgggatttttctctgtcgtccctcagttgtgtcagacggttctaggccagtattgctattcaatttgtaccggctagcaccgcttattggacattcatctaaagaagcgtattctttcttgtatagtatgcagtgatttacgcacgcatgaatcttttccacaccaagtgaaagggggcatatgagtttctttgcttgatatgtgctggatggtagtgagttaggcctcaggagcattttctgcagaagttctaacaaactgtcgaaattggtatcagaccatccatgtctcgcctttaacctcataagttcaagaactgaccggagtgttgtgaactcactgtcacagcccttcgactcatcatacaaaacttcctttgctgccttctgtaaagcttcaaagttatttaaccctctagccgaccccatcagcacctcgggttctgcatgacgtaacatttcctctaggtcgattttgtccacaatagaaccatcgtcatgcaccatgtcttcaacttgtgtcggaactacattttcaggcccgtccacttgttcttcgccatgacatgtccatatttcgtacttgtccataaatccacgagttactaagtactccttcacgttaaaagcattgtcaaagttccaggctatttcattcttactgtcagcgcatggacaaattatcttcctcatattgttcttctcagcgtgtgtcttggcaataccaataaatttagacactttgtttctatatggagacaaaaaccttggccaatgatacatccattcccgactttccatatctctaaaaaaatacacgtaaaatatttgcacaattaataccaaatttgtagggtttattgaaaaaacttatcgctattcaaaactaattaactaaaggttaagtgtaaagtaataaaaaaatcaaagtttatttcaattttttttacacagacatgccaaattagtacattaggaaaatctaacaaaatcatatcatcggcatattacaaaatactataactattttttgattgcaccgaataaatagacattaaaaattttattctctccctatatatgacaagatctagatctagatctagaactaagaggtggatgtgatagcaaaaataaaaaaaattgagaatttatgttaccacattaaaccactacaacaagaggcatcaagtattacacatacatctaacatcaacatatcaaaagaaataaaattaaaaaacatggagctcttccttcacaattttgcatgcataaatccatcacaaattaaggtctaaaagcttaaaaaattgcatacctagtgtggaaatgagtagatctaagtaccgtagaaaaatcccccgaagatttgaagttcaaaacatcccccatatatttaagtcactttaggagagagaaacttcggggagaatgaacagggctcggggaggaagaagactatatagaggcatctttttaagccggccatataagcggcgcctgcaaagataaatcttcgcaggcggaccgccccctccaccccgggtactttttttgccggcggggttttggctccgaattacttgtccgcctgtgaaaatcgatcccctatgacatcgaaaatgaattttctagtagtggcactggggaagccacagtggatcagatgcgagaaaacccattcctatattgcttcttcttactagatgatccttttgcttagcttagttgacgttgagctgattcacaagagttattattctactgcatgtttgtgttgttctacaggacttgctatgctttttagtattcaataatctcaaatcgtggcttcagtagtagtagtagcgtgtttttttttttttgtcaatgaagcacggagactgggactagatcactagaatgaactgtatgtaaatcgttgccatgcaacgtcacaaaccgtatgttgagttaagctatgaatttgacgttggtatggtgttgatattcacctgtctcattttaagaattatttgagggatgcaatggatcatttcatttgcatcccctccgtgtgatggggcttgagcatttgcttagagggtgtgtatgatattctgatttgtcatgtggctttgttgattgtacgagcatctcattgcattactgatagtagtagtagtatctaatttgtggctgcatcaatgtgcagtggtagtaacaagatgtgaggtttggttgtattttattggagaagtgccctgtgctgtgttgggctagctttgtttggatgataaagacagactagtaactggaattcaaatgagtgactgctctgttgcctttttagtactcagtatatgaagttatattgcgtagcgtggatgtgaatatgtatgtgtgatgaggaggatatatatatatatactccctccgtttctaaatatttgacgccgttgacttttttaaatatatttgactgttcatcttattcaacaaaaaattgaagtaattattaattcttttcctatcatttgattcattgttaaatatacttaaatgtatacatatagttttacacatttcacaagagtttttgaataagacgatccgtcaaacatgtgctaaaaagtcaacggtgtcaaatatttagaaacggagggagtatatgtgaatgtgatgacaagtaaagcgagacaaatactagtgtacaccaccactaaaactaggccattctctctttgccatgacctcctggaggatgatcttggtgtgggcggcgctcgaagctgttcaagaggcgggtggcgctggtcgtcggcggcggcggagatgagcttgtcgatcgacgtcgaagtacgttgttgcccagcaggtagaacgccgtgctccgaagcctgtacctgtacgcgtgcgccgggtagctcggcccgatgtcggctacctatgtagatgccgttcctcatgaacgtccggctccccgtctcgcataatggtaatttacctgtctctttttaaaaattacttcctccatttctaaatatttaacaccattgactttttagcacatgtttgatcgtttatctttttcaaaaacttttgcgaaatatgtaaaactatatgtatacatataagtatatttaacaataaataaatgataggaaaataataattacttcaattttttttaataagacgaacggttgaacatattttcaaaagtcaatggcgtcaaatatttagaaacggatggggtatttggttttgtgttgctgtaattatcctctctttttttgctttcttttgtcaaataagtacgtgtgccacacgataggaggatcaaaagcaaaagcaagggttaagttcttgagttgcatgctatcattggaattaatttattgcaaatatatagttaatctctaacatgcatgtaccttttccgtcagatgaagattttaaacttttagtgtcattaagggcataaaaaaaactccggttcattgttgcttggagcagccttattttccgggaatcttctcatttttacatgtaatttaaatagctgttttttttaaaaaaaaggtataattgatcaatacgaaatatgtcagtttcacagaaaaatcaaattcaacatagacaagtaaaaaaaaatgatagatttgactgtgtactattcacaataaaatttgttgtttttgtttctatttatttaggttgaatttgtattttgtatgtctatggaatgacatatttcacattgatctatgatatcaatttttttttaattttttggacgacatgaaatacaagggtaggggataaaaatccacttccttatcattgtgttatgccaaaccgatcgacggtgaatatgctgatcgatcgagagttccttctctgcggtggtatccaccaagacggtgttgtatactcctatgcacgcgcgtgcaaagagaacagcaaaacatcgatcatcgatcgtggtgtggctggcggaagcagcaccctcatgacgatgagccacaacgcttgcacgatgccttgagcacgaggtcgataggcggcagcaccgatgtcgttctccctcatgttgttttgcaagcccgtgccgtacgtgccatacggtttggttcgtttacatttaggtttgtttgattggttggaaattgagagaaggaatggaagtttaagagaactagtaattaatcgtgcatatgcaacgcacttaaaaaatcaatataaattaaaccagacaagttgcttgtggctctaatataaattaaacttgacaaacagcgagggaaaatatttttattattttaagaaccattaggctgagttgttttgttcactttctcaaactcacatcctttttttcacgagcgcgcttttcaaactattaaacggtacggtacgttgtttgcaaaacttttctataagaaacttgcttttaaaaaattatattaatctgttttttatatacaaataactaatatctaattaattatgtgccaatgagttgatccgttttacatgcgcggagtattagttctcaacccaggagccgaacacagccttaatgatggtagtaaagggattacctaaagctacagaataattttgaaaattgaattttatgtagtttgcatatatagtacattattgttgtgtagtacaattagtttttataagtagattttgtaagtaaaatagttccaaataaatcaaatttaaattctttgatttattatgggacacaaattttgttcatattagtacaattctgatctacatcaaatgctcgatatttttgtttgagactacaactgaatacacatgcactgctacatccttcgattagggaacacacgcagtagagattacctgacaatttccagtacaaaaggacttcgctggtcagaagctgattgaaagaagaagaaacataacacagtaaaattaaattggagtacaattgtgtattatgttttctgaattatgttcttgatgtggatacccaatctagaatctactctctactagaaaaaacatttttgccaacgttgagtattttttttttgcaggcgggtatgatcatcggagcgaaatagccgcctaaaaaaatgtaaaccgggttgaaactggttgtctgcctgcgaaaattagtgtggaatataaatagactcgacacatgaggggatttttttttctaagttctcagttctctcctcctctccggctctccctcacctctcctcttcctcaactctctctccctcaactccctcagcgaccggcggcggggggaaccgtcgacgatgaggcgaggcacgcggtcggcacggctcccctcccctccctcccaaatctggccgaaggggggaggcaaggtggcggcggcggcggttcccctccctccggatccggccgaagggaggccgggggagggcggtggtggcggcagcggttcccctccctccagatccgcccggagggatgccggggcagggcggtggtggcggcagcgcccctgcagatccccacttcccctcacctcctggcggcggcagcgccccccaaccctaaccctagatcggccggaggtgggtaggggcgcgggtgggggtggccgcgatttttttttttatagagatgattttcactggcgggtgactgggccgcttgcgaaaatcgatgattttcgcatgcgattgcttctagacggactactctcccgccgggaaaaatagtttttggctgcctgaaaataccatttttgtagtagtgactccctccgtttcaagtcaaagtcaaactattataagtttgactaactctgtagaaaaaaatagtaatatttacaacatcaacatagtttcattaaatttataattgaataaattttcataatatatttatcttgggttaagaatattactacttttctcttaaaaaaaattagtcaaacttagataattaagtttgactttaaccaaagtcaaaagattttgaccaaagtcaaaacattttataagatgaacggagggagtaccatggaagcacacggagaagcggacaattgtgccggctcacgtctgcacggagcccagcagtatgggcttgtctacaaatgttggcttatatggggatttgctatacaacaccctgctgaaaaattttgttttatcagctgaattcctggccatcagattgttccaagatttgtgcaaacgttaccgggcaaacagctagttttgggtgtgcacctgttttattccggatccgaatgggaacccaacgcgttcccctcgccagtctcttcgcctcctcacgtgagtcgccgccatcgccgtcgctctccccgccggcggatcctcctggctggagggaggaagatgcgccagggtgagcatgcgagtcgccgccgtacatcctcttcgtctccccctttctgtctcaccacctcgccctatccctctcctcctccctcccctttccctcttcctcccagctctgtcatcggctccccgccggcggatccggtcggccggaggggaggaagatgcgcagaggtgaggatgcaagtggccgctgtgcgtcctcttcccctccccctctttgtctcgccaccccgccctctccctttctcttcctgtccctccccactgtccccgtcctccccgccaacggatctggccatctaaagttaagattatgttctattttcactgaattttagttcattgatgtaggatggaaatgagcaacgttttttttttgttataaattgtgcgaagacatagaattgttagaaacagttttgtgttttctcagagaaatattcctttttgaagcaaacaaattaatgtttgtgaacttaagggataaattttgcactctgtatgtagtttgtctaatttatctgcagtagaattttggttaatttaccttgtcagggcaccatataagctactaaacagtaaactggttagcaataaagataacatagttttgttaggaatgttagaaattagcatgcatcacattagaatttgaagtgaagagtaggtacttagttttgttagaaatatatttgtaagttttgttctcaatgatgagtacttagtttctttagtttaattttcagctagcaggtattttggtttgtttaattttctataagcagctcataatctctaaaggagatttcctgacttctagcagtaggttgttctgtcatctactagccatacttattcctagttttgtcatttttgtgagcactgtgaatgtgggctatttgttataagttttgttataacagttcacttcctagttttgtcattttttgtcatttttgtgagcactgtgaatgtgggctatttgttataagttttgttataacagttcactaattatttccaattccaattaaagtggggatcaggagtttgtgtagttttgtcttctttttttttgtcaatttttaatttgctatatattaatcaagctgatggtagattagattttgctacatatcaaaagtcttgctaaatttttggttttgtaatttttgtcagcaattacaattttaagtgaagagtatttaattttgtatttgtttttgtctaatttttataattttgctagtagcagtacagctcaactagtaactagatactttgtagacgtaactaggtattccttcatggtattcttgaagaagaggtatacataaaacaaccacttaggtatgaagataaggtccatccttgactatgtgtgtaagtttgataaagctctctatggtttaaaacagacacctagagcatggtatgctaagttaagtcagaagcttcaacaccttggattccaaggatccaaggcagatacttctctattcttttataataaagggggtctgataatttttgtgcttgtttatgttgatgacataattgttgctagctcgagacaagatgcggttccagctctgctgaaggacctataaaaggatttagccttgaaggatctaggtgacttacactactttcttggcatagagatgaacaaggcatctagtggcattgttctaacccaggaaaaatatgttactgatctactaagacgagttggtatgactgattgtaaacctgttagtacacctttgtcaactagtgagaaactcactttgcatgaaggagatttattaggtcccaatgatgcatctaattacataagtgtagtaggagcactccagtacttaagtctgactagaccagacatttcctttccagtaaataaggtatgtcagtttctatatgctcctactacagttcattgggctgctgtgaagagaatattaaggtatttaaaacagtgtactaaacttggtttaaagattagtaagtcaaagtctatgcttgttagtggatattcagatgcagactaggtaggaaatatagatgatagaagatctacaggaggttttgcagtatttctaggggataatttggtttcctggaatgcaaagaaacaagctactatgtcaaggtctagtactaaatcagaatacaaggccttggctaatgctacagcagaaatcatatggatacaaactctgttagaggaactcagtgtgccaagtcctccaatggctcgactgtggtatgataatcttggtgctaaatatttatcatctaaccctgtcttccatgctagaactaagcacattgaggttgactatcattttgtacgtgaaagagtgcaacgaaaattacttgaagtggagtttgctcctacaggtgatcaagtggctgatggatttacaaaggcgttatcggtaagacaacttgaaaattttaagtacaatctcgatctaggtaggttgtgattgagggggagtattagatataatcatgtgtaagcataacaacctggccgtatcgatcttatcttagctgatagataatgattgtaatcaggattagttagagatactgattagccaaggtcgttatgatcctgtaaagccatgttgccggctattggcaaccatgtaaatatacgcgggcgcaccaagatcggtgacgacaccgcttcctgcacctctgtttcctttcattgtcatgggctatgacggtatgtgtccgggcgagacatggctgaggaaaagaaaatcaatctttttttggggggaagagaattcattaatcagaataggaaattatacattcgtcatgaatcaaccgcgagacacaagtcgcgtctcatggccgagccagaagcccgatcattcaccttttatccctaagttggctaacaaaaaaatcaatctaaccttgtctgtctcatcagctttatatacggctagagctagcacaatatactcaaaccctaacaacttcaaactgacttaaccctaaaccaattgagtttctccctaagcatttggtggagccgatcctggaacggagttgtactcctgtttgctgcctcctaaattatatctaggcatttggtggatgagtcgatgatggcgatcataaagcttcttgtaacgctgcatggagaacacctgcattgggttgtgacaagcggcatactttctccatcccattatataaaagattttgaatggatggaacacttacta

SEQ ID NO: 46922 - DNA, 11921 bp, Oryza sativa
ataaaacaaattagtaatgctgttgcataaatcccaatattcttatgtaattttagatttgtataacaaatattttaaaaaaataatagccaaacaccatggtattaactattcagtgctaaaaaaagaattcaggttattttgtgatttctggaaattcctagaaagaattctggaaattccgagaaaatttctggaaagtttccgacgggttccgagttccgacggaaactgcccttatcatttccgattccgtttccgagaaaatatttccaaatccgtttccgtttccaaaaaattccgactgacagattccgtttccgaaaataggtcactctagtgtatgtgacctgtgagtgtgaccgtgtggtgtggccataaatacctcacctgctggtctactccattatccatgtttttttttctgatatgccacttcaatcacgatcatttgcatatctttagggtgtatttagttcgcgaaaagaaaatttttggatcatatcagacgtatgaccggatgtcgaaaggggttttcggacacaaatgaaaaaactaattttataactcacatggaaaccgcgagacgaatttattaagtataattaatctgtcattagcacatgtggattactgtagcacttatggctaatcatggactaattaggttcaaaagatttgtctcttgatttctatgcaaactgtacaattagtttttttatctatatttaatactccatacatgtgttcaaagagtcgatgtgatgtttttgggtaaaattttttggaactaaacaaggccttaattactacccacaatggatcaatctggtactagctcaagattttgccgcctacgcctactaattactcgaaaataaggatttctatgtagtagtagcaaatactaggatttctatatcaaaatatttatttttagtcacttcagttgtcaatttttaaattttggatcgtttacattttatttcgaaacatctgattagctttgaaatcattaaagtgatgatatcatatgaatcagtctaggaatactataaaattttagtctaaatacttagggcaaccacaatctaccaaaaagttagtcttaagcattaagtgttgtaactttagccattgtggaagcacaccttaagcttcatacaaccaaaaagaaccttaggcccaaggttcatccgaaagaaatataaaattatttttttcattgtccacggactatttctctagcttgctgccttgcatggggtggttaggaagtgatctttttttcctttggtggaactcaacgggacccatcttatgttcttccaaaaacttaaccattgtagatattatcataaatattgctccgagctgtaacgggttccatccttattgtcataataaccataagcattgccttacccttatatttttcatggagaaaatgagtacacgatttcatgttggttaaattatactgccgctatcgattctatctctcatgaactcgggtcataaaaaaatggttggatatattcttttatgctcaatccatacttatgctcaatccatactaatgatctatccctattgatatgggttgtgctactcatctctaattacatatgtggacctgttgcaatatatgggccattacaaattcgtcgtcttggagaaatgacgttactgtttgttaaatcgactcagtgccattggtataccataaaattcgaaacgtgccattatgtggcctaagcctatgaggcgtcctaaaggagtttgtttataccatattttttcggggactcctacgcgtcgggcacccgatggagggggggggggaatcgggcgcgccacgtatacatgcaaaaccacttgaaactattttttctcttaaattatttatccaaatcatgattcgattacaccattaaattcattgcaattaaatctttaaaacaagaccacacatggatatattccgacgaaatttttttagcttattattgaattatttttaaatgttgcacaatgttccaccaagtatatcggaattgtttcactgagtagatagaaaatatttcaatcatttaaattgggtgttgtttcatcttgtatgaaaacaatgtttcagcaaatagcgaatgaatgtttcagttcactgtaagtacactaggtaaaatatttttggtgaaaaaaaatgaaacgagttcccttaatagagggtttccaaaatatgtgggtgatttgttacaaaagaatgtttcagttcactgcaacattagatgtatacatagtgaaacattatgagtacactaggtgaaacattttttatggaacaaaaaataaaacgaattctcttaatagagggtttccaaatgggtgatttgttgcaaaagaatgtttctgttcactgcaatattagatctatacatagtgaaacaatgtgtgtacattaagtgaaacattcttggtggaaaaaaaataaaacaaattcccttaataaagggtttccaaaatatgtgggtgatttgttgcaatggagtatatggtgaagatacgtggtggggccaggaggagacacgtgcgcgttaggggagagcgcacgatcctgctgcccccgagctggtcgaccgattggaaggaattctgtaatttttcacagggatcaaaatataatgcacctagccatttttcttccgtagtcgttatcttcttctaacacttggaaacatggccaccagtgaaaaaacagcttggttggtgtggctagcgatgaaattaagcactactgtagccgttgtatccggtggccccatcacgtacttaccacggtgttgggccgggagggagcaggcgtcagatctgactgttttttttaaaactcataaatttatttaaatagtgaggattacagacagagcttaaaggaaatgatatccccaaaacatcgccataaaagataagacaaagaacaacaccatccattcagaaggtaaagctagctgaactaagaaaaacatcctccaagataatccaaacagcagtaaagaacgcgatcgacaggggactgcggcaatgccgcgacgaccacgtccacgagcctctactgaagacgcgcacaccgcttgatagaccggtgaccccttcggctgcctccacggaaacggcgctattcgaggtttgttgttgagtcatgaatttttcttaagcttcaccggactcaacaaaatattgtctaggagttctccatcgaatctgaggagcatagactacaatcctatcgacaagagccgactagacggtttatactcaacccgaatggagtcctcaacctgaatactactgcaaggagatttgaagaaagtctccatactccaacttgccttgaacatgcaagaattaggataacggcgactgaacccctgtcttgtaacgatttggcggaggtacgcaacaccggagattgaagggataatgttgccgtagagagcttcaataagcaaccaacaagcttgccaccaagagcttcagcagaagcatgtggagattcaaccaactaacaagctggagcagctcattcagcccaccaacgagcaggagcagcagcagcagctcttgcagccaacaccatccgtccttgtcagagagcctgagacggccggcccagaaacaccacatccacctccatcgctctggccaagcaatgaaccgaggccagctgcaccagatccaccaccgcaagcccttgtcgccatggaaaggacgccaaacgccccagatccgtccatcttcagcgacgcagccgggattgcgtcggacaccgcgcagacccttgatgtggagagcaagccagctgcggtccagattaaaagcgacactgggacagccacggccacaaacaccaccgccaccatcgtcttctccgatcgccatgaagcaacaccggcgaaactccaaaagggacaaacccgagctacaggaagacctgactacggaagaactccgacctaacctactctatactagtacgggaaggtggcctgacccctcctccggccctcgccggcgacgaaccaccggaatcggggggaaaaggggtcggggagggggattttactgtagaagcctgttctctcacaagctctcgagagacttctcaccaggtagcgtcagatctgactgagattgcggttgagctcttcactccattgttggctttggtcgggaaaggatgtttcatctcgcgttgggagcaaattaacgacgggtgcccggaccgatggatgacgaagatggtcatcatactacggcctacgggtactcgagaaggttgacgatggtggcccagatccaactgttacgactttatgatcagccttgtcgagctcccaagccgccggtttagttcccaactttttcttcaaacttttaacttttctatcacatcgaaatttttctacgcacataaattttcaacttttccatcacatcgttccaatttcaatcaaactttcaattttgatgtgaactaaacacaccctttgtcgagctcctgagccgctagtggcctcatccagctagcacattgcaccttgaccttgttgagctcccgaccaacatccttgagctgccaccaacctcgatcgtagagctccatcactgcacacctaccacgtcgaagcaccctaggctgtgttggggaggaggggttctccctgacatgcaaaacaaagctcgtattattgcatgattaattaagtattaactattttttaaaaaaaatggattaatatgtttttttaaaaaaactttcatatagaatttttttttataaatcacatcgtttagtagtttgaaaagtgtgcgcggaaaacaagagatgtgggttgggaaaatggggggaagaacacagtcgaagccaccgtcggcctcgtcgtggtatagaggtctttaaatacaggacaacatgacaaccgaaccttactctattacataatacatggtttcggctcacctcctatatttctagtcgaatatggaggtcacgtggttatccggtatccatattatccacattagcctccgaaaccttcgaagtcgagttacagtcttctctatggttcatgaccgatactgagtgcttcaatcttctttgcgaaggcctcccgagtgtttacttattaagtccttatcttgatatcttgcaaagagactgtggagggctcgtcaaataaattaaaaaaataggtgcatcgaattgatagataaacaggtacatcgaataggtgtacctgataactgtagcaaactatgtgcttagttgggaaacaactaagcacatagtaagaaccataattttaaccaaccaagtgactcaatattagtttatagcatatgcggtgttaatctctgagtaatataccgactcataaaatatgatgcacgtagctctgggcaaatcgtggcttaagaatataacgcgagctttagggcaaccacgtcttaaaaatataatgcgcgtagctcaaagctaactgcgactttataaaaaagaatcacatagcgctaggcggccaaccgtgtatagaatgcgtgtagcactaagccaattcgcgtatttaaaaatcagatgagctatgttaattaccccttccttgtcacatgagcacagtacacatgcattggatgaccatggtccatcagggtagccatgaaggaccacttgggcttcggcagcgacatcgatcccgtaggggcgtcgcgagctccggccggcaacctcgccgatgatgttgtgtgcatgcagtcgccgttctgcctcgccgccaacgatcctgcgtttgctactccgtctggtttgcatgcatgggcgctagctagggccggccgccgacttacaccgcgggagaccatgcatgccgctgtggctgcgtacgttgcgccggccgggcaaaagcgcgcggcgagcctgatcgatcatggccgtgagcctgatcgacggtttttcctgacgggtccacgtcacaattaacatttcttgacgccagttgcaattttctacctgataggaaaattgaatttctcgtggtccttttttctatcggcgatttctgacggttcacctacaggaatacattttctaacggtaaaaccaatttttctgatggtttcgctcctacagggttggtcgtgaatctgctggtagtgaccggctgtcgtgcgcggcgtacggcgtggcgggaacacgtccgtacgtcgtagcttgctgatggttaggatggccgacgggaccaccatgccaaggtgcttcttcccgtacgccagagaggaggtgtggccgcgttgtgcgtgtacgtgaggtggtggatcgggagggggtttcggagaagaaaactccgacctccccaaggccttgaagttgggcgcatgcattttgtacagatcgatcagtgttatttgtacagatcacgtttctttatgtcacagaaatagtcgttatttttttataacgaaagttaacaagatatattaatgcacgatatatcatctttaaatatgcagtgttaaattcgatcttaacaagttatagaaaaaaaaagtaaattaaactttaataaggtcaactaatgaataaaatactgcacatttttgtttgcaagttgcaaccagctccttttaatatcgcgttggatatatcatatactagtacatcactgtaacagatgtgcgtttcacgagggatgtaggagtagttctcggttgatatgattacttcaggtaccaaaaaacaaaaaatctgaatcatagttaatctaaccaagacttgatgaaataatggaatccacagatagtggccatatctggattattgacgactgtaattgctctggaacctttttgtgctgcatcaaacaaacaattaatgcaccatgatattcttctctaacatcattgttcaaaaaaaaagagaaaaaaatctactctaacatgatcatttacgcaattgaagaacagtacggcattttttacttcaaccttgtatggtttcagtaattcagttcatgcctgtctctgagagcacattcccaataatacaacaacaacgcctttcgaagaagagctccttttttttttcccacaagaactgcagaatctgcatgccattcagaatttccaatggggatcgatcaggttaatctgcacaccctctgcctggccatgcgcgcggtcgccacgccgacgctctgcacgcggcgtgcgtagcgtccgagatggcgtccgtttgccccgcgcgctgcggctggcaaaagcggcgagactgagcatggccgtgaaccggctgtcgtgcggcgtggcgagaacgttctcgtcgtagctcgcggacgggatcagatcagatcaccatgcatgcatgcctgtgggtgttcctgcgcgtgcgaccgccggagagcggccaaagcagcggaccgccaggattgggcggcggcgctccggcgagtcgacgaacaatgaaccggagttacgttgacgtggcaagggggttcggagaagaagactccgaccccttgggatcggagtatacggaccacttcaccagcacactgacactgcacacatgcattggatgatggcgcccggaacttggtcggaagtcggtgcgtgcggtgaccggtgaggtgagcaagctaagggaggccatggcgaggtaaccggcactgtcaatggggttcggagtttgaaacaccgaaacggactcgcggacgccacagtctacggcctccaccggggattcagtcctcagtcgtcatcggccggcgccggcgccggcgaggcgaccacgggaaggcagtgaggccgacgatgtcgacctcgaactgttcttgttcagggacttggccgtgtccatgacgcgcgcgtcggcgtgctcgccggcacggctgcgttgttcacctgcggcggcgagatcagcggatgcgtgcgccgggcgggcgcgagccagacagagatcatggccgcgaacccggcggctgtcgtcgtgcgcgtatcaccatgcgtccatgccagaggggaagggtcggagaagaaaactctgatcgacctccctaaggccttgaacttgggcttgatctcgcccagtcgcgcgcgcacggcccacgaaggcccatttgtacggatcaatcaaagttttatttttttttcttcttcaaagaaaaggaagaaagtatcaattcgaacttgtcaaaattcaatcatctttggaatctccaaaaatgtcaacagaaatgtaacctaataattccaattgtaagcattcttctctgctcaaactttgtcattagtactggctcaaaccacacgagggtcagggttcaatctttcatttttgggatttgtatcggagggtgccgatatactgaaatttagaataaaatttgattaaatttgaataaaatattatcaaattcataaaaaaaattgaaaatttcatacaaactagaattttgaacccgtacctgagtatatccgccctttcccctccacacagtgcccaggaatccggttttgaaaatttttagctatagttcgtttattttctatttccaccaccccttaagatcaacttagacacccgcatcagcttaaatttggtccaaagtagagtaaagcaagcatgtgatacatctctccatttcgcactaacttcgcccctacctccatgtacatggatgctcatggcagcatgagatgctaacacttggtggcggttggtcgtgctagttctgcttccttctcccggcatccgcagctacaactggatcagataacatcatataacaatcacggcgtcatgtctggatctaacgctacttcaactttgctgctcaaggtgttaggaatggatgagatttgctccggtccaacgaaaagtatctcgagttactggtacctcacggtaccaaatcatttccaattgttagatctaacaatacacattatgtctaactagatttaatgatcagaaataatttggtaccgtgaggtaccgatacctcgagatattttttttattggatcggagtaaatgagaacagagggagtactccactcgttaagatttattttccataacgcagggattaataaggacagtggttaggagtaaaagataagctacccacagtgccactagtaatgcaccgacctacgtttaatttcatattaacgtactacgtgtttctttctcttcgatacaaagttgagttacgcttatgcatgcattgcacacgaatacttagtacacgaataggctcgatcaggaatgtaaaatactaaaatctgcacaaaatttactttattgtttaattactgtcccggcaatgttagacaaaaacaaaactcagtagttactctttttttaataaaagggagcttggtgcaaggagtgctagatcgatcaggctacagggagagaatcaaataatgtaggtaaaatgatcaggttaggtacgtttatttgtggtataatattattgggagtaaaaacataacaacttgttaggtaaactgatattttcatacctactacacaatagtcagttcatataaattgaactatatcaaaaaaaaaaaagcaccattcatcctttaccacgaaaatatgtaacattaactgcatatatcaatatactgtttacagacaactcgctggctctgttagagataagatccccagacaactcgctatgatcagaattgacacctgaaatttctcgaccaggaaaatagttaagcagggcaggaaaccccaggattatccatcaaccaaccaactaggtgcttgcttcagattttcatcagtacatcatctctaatcatccaggtaaaagacaagatcttgtcacgtgatcatggccccatgacacagtattatcatagctactatccaactgacaattgactaacaaatcatagtcactcactgtctgctactgaaagccttcctgtatttaaagccatggatatctgatgatgaactgcataagagatcatttgcattaatttcagagatagagtgagtgatcagttgagtgttgttgcataaacatggctgcctctgtcatggcttctctggctctgaaaccatctgcatctccattactagaacgttcgaagcttcgagggaaagggacaatggcaaggccatctttgatcatagtggccaagaaagcaaagaagattcagacatcccagccctatggtcagtacatgctgtaaaattcagagttaatatattagcaactggcttaaacatgaaatggaaaatgggtttctcagtttcatgggtaccaatgagtgtctcctggttatcttattttttacatgcaaaggtgataaatggtagtgaatagaactgtgattgttaccattcatttttctctaaattagtttaccttctcacaaagttatggtatgccaccatctagggcctgctggaggagtggtgttcaaggaaggtgttgatgcatctggaagggtagccaaggtcagtataaggctataagctcagacaagcatatatatcagacaaaatggttatttttcaccattaaatttttcaaatttaatcagggaaagggtctttaccagttttccaacaagtatggagcaaatgttgatgggtacaggtaaatgttaccgatccaatgaagaacaatatatttgagatccatgcacaaataataatatatagtaactcataaaaatattagtttcaaagtaaaaatgggataaagcatgtgaatgaataaaaggagaaatttacagatctagatgagggagatgaaaagagaaacacctatttattatctgtaaaaacagtgaaatccatagcttatccatgacattttgttgcttctaccgtgttacagcccaatatataccccagaagaatggtcttcaactggtgatgtctatgttggaggtaagcaaaaaaaaggactcgagaaacaagaattttaacactgcgcactgcttatttaaatttctcatgagatgtttattgttctcacaaattttgtacttacaaaatttcttgattttcccaggaaaggcaggtttacttctctgggcaatcactcttgctggaattctagttggcggcgctattcttgtctacaacactagtgcactggcttagctaagtgcagcagaccaagctgtgcctgcttccatgtatataatcttcactaggaatgtaaccagttatgtacctggactggacttgactgccagcggtggtaatgaataaggccgagtaatgttaattctaagttatgcaacgatgttttagtgagcaacatagtgttcttgggctctagggacaaataattttgagttcaacagagttggcacctgttggatcataagagttaaatcagttgaacagcttattctgaaaaattggaaaataaagttttggtagcgtaccgatccccatggagtgcaagtaaatcttcatcatcgaaatatccccaaggattacatgtcattctccagtattacaataatagtaataataaattaggtgctataaaacatactctgcatcagtgaaagtacaaaaccacaaaagcatattaacaatgtcttagtaaaatattttctgatttaacaacacctaataagataaatgttctttcagataataagaatgatatccagcatatccacaaaaaggatggctatcaccttcaaaaaaaaaaaggatggctatccaggatgcatgccttaagaatctaaatttccatcataatagaagagggtttgcaccataaaacttattaccctctcaaataagattatctatgtgagaatcagattactttacatgattaagactttatccctatatgcaa

SEQ ID NO: 46923 - DNA, 9259 bp, Oryza sativa
cattaggactacgaagaatattaaaatcaccaccaataagaattggtatagtctcatgactgcacatgttaactaattcttcaaggaattgatctttaagctcattctgtgcaggcccatacaccaaaactaaagcccatttaaaattatcagccttatttcgtaaatgaaatttgatataaaaatccccctcatcaatcaaaccaatgtcaaaatttagaagattaattcctaaaagaagaccaccagatctgcctctaggagatttacagtgccacaaaaaatctttactaacacaaagattattcagagcagatgtagaaaattccttcttaaccgtctcagataaaacaataaaatcaagttgatgttctttggttaaatcagaaacaaacttatgtttttttcgggtccttgaacccgtcacaattccaaaaaaacttctcccactattagacctaacgagccacatgctcaaacatgaaagtaactatggactacagaatatagaggaaacagaaaaaaatccaacaaggagagattttgttaacgcggataattatgtttgtcttttaggaaatggcccatatcatgccctcagcaacgaggagctgagctgagaattatctcgggaatgactaggaaataggattatagaatcatagtattggaataaacatgtgtggtaggtcagcatattcatgcaatttgctgtaatgtaattttgcgatgtattcttttatcttttctttgatgcttctaaaggaagctccagttagtcagagtatttgagtgcaaaatgttgtattggggaaattctctgccatgtaactgggtaccgaagatttgatgtatcaggtgataaacaagcatattattatgatttttctcattttatttcttcatacttgaagactgaaagcatagaagagcaaactgtttctttaacggccataactttagagggctgcataaccaaattgccacacatatgaaccttacataggtgaagtgttcatttcctataaattttctttttttaaaaaaatgaccataaggttggcatttataaattgcagcatgagcaaactagaggtttctcaatcgttgataggaacatcatgtaatttgtggcatgacagactaattatcggtcagccagacagatcgcaatagcaacagggtaggaggtgattatctccaccttgaactgaaattccaaacatcacacatgttttcagtaacacacaattgtgttgaacgaaaccgaacaagacttaaaaaagaaagattacaatatactacaataaattgttggatccaataaaattatgactggacagtacacttgctatcatccgtgtgcgtggtagcttgagaaggagctatggtgtgcatcgaaggcggacgatgaacaagagtgaagctttctcccacatcagccgacccatagatttttcgcttgatgtagactgctatcctactatggcctcggctgtatgggaattacttcacaaacatgcagatatcatgctcttgaatagctcatgtagttacagcatgattcacttgcagcatctccaggattagtcttccatatagttcatagatcatacaacctacaaggtttcaatgaatggaaatagttgaggtcaattaatgtataacatctacagaaactatggagaaatggaaaaaatatatatacatgaaacaaggatgtgcaaatgccaagaacaacctaggaactaggaaaaatgaaatgcagcattgtgcaaatgatgagacaggaaccagcaacaagaaaataatctcagaagttaatccagctgagtcaaataatctcacagtttggaatgcaaataagtaaatcaatttgcaacttaaagaaatatatcatttagaaatactatacattggaaacaagcatcacatcacgatgtataactgttaaaatgacaattcttatctgccaaacaaaatgctaccttgagtgtatggcattttacatcttataggaactaagcaagcagggaatcataacaaaaaattacaaataatgatgtatgatcatgggtttatacctcagatcttaatatgactccaccacagaagtgtttatacctcagatcttaatgatcttggcagccctgatcacaggattcgcgcgggcaatctcctccctgcccgcggttttataatcgaaggagcactcatgggtctcggaatgccggtggcaaggacagaaaagctccccgcagcggcaccggaatccggtcaaaccgacctttttgcggcacacgttgccccggttaacaaacagcaccggagataatggctcggctaccgccgccacgaccacggcattagcatcggtggcggtggcttcggctagtttcctcttcttggaaacctctatgagaataccttcgcagttcttggctgagaattgaggagctgctgctgccgatgccgctgctgctgctgccggtggtgttggtggtgtcgattgcggaggcggtggttctgtcatttgtgctgttggtggcgatggggaggctgtggttggggaaggagaaggtgaggatgatgatgatggcttcaagatctcagcctcgtccttgttgagatcacagctctcctgcgccatcggatttaacgcggacgaacaaatcaagggaagtggaggcgaatcccaagcttggacaaccagatcaggacgaattgggcgtaggaacagcaagaaatggagtttgttgaggtaaataaaaggttcggaaatgggaaatcaatggctttttttttattccttgatcgaatcggtgcaggccttagacccaaaaccaaagaggaaaacgagatctacgcaggtagaaatcagagaaatattattcggaaaaaagaagggtaaaaattctagcttttcctgcaccaaatcaaacgtggaaatgaacagaaaatcgggctgaaatgtttacagagtaggaattttcccccctgatttaaacgcaagaacaaaaacacaaaatctacaacacgcaatcgagccaggagaagagaacacgcgcagatcagggggaaaaaacccaaaaaaaaaaaggacgaccttttcagctcataccaaacgcaccgaaccacggatttctccccaccgcccaaataaacccaaatcgaaaccgcgggagatggatcgccgccgcgccgcgccgcgccggctaagctgccggcgagggatcgaatttcgaaggagagaccaaagaacaagaaccaaaggattggggaaggaagaatccgaagaagaagaaaagctccgaaacaaatcggcgggaggggggctcccccggcggccgcgtggaatcgacaccgaatccgggcagattcgacggatcgcgccgcgggagagcgccgaattggggacggaattgggcgaggaggcgagcgcaggagggaggaggaagggaaaggtgggagctttgggtggaggaggagagagaccgaggtgcgtctctgttgaggtcccgaaaggccaaagggaagggaggtagtggagaaaagtatttatttactcctcctctatacttatctatctatagtttattctttttttctattattttgttttattttatttttatttgtgtgaaagggttttgtgtgtgtggattttgggtgtcacacgacgccatctttttttattagttttttttttcttatggctcacctcacctgctgtttctccctagcttcttttaatgaccacatgtgttttactaccaacgagaatgggggatgtatactggtggtagtagtactagtctattgtagctgtatctttcattcttttctactcctagctggagaaaatctggtcaggctggctgctggtggagtttgtgctccttggagggaagtaacgcatataggattccaattaaaaaaatacttatcgcatttggagaatttggctcattttatagggaaagaaatcaggaattttgtaagagttagttcaatacctacgaaaatccctcaaaatcacgttattatatcaaagtattccggatgagtccatgggtcggacgcccgatcggtttagagaaaaatcgagcgctgatggcagcacgacatcagcgcccgatttacatgcaaaactattttaaactgatttttctcttaaattacttatccaaatcataatccgattgcaccattaaaattcgttgcaactaaatctttaaaacaagaccacacatgaatatattccgacgaaaatttttttagcttactattgaatttttttaaaatgttgcacgatgttccaccaggtatatcggaattgtttcactaagtagattaaaaatgtttcacttgtttaatcgggtgttgtttcaccttatataaaaacaatatttcagcaaatagcgaaagaatgtttcagttcactgcaacatttgatctatacatagtgaaacattataagtacactaggtgaaacatcttttatggaacaaggggagggacaagtaggtgggtccagcatggtgcgcgcgtggggggagggggagcgactgattttcccacctctccccggtcgaccgatagagagcattttcgtagtattcctctattgctcgaagaaggtatattaatattttagagagtattgttgttccatggtgtacctttcgaagtctacatggtttgcgctgttcttttctgataaagattcagattttatcttagtttcgttagcacgtttttgaaactactaaatggtgtattttgtgtaaaaactttctatatagaaattactttaaaatatcaaatatatcaatttatcaagtttgtaataattaaaatttaattattcatgtgtcaatatctttctcattttacgtgtgctaacttaatttgcatcttcatcagttttgaatactagttttgcaaaagtctaaatgttttttttataaaatggttgtcatctgttccttgtgttttaaatagtctttttttctttcatttatgttgcttttagttatgttgtctttgtaacaaagaaaagaaatatgcattccacctattggattttcattttcttttagaaactgaagtattgtaaactgatgcaaatttcatataaaatatgacgcattaaaggcatttcacatgttttccctacctttctattgtttacattgttatcatgtttggacatgctgcatacattatgttctcctcataggctgcgttcgttagcatgggttgggaacacataaaacaaagcatctgtttaatgcatgattaattaagtattaggtaaaaaacttgaaaaggggattaatattattttttaaagcaactttttagattttttttttgcaaaaaaataccctttatcagtttaaaaagtgtgtgcgtggagcacgagggatgtgagttgggaaagttggggaaagaactcagccttaatattactcgaaaaattctggcggccaggattttttttcatctggacaaacactttgacttttcatttctcaaacaatcatggcctttttacgtttatcattgactttgctaggctatgttagggagctggagattacaagaagccgctataaacaagcatccaactagtggtaatatgttgaagctctaggttccctagcctctagctattagctcattactggatcctagaactatcgggtttcacaatctaaagagaggattcagattgttattttagggtagttgtagctactcaaaacaccctcccaaataaacatgcatcaacttggtgaccacaattccacaactgtagtcgtttccagtgacatgctctttcaacgatttcatacaaaatagttgcatatcgagtttggttcgttttgatcatcaaagagatctatctgtatgtttgagaaatgcacttggccaaaatggattttcaccatcataatatatcctgaaactcagcataatatattgcattgttttgaggttaaaatgtgatactaaataatttcaagttcacagtaccaaattatgatccattgctgtagagaatcatgtcctataggatagagagagtttaaagttaccaatatatcataagaataagaacaagaatataagaataacagagtaggttagttatgatgcttgtctctacttcagtgcgtcagtgcccatctaaaattgtccctaaatgagtgcttctagagatggccttttatacaaactaggaaggtagatttgaaaaacctataaaggtggtatagcagcgaaataatatctgcaacgtttcaaaattgtgttttttttcatgaattttcttcattagaattgcatgacgaattataaaattacctattagagattagggttgataacttacggtataaaaaatggtacctaagacatatgactcttgaggttccatagggaaagagagaaaacataagttataaaagacattacatatacaaccatatataattaatggctctacccattttttataaaaaatgataattaatttattatttgatggcaaacatcgattggtcatagctatggataattcttcataggaaattatgagtttcataggaaaagagagaaaacttaagttataaaagacattacatacacaacaatatataattaatggctctactgatttatattgaaaaattgataattaatttattaaacaaaatatatgaccctcaattttagaccattatttctaaccattggatatgtagatgatctaacatattgtgcagagtcaaactaaccaaattattcgtctttcctcaccacggacggtggacatgttaattcgtgcctccggcaacatgctcgcatcaccatacttagaagaaaaaaaagtgccctgcatgtatatgcataatacatgtaactatctcatgccccttttttcatctgagaaaaaatattatatacccatgcatgcacaccgggatgcaccagccagccctccaatttgttcactccatggacattatgttcctttgttctagtgattagataatttaataaggataataagtatctaaaatcaatttttattagtaaaatatccataaggacagctctgtagacaccatctctccttcttcttttcttggtgtattagttggatttgagcaacgtgatataggtattttgggctataagttaatgtccaacttccaagggattaaggtttcccaaccttcagcgccgaacacagcataagatcgttcatttatccttaaaaaaagatcatatcttttatcaaggcattgggattaagtaaatagcatccacataaacgttgagagatataattaagttggttatgagtcaataggtccattgatgctataattaaagttaaggttaatggtttataggttattttgattttattaaaaaaataaggtggatattttgatttttaatgataacttttaggatttttttttggtatggatgtgggtccaaaatataataattttataagcaattaaatatagttggtatagatattaaactattgatttaattaaaaaatacaatggttcaaacagatcataaattgaatatataatttaaaatttacagctattgaagattctttatttatttataaaaacataccaagatcaatatgtatgaggtatattatctatgtctatatttgcaagtgcatgcagtctttgaaagtgcgatgaaattaacttaattaccttggaaaaaaatgggtggcgagcgaggaaaaaatcacacagactcttatcatgcgtatggatggaaacatgtacgtgcgtgggtggactcgtaccgccagattgatcttaagtttgttactaaagataaatctaatgtatctgaggtatattataataataataataataataataataataataataatagtaatagtaataatagtaataatagtaatagtagtagtagtactaataataataataataataataataataataataataataataataataataataataataataataataataataataataataataagaggtatattattattattttcatatataataggtggttgtatatgagatataagtacgtacgtacgatctacagggctgggtggggttaggtttgggttgttaactttttctttaagataaatctagtggttgtaaataatgggtccatcaaatataatgaaaatcacggttatttgttagagtggcatgtggcaacttaggaacatttctaggatgccacgtgacgacttacgagtgtttgtagaaagtttcgtggacttttaattaatacaaatctaataacgacgtaaaatattgtgttcatcgattttagtggaaaccaatgtttggatgtttctctaatttaagagtgccacacacgcgtttgatgtcttttgtgggggtattcttttcgataaagataagttcaattttaattgtgttggaaaaagaaaagaaaggaacaaagggaaaaaaaaagagaatggacagatggagtagtatgtgcgtactgcacggaggtggggccggtgggaggttttggttttgaagatagatctaacaatgtaaaataatggttccaccgatttaaatgaaaatcgatgattagatttctctattttattagagtgccatgtggcaatatgagagcgttttgagggagctacgtgacagcttgagagcttttatagggagtttaatgaacttttagtacataatagatagatagttttcttttactttctaggaaaggcaattcacttagacatgtctctatttttttttttgagaacgggggcattgtgttcctagtttatattaagaagaataaggaatcgacccagtttatgaagaaaaccggatatgaaactaaatagtcggcaaaaacacacatggaaagcaggaaaaaaaagagcctgtggcaacaccactactgagacccgacacaaattatcgttaccaagctcatcacaagacaagaagctctgacttcctttgacaaataactgtctcaaaaccacctagcacactaattattaagtaggaccttctaagcaaagcctccaaggaagaaaacaatgtcaaagacgttgccaacacccatcgagaactagactagggatgcctccaaggaggaaacgacgtccacaaacgtcgacattgccggcaatggtcatataccaagcatg

SEQ ID NO: 46924 - DNA, 3333 bp, Oryza sativa
cgttgctcagcttgccacccggcgcagtagctccgcctccacgacaactcaattgctctacagaagccatcagcaccactcccctaaaaaacccttgccacacagccagaacgaaaatagttgagagttatcgttgtcaagcttgccacatcggccaagcggctccgctttcgcccccaacacattaatgcatggttgctcaatcggaactgcttgcatcgccacctctctcatatgggagagaaaacccacacgggatccctcgctgccacaagcctcgtgaaagcaatatcagtgtcatagaccacctgtcctccaccacatggaaatcctctcagtctaacggtagtccccttacatccctcagtgcttcccacgatcgaagtttgaaagcaaactagccattagaggggaaggagcaccaagaagagggaggcagcctagctggccaaaagaggactagctcgctgtcatccatgccgccaaccgtactgatgaccgccatgtccaactgatcgagccaccaagcgatcgattagcctacaagtaacaccgtaggccatgagctccaacggcactgcatcaaaaccacaacaccaccgatgctgcttgtgttagtgcctcgccatcatccggcccatctaactgtctctaggggcggcctacaccaactgcaccacatctgcactgagcaaacaccctaagtccatctcagacccaatgcaagaagcttcctcgaagtggcgcccaccccaacttcccaacggccacctcaccacaacttcttggctaccacccgctcaggcttcctaggttaagccggcctccgccgacctttcttccctagcagagcaactaactcgtagcatcacctcatgtttgcttgcccgcatcgttagtcggtccgtgctacctctcccgacctgaggcctggaccaaaaccctcctttgaccaagtgcttgctcgcctgcggccactgctgggtcgagtccatggccatctcctcaccaccccaaccaccatcatcaccatgggagggataacaggtcctagatacatgttgcagcgctagatctaggtgaggaaactccagatccaaccgctgtccatccgtcatcgtcgcatcttgtcgcaactcccactaccaccgtggtggacaccggctctcacattaagctgccccggtgtggtgcccccgcagctcgccatgcatcggctgcccactgtcacttgctcgaggaagaagaagaggccccgtcgttgctgtccttgcggccgtgtggttcctggaggcttgctccggcggcagcgagggaggggaagggagaaggatggcagccggtgggatggagcaccgcccgtgtcaccccgtaaggagcgacgcgggagaggagtttttagaattccagacatgtctctaatgatgtgctagtatattatattacaaatttaaattttttatcgtctcatgaaaattttctcaaaactctcaatccatcctttatcttccattatcataaacaaacaaagctccgttcattttcttcctctccttgtccttctctcctcatctcctctcacttagctcctctgctgtggttataagtggtgcgtgtattctatgatgacctagccatagcacatgtatatagtgtccagacttgtagtattaggttatatttaattcaatattagagccaaatttatttatcaaggttcccaaccttcactccctcgttttcagcacgtatatttcccaaactgctaaatgatacgtattttgcaaaaaaaaaaaagaatctataggaaagtcactttaaaagtcacattaatccaatttttaagttttttagctaatacttaattaatcatgtgttaatctaccactctatttttcatgcgtggggattagtttcgaaactacagtaaaaacaaagcttagaccgatatattttagaagcgagagagtagaaaagtaagataacccaataactaaatttgtactgatcataataaagttgtctagttttatatacttcattaaaaggagagccaccatgtggcatgaagaacaccaatagaaattaaaggtgatcggtggtgccatatcgtgtgcaaaggattaaacaagtactcgcttgtataattgcatagcactagttggaaattttggtagaagatgggatcaattttaagtaacaggacaagattcgaactacagtattgtgcgccttttttttttcatacatttagaaaaaaagttcaaggggatctgtggcaaatttgattttagtatataaatctatataatcaacatatatagttggaactatatttgattctgatgattgtcttgaccaaactagaaggctgttgacagcaaacaagaaagccgcatgacggaacgaacgatcgaatcgtcaaaagatgattgagaacaaagatagaggaaaatatgaatattttgactggtttttgttagctcgccagctggtgatctgggagaggatactgtaatgatgccatacaatatttttcatttatgttagtttgtcacctcaaactgtggcatgtcctagtaatgatgttacctatattttgtttactatcattacctatattatggccctggttagatctcatcccaaaactttacaccagatcacatcgaacatttaacacctacatcaagtattaaatataggtttaaaaataactaattatacagattgcgactaattgcgagacgaatcttttaagcctccatgatttgacaatgtggtgctacagtaaatatttactaataacggattaattaggcttaaattcgtctcgcagtttacttacggattctgtaattagtttttttattagtgcccgaacacctcatgtgataccctatataatacccgatgtgatacgccagaactttacacccttaaatctaaacacccctatattagtaatgatagtaagtcctatctcacatatcatagacggattcagtatcgatctagtacattagtactgcagaggtagctacgtgaaaatgagtctggcacattgtttaaatgcacacacatatataaatgtatcaaaggtatgtaatgcagggcttgttcactttgctactattttcaaccttacatttttttggcaaagttactaaaaaagtggctacacttagtttgttgctaaattttaataagtacatatgaaatcttgtcacaatttgacaaccttaccaaaatttaacaatgtaaaacttggaaaggttgaaaatggtagcaaagtgaacaagcccgtaattctaccgtgtgaaaaaaataaaa

SEQ ID NO: 46925 - DNA, 14791 bp, Oryza sativa
ttttttgttccaccgaaaaatgtttcacgtagtatacttacaatgtttcactatgtatagatctaatgttgcagtgaactgaaacattctttcgctatttgctaaaatattgtttttatataaggtgaaacaacatccgatttaaacgagtgaaacattttcgatttacttactgaaacaattccgatatacctggtggaacatcgtgcaacaatttaaaaataatacaataataagctaaattttttttcgtcggaatatatccacgtgtggtcttgttttgaagatttaattgcaatctgatcatgatttggataagtaatttaagagaaaaattagtttaaagtagttttacacgtaaattgggcgctgacgtcgtgcgcccgattttttgaagttttcgatcgggtccctagtcacctccagattgtagcagataacttgaaccatccatatcttagtcggatggttaatttgtaacctcagtatgtttcactacatcgtccacgtaagaccatggatacatttctgtcatagacatactacagcagaactaggttcttgtaacacagctatgtgctactacagcccttaaaacgtgtgtaggtaatttttttttatcttttgaattcatatatacgttcatgctgtgtttcagcatttgattgcccattgcttgcctaacaaaggcttatattagttaaaatgtttgctaaaaaatataacattttacatctaaaaaaacaaagtctgctctaaattgtatgatcagataatatctgtgcttcctttacttatccacagcaacactagagtatcagttggttaactggtcattcccttccatttctttttttatatactatagagtatgatcatgatctatgttggctcatatatcatacagatggaagttctacatttccgatggtcactctgcaatattctttttgtatggaagtcactctgtactgttgaccatattcacatgtctagattgacaacatggtacgttaagatttagttaaaaaaatactaggtaaactaaatcggttttgtatggagcatggtcatcgacttctagtgagtgataaatataatctcagttttttattgaactagtactgaccaaaaaggcatttaccatatgttagattaatttgtaatatgctctaataaaataaacactagttttgcatatacaagcgagcatgctctttgaaatatattctgcttgagaaccctgatcatgggtgattcttgggtttatgtttgttggtaagctggaatatttttggcctgcaggaccatggagatcaagcataatttggcttgcagacctttggagagttggggaactgttatacttgtgcatagtttggttctaactgcttgtaccagatgcatgtttttctcatgactataacaaatgtggaccaaggtgctttcagcagagcacaagatgtctcgaaactgccttatgtaatactggcactaaattggcccttggtgctatcaactacccacatgcttcaattaatcggtatttttcttacatgattgaaatgctcttcctacaaagcatttgatggtttctaccaatttgtacctcaactgtcaaagaaatacatatgtattttctattttgtgaaagcttcttattttccttaagagtagcagtttagatagatagataacactagcattaagtcccaatttgcattttgctaaaactgaaaacaagacctaccgaagaattagtccaagctgtaaattacattcttataaaatggtgatatgcctcaaacgcatcaattgaccatgcttaatatataacagcgaaagtgaacaaggtttagttcttgctttcatagataaatatattgatgaatatagtgcatcctaactatttttacattatactgattctggtatcctgaatttttaatagtgcttgtcgtggggctacccaaacttgcttctgattcactaatccattgatcataactaggttcactgtcaacgcctgtgctgtacaactctccagatgcaagcttatataagttgtgaagagatccttgcagcaaacaaaatgaggagaatgccacaagctttatttgtagcctgtgtatttgttctgtgcagatatgtggcacaagttttaatctacagatagtttcagaagattctttttttttcccaatatgagcacatttttgtattctatcatgggaactataggttatttcttaaactatttgttattcttagttagaaatttgtattttcacatgtatgcatttattttgttttgttttacatgaatgtcaagtgcgcaccacgttttaaaacttattgttattatatctcaaggtttaacatgctggagtaaatatttattggctctgacatatgcacgaatggtttagcctttcgatcttcataattgatataatgtgcctttgggacatatcctttgtaacatatattttgtgatcctactagtgcattcctggaaaaaaattttctttcttattccaatgtgttacagactactcttgtagcacatatgatgtgttactgtgatatttcctagcagcacatctattaatatgttacagggttatgttagtagtagtgacaatggtagtactagatgtattaatcttgcttagtactactaaagggaattgagggggcaaaccaggggttgtcagcagaagtaaaaacgaaagggattgtcggccgttcagaactggaacatttatagaaaattaagtcgcttttgtcgtcccatgtgaacctacagatccatcgtttgcttatagacttattggtgaaaaatttaaattctactaaaacttaactttacaattgattataagtttttttcatcgtagtttattttttatattggattttagatagcaaatgataagctagtgaaacttgaaactcctgattaatcggcgttagaaaacttgataaaaataaataaaacattggccttcttggatcatcagaaacaaaggctttatttagagaagtttagctgtagcttatttcaaaatcgttgatcattaaaatcttctctaaacaatttagattgttataccgattctgagaatccaaaattatagaatttagaaaataaactagaaaccagaaaagaaaaacccagctttttcacactttcactagctagcttattaccagctaattgactacttctcaaaatcttaaattctcttaacagggctaaagttgcccactccctcagctggattgcactagaaatcttgtttctttagttgggctcacctacgtattcggttaatgtttttgttttttgtttttattctgtggaaggcacctgggcgcaccaccacagtccacagagtcacacacatcaataagagcctcattttaaccgttaacacattcacgcttaatctttatcttcatcttgttgaaataataagcacataatgatttaatttatttcataaataaatcatgacattgcatatgtaaactagcatgaatgcatcattgcatctacacatataaactaagtaaaaaaatatgaacagatcaaatatgcgcataccgaggttgccgaaacatcggttgctcagcaggaattacttgcggttgcgggcgttgatgaaagtgcgcaacacgcgagcgaacaggaagacgagccgtcatgtacgaacagggagcagtcgcgtgaagcgcttcccaaaaaccttattgccttcttttctcggtgcaggatgtcgaaggcagaggttccggagacctgctttcccgatcgccggtgtacgccagcgagcgggatggagtagtctacgagcgatggcacggcatagagtaggaggcaaaccttagattgatttcgcgtatgttgcgtgaaggcggtggctcggtttatatagagaaaggtcacttgatcagggtgcccgcacgatctccactccacgtaaccgaaccggataagtcgcgcgtaacttatccggactccacgccgttttcacgcaacggatttttcggaatgtttccaaaacaaacaaatccgaatttcccgcagcaaaacaaaactgcaaaaggaggctacatcagcgcaaaggtgaggaaccaattttgcggaccatttgacgcgtacatcgtgcacgccctgccaggcaagggcgtgcgcgcgtgtgttccccctcttctctccacctcatttgcttcaagtggctaggagggcatcctcccttttaaggaggtcaccctctcctagaataagtaatgtggtactaaacttcctatgcatgctacctcataaggtgggtttttatgattttccaaagaattaatcttcgagtggcctaagacccatctattaattccaacacatcttcatctttaggagattcaaacaccacctaatacccagtgcctgtctttttgtcatttcaccggtttcttttttttttctattcacgatcttgctttttcaggctatctgcaacttggtgattttcaccaaagaaccaaatccaaattgctataaatcacactaaattctacaattaaagatcaagaaataaacatataggtgaattgagccatgcacgatagattgaatatcgcatgcctatggtacttcattgtccctctgttttgtgcatgaggatagatgacttctagcaatcgaaaatgaaatttataattttgaggatgcagacgggtctcattgtctactccttggtttatctgcggtaactaaaatttaattttagagttaatataggtatctttcatcataatctatttttcagcataaagttttatgcataaattttatattttgtatttgtcagtaatttttttatatctatatttttagcaatttaaaatctaatgttgccaacaacgatttgaaaaaaaaaactcaaaatcaaaattttcaaattaaatttaggccctatttagttcccaaaatctttttcccaaaaatgtcacatcgaatctttgacacacgcatggagtattatatatatagataaattaaaaaaataactacattgtttgcatggaaatggcgaaacgaatcatttgagcctaattagactatgattagccataaatgctacggtaacccacatgtgctaatgacggattaattaggctcaaaagattcttttcgcggttttcagggagttatgaaatttttcatttgtgtctgagaaccccttcagatatccggtcaaacatccgatgtgacattcaaaaattttcttttcacgaactaaacaagaccttatatttcaaatttctaacagcggtttataagatgaaatacaaatgatcgttcttttgttattccaatgggatttcaaaagactcattaagtcccaaagtatataaaaaatattcctagaattcacagccgacataaattttaaaaacatttttttccagaagaaaccctacaactgaaatatctcaacgaaaatgggagtactccgtctaaaaaaataaaacataagacatgatataacacatctagccctataaatctaaaaaactcccctgttcaaaaatcataatagtactcttttcgttcaaatataaaaattttgagctaaagatatctagctttgagaataattagagtttcaaacatgacattagtacaagtaaaccccagggcctcaaaatcctttctccgccgccgatgtgaggagaccgaggaacgggcggaaataaaaccccgcacgtgctgctgcagtgagccagtcggtcagccgtcagccagcgccgcctgccgcagcgccaccccggcggtacaagcgggtagtatatccagggaaaagcagcagcagcaaaaaataaagaaaaataaaagtgacagggaccggtgaaaaggcagtgggacgctggaaaaaagagctcctcgcaaaaatgctctcgtgtcctcgtccgtccgtcctcccctgctgagcctgcagccttttgtggaccaccccgccccgcgcaagcgcaacagaagatgaaagaagcacaagcagtcgctactagttcgctaccgcttgcgctggtggtgatggccgaaggaccagaaagaaatacgattcattcatgccaagccagtgttgaggccttgaggaggcccaaagagggcagttttgctgcgggttgggcttttgttgtagcggcgatgaaacgttctctgccttcgctttatttccttatgctgtggtttttgttgtagcggcgataaaacgtcctctgccttcgctttatttccttacgctgtgtttgagaggaggggaaagaaaaaaagattaaaaaaatacgtaaaatgagataaaccattaacgcatgattaattgagtattattaatttctttaaaaatagatcaatatgatttttaaagcaacttttttacatttttttttcaaaaacaccgtttagcactggcttacttgtagtggcgtatgtgtgggtggtttgcatgtgatgatgtgagtttatgcataaatttagatactacatagcttatacttgaagggctgatgcataaaaaaagagttttcatgatgtcattcagagttcaattttgatctcttctactccattgaaaaaaaagatcggttgcaatgcgacaggagagaggttttttagtggcgtgcatgtgattgggaggatgtttgctacagagccatccttagcattttggggtctgtgccaaatataaaggaagagccttatctttagaaaatactattatataatatattataattatatagtattatttataacacattgggttggatatctgcaactactgttattttgcttgatcgaatgcagtcaatggccttctaaccacggcaggaaagccgtcattaatctaacactactttctttagctatatcctattatcaaacaaacataaattgtttttaaccaattataactatagctatatcaaagaagttcactgatctatctatcatatagttaaataaatggttttactcattcatcgtgtgacatatccaatgatccaaaatcattctgtgagttgcatccgacatcacatagctcgccacgctccctccctcccttcgatctcattcccctgaaatcacgcaaaatcacgtctaactgttaacaaccaaatttggtaatccaagtatccgaaataaagataggatcgaagcagaatttgagatggaaattgttccggaaacagagtaaggattggctggagtccgaatcggctgcgactgggatcggcagagtccgaattggacaaagttagccgattgagccgaatccgacaatgtgacacggtacacgttgtcgggttgagttaacgtgcttcatgaggattgctacgcacggattgagtcctgagaaggcaattgtatctattaattaggatatttcatgtaatttccttagagatatgtttgggcaaaagtctgcgtatcttagagtttgttagagataagagttgtatccgacacggacatatattgtaatcttgggtataaatagaccccgagccccatgtaatacaacaatacacattcaatacaatctcagagcatcgccaccattttactttcgttttgtttcgacaagttctcgctttcgggttgagctacatcggtttcgatcttcaactagaggtaaaacttgttgtggcggcttgcgttctcgagattagtgcttccatctttacgatactctaatcttgtttatgtaattcatcgagttaccatatattctatataatctttgacaatattgttatctaacctctagtcggctaacatcttttgctagaaggcagccgattaggttgaataccaacgttgacttagattatatatgatatttaccactctatgaaacatccaacggcttaataccaacgttgacttagattatatatgatatttaccactctatgaaacatccaacggcttgattgtctagatattgttcttcttttcatacttatagctgcatcagttgagtttaaccttataagtcgtgattagaatctcaatctctagcctgcttttggttgccgattagtgtagcatcgggatttcagccgaccttacctgatttaactactttcatctcatatgcttgattgacatgttaaatctgccctttatattaagatcttgttgcatttaagtatattaggcttttgtttagtatattctacttgctttaatatcttaatatagagtagtatcggagtattagccgatacatgctagatctatctgatcggctatgctatgaatatatatagtctagttgttaatatatatttcgatctaagtgatttatactgtctcggcatggtgatcgatctatcccaatcacttgatgtaagtatatattgacataaggattatatattattaatatctatagccgatcgagtagatttagttctttcttattcattcatgattgccgatcgattcacatatgacatcggcctagagatagatgatatgtaatcggcaactagccgatcggctatcatttatggatttaaccgcggtctctttgtctttatttcttgttgattgcaggatcaaattaactggcacgctcacacatctaaaggaaagcttttggacctgcactgaagttaagcagatcccccaggcctcatgttttcacatgaacactaactgcaaaaatgatgccgccgtcaccaccactcggattcggtgcgccacctcgcccgtgagcccctccacacatcggcgcccccctctaccctagcgtcattgttccccttgtgctagcggaggcagtggccggttataggaccaaggtccaagtatgcggcagcggcatatgtgtaggatggattttgttcggtcaggcgggcggccgtgaagcggcgagagaaggatgcggtggtcgaaagggaggcgtccagttagcgttgacacgatccaggcaacaaggtaaccttgcctcgaccgcgtccacgccccgccgcgcgccagtcgctatctgtcatgaccacgttgcccccggtgtcctctctctcctacatcatctctgtctcccctccctctcgtgcatccatggcggcggcgagttcttcaagcacggcagcacatctgacaccctgagatcaattcaatcttacaagaggtaagcatataagaaccatacgattcaccattatcaatatcttgtccaagattcatgcttcatgcgggacgcggagggagtggaggaagaggtcagaggaggtagtctgttcggcacgaaaatctcaggaagtgcgggcaaggagaatggtccctggtgaatccaagtccgttgaggccttaagcagtaacgaaatccatctactactataattgcatctattgtttctgtattgcagtgtgcaacacagtgctgtttgtgtatgcacataacaagaatgaaattaaggttggaaacaaccaaaaagtgtggaacctctttcgttctaagctgacatccgctgaaggaaattgtggcctccttttttctgattccttttctattttgtgctatctttttcatgtaggggagcagctctggtgcgacggggaagttggcagcacatacgcatttcattgagcacatcttgagcgttttagatttcttgaatgttttatattgtgatcagaccaataaggtattcaactggcatacagttttctcatttgggcttaagtgattggattggtttattgtatcttgcaatttgttgtgttaaaaaaatgttatagttttattgctaaaagcaatctatcttttctgtcatccagatgaaagcaattacttgtggtatcttatgttagtaggcataattatggaagaactggattagcatggataattaatggactacattaattggcgatggtttttggtttagttgagttttctatgcacggtatcttctggtaacgatgattgaccttttccattttaaattaagtgaaatgaatcattagggctgctatggacacttgagtacatttgcatgaactatagcaacaaagcctgtgctttgcaagttgctggtatggacatccagtgtttcttcactcaaatcttgcggacacacaagagtccaatttttcacatatttatttttcttttttgtctcgatggacaaaaattacaattttaacaagtagtggggattgaatttgtgtaacacaagaattctccaaaatggcacactgcttgatgagatccacattgtctgaaacttgttctgcgtgatactcagtacgctaatatgaatactaggtttttgtagtgtcttggcttaactatttgtttgggtaaatctaaaaccactaatagtaattttgctttgttgatccatttggggaaataaatgagataggacagtacaatgatgccaggtacgtatcatcgccagaggctatataggattcttggtttcccacagttcgatatctatccaactattttgcagctccaacttcatcttcctaacatacagtatgtcacgtatgatgaggatggtaatatcgaggatgttgtcaatcgttcatcttcttatatggcattaaataatctcgaggatggtttaaatttaaatttgttggatgggcagtatgaacggtctatatgccctaaccttttgttacatattgggaaaaaaaagctatgtgtagagatcagatggacttttcctgtgcgaaactctggattatgattcatgttaggcatgttttttaaggttaatatcacacatctctttttttttttgccttgtgtttgataaatagtttatttcagtattagtttgtattcatattaaaatggatattccattttaattttttttatgtataactcttcgaaccaataaatttatttgtctaatgcaaggtagctaactattcaaatttcttagtaccttgtcgggttgtatcatacatctctttatgcgtgccttgaaaattactttatattatttttatttattttataaataaatgcatttgtaggatattaataagctaaggcaacaatttttgctacatatacaaatgtaccaacaaaatgagtgcgaaagcaacattcctagcgatacatgagtgtcagggttacggataaggcataccttctatcctacgacttatggaatataccaataaggcataccttcacgtacatggattgtttccgtatacgtcgttaggaatttatcttaaattacggaaaatatccctatgagttaagaaactaccaaagtcctactcggagggggatagaatctctgttatatcgtatcagattacatacctccaggccttacttggggttcaagataatccacggtataaaaggggacccctagggggaggtgaaggacatcgaatatcatcgccaacacacccaccatagcttacgaagccggagtattcggagccaagtcaccgggagatctcgtcgaatccatcgactacgatctcgtcggtatcgtctgttccatctactctctttgtaatctgttctcatcgtcatcaatcttatataaactggactagggctattacctgttagggggcctgaaccagtataatccttgtcttctgtttgcttgatgttgtactacgtagaccctcgttccaatgtaccccaatactcaacttatccggtccacgagtatcactcgtcgacagtggcgcgccaggtagggggacttggtgctcaaggatctaccagtatgacttcaagacttcccgacaacagaaccatctccaacgtcaatcaaggagcttctacctcgacatcgttggtttggactcaagtcggatccattgtctttccggtctataccgttacgccaatctcggctggcccaatcatcatcgggaatgagaaaggcacggtaacgactcagagaaacgacgccccgccgataattcctcccactcaggtggagaatggaacatcgatggccccaacactcgggaggaatcctcaggcggctgaattttgtcccccatacaaaagatcagagccgacaaggatgaccaccctaagaccgagatcttggtgtcttgtgcataagacatccaagcatactcttgaggactgttcggtgatactccatgtgcaagctgaactctacgcctattgggaacgtgggattcagcgtacttcatcgacaggagccacctactgtccgaaacatagatccagatctcatgatctcacaagctgcagaatcttcctcaggaccctcaaaccaccgcatcatcgtgtccaacaaccacgagttcaaactccgtgcgttgccaaggaaccagatgcagccccaatcccgtatcggttcgtgggatacatcggtgataacgagccatctgttttacacctcttggaaggctacgaatcctcttcggagtcaacacgagatgtaaacgtggtcgacaacactgagacaagcgcgtccgcggcagagagaacgcccgctcaccagttgcgaaatctagacgcgatattgagggaaagtccttttgatccagcgacaaacccagacgccggccaatgggtagagcgactgcgagagaccgtgaccaacctcaatgccgcgtttgccgaagcagcaggtggcccagaaccgcgcaggtacgaagaacaacctaccgaggacgcggatggagaaaatatcgccagaggacgtctcaccggtgaccactcacctcggcaggaatgagatcctactccgccatgccgcgaaaatcgcgatctccgtgagcaggagggatcgtgacaacaacgactgccatcgacatcgctctccttctcgtcgtgagggcgacaccacgcatcgacaacaccgtcattgctctcctccgtggcaagaaaggaaagacggccgagggaacacccccaatgaagaccgagactgtcgactccacaatgaccgacgcaacaacgacaaccaccgagatcaggggaatgatcgccaaggccaagagcgggacggtgacaaccagcgagatcgaaactcccaatctccacacccgagtcaagattgaggacgcgatcatcactcgagaagccgagctcctgagccaagcagcccctcgtcctcatctttgtcatcttcttcatcagatcggcctcctcaacggcgtcgcaaccacgggccacccccccgtcccaggaagtggatgcagggcattcacgcccatgctccaaaacgtgcgatggcctgagaagttccgactgggagcgatggagaaatatgacagaagtacggacccagaagaatttctgcaagtctactccacaattcactacaccgctggcgcagacgacaacgcattggctaattatttgcgagccgcgttgaaaggctctgctcgttcatggcttgtccacctcccgccctgctcaatctcttcgtgggaagacttatggcaacagttcgtcaccaactttcaagggacatacaagcgccacgcgatcgaagacgacctgcacgctctaacttagaacccgagcgagtcattgagggactatattcgacgctttaacgagtgcaggaatacgatccccaagatcaccgatgcttctgtcattcgagcattcaaatcaggcgtccgagatcgatataccacaaagaagctgacgacgcgccgaattacgtctgccctaaagttgttcgagatcattgataggtgcgctcatgcagacaatgctctgaggcgcaaggagggaaaaagcaaagcgggagaggagaagaaatcgaccaataaggatgcaccagagtcaagcaaaaagagaaatcgcaagagtgggaagtgcaagtcctcaggagaggtcctcgccactgagcaaaaggaatcacctaggcgccctaacccccagaacgacgactcacgcaagacttggtgtccaatccacaagactagcaatcacaccatggaggattgttacgttatcaaaaaggagctcgcgagacaacatgcaatcgaaagggggaagcgagtacgtgttgttgaaacggcggaagaagccgccaccggtgactctgactccgccttcctagagtatgacctacatgtctcccacatcttcggcggttccacgttgtacacctcaaagagggagtacaaaaaagtggaacgcgaagtctgcttcacgtcgcagacgagtacaaccaagatgaagtggtctcaacacaagatcgaggtcttttggatcaccccaagatcgcgactacgcctgacagatatccaactgtggttgaacccactatacggaacatcaaagtggcgagagtcctcgttgacagcgggagctcaatcaacctactctttgccagcaccttagacgcgatgggaatacctcgaagcgaactgacgcccacagatcagcccttccatggaattaccctggaatcatcgtctaaaccattgggcaaaatcacgctacccgtcaccttcagacaagctgagaacttccgaacatagcagatcacctttgatgtcgcagaattcgacaccgcctataatgccatcattgggagaactgcgctcgcgaagtttatggtagcgtcacattatgcttaccaagtgctcaaaatgccgggaccaaaagggacaatcgctatctaggagaacgccaagttggcggtatagtgcgacaagcggagtctcaacatggtcgagcatactcccaacccgcccgccacaaccaattcggag

SEQ ID NO: 46926 - DNA, 24224 bp, Oryza sativa
cgcttccaggcaagaaccgcttgagcctggaaagtttttggacgtcctaacaaaaccatccatcaaggacacggacaacgaaagcaccacaactgataccggcgtcccgcagggggctgcagaggtcacaaacgtcatcacaaatgcagagacgacaaacgactggcgcactccgctaatcagattcttggagtcagacgagctaccggacgacacagatgcagagaaactgtctcgtcaggccaagatatattgtatgatcggcaacgatctatacaaaaaggaaccaaacggaattctcctcaagtgcgtatcatccgacgacggaaaagctctcctcctcgacatccactaaggcatttgcggatcacacgccggcgcgcgtactctggtcggaaaagcttttagacaaggttttttctggccaataactctcaaagacgcctgtgaaatagtgcaacgatgtgaagcttgtcaattctttagcaaacacaccaagttgacagcacgagcgctccagactatccccttaacatgtctgttctcatgctgggggctcgatatactcgggccattcccacgaggacaagggggctacaaattcctgtttgtggcgatcgacaaattcaccaagtggattgaagcagagccgacaagagaaatcaaagtcgacaacgccataaaatttatcaagggaatattctgcagatatggattgcctcaccgcatcctcacagataacggttcccagttcaccagcggtgatctccaagattactgcatcaaactcagagtcaagatcagctttgcctcagtatctcatcctcagagcaatggacaagtcgaacgggctaacagaatagtactccaggggatcaaaactcacgtgtatgatagcttattggctacgacgcaaagtgggttgaagaactctcgtcggttctatgggccgtacgaactacaccaacgacatccaacaaggaaacacccttctttctcgtatatggatctgaagccatgctcccaacggagctacaacatcagagtacacgagtacagaagtatgctgacgaggaacaggatgaaaggcgaagcgacgatgtgaatctactcgaggaacatcgagaacgagttgccatccaagcagccacatatcagtaggccctacgtcgatatcacgagaaacacatcagagctcgcacacttgccatcggtgattatgccctcctacgagttcaaaaccaggcagggcgtaacaaactctcgcctaagtgggaaggaccatacacgatggtgcaagtcctgcgaccaggtgcgttcaagattgtagacggcgatggccgtgagttatccaactcttggaacattgatcaattacgtaaattctatgtgtaaagtcaatgtatctcaaatatatacaaaccgactatccaaaggtattttgatttcttcatgaaatacattagtgttcttcccggagatcccttaccacgataacacctactcttgaaatcgaacctactgaccctttacgctgtttcgacaagcttccgagaaacctacgagaatttcgactggggacgcccagagcagataaggtcttgtcagattctaagagccgaacgaccatgtaagacctagtcatgtaagagttctcaaaaggtgtattaactaagccgtgtaatcggaaattgatttttccaacttcacggctaggggctaggtaaattgcattttcagctaggcaggttacgggtcatcgagccttcccctccgagaacaggtttccccgaggacaaggcttagggctagggagagtacctcactcgacaacgggccaaaggcagcctgtaaaaagagtagtactcgctcacaacacaacctgtttaagcatttactagatagatttctactttgattacaagttcttaatagagataacaatgtattataaacccccttttagatatttttctatagggaatgaagcctaccacgacggccactgccagttcatggaagcgaaaacgtcctcggctaaaggagcaagggatcacgccaactggtcgatctcatccgccgataaccgagaacggcgaaaacccccgcgcaagaatctgaggtacatttgcgagcggcgatcttggatgcaggcgaggacgtgacctccggcgtaacggctggcgcggcgacactcctcttttaggctgatgtcgatccactgtccaatgccttcaagctgagcacactgttgatagtcgttatcaatcagtttcgaccgtcaatattaccaaaatagaggagaactagtgatggttgcaatgcatatgcttgttagaataataatattccactagtattaggtttactaaccttttgcagagaataacaataaagtgaaggagaatcgagatcaactccaatgataaatcaatcggacgatgtcgagaaccaaacttgtgtatgaatgggccaagaactcagaattgacacgacaaactgggccaaaattcacaagtctgcggagaagaacaacagaggaggctgccagccaaaccttgggcttattgggccggccccaggatcggccgaacctggtggttcggccgaacctggtggttcggccgaacccccctcttcgccgctggatgcagggtttcttctggacagtgtggattagctcccaatgacggttggagggtatttccgaccattccaaccgtcacaaccgtcattgggaggctatataaacccctcaccttctcacttcactcacacacctcaagcaagagctctctcgttcctctcaagtttagtttagtagtatatagctggtggaatagaattagaataggaatcaggagtccggaagccttcggaagagttcgggtatggctctagtagctttcctttcctcttttgtaagctttgtacttttattagaatactcttctaaatacatttctggtattgaaatactttccgagtatatgagtaccaactttacattatgttcttgttatactgaatatattgctagcttgtctgggagatgcatgctttggtgcgggtatagtgtttgcttatgcaattactctatgtcatgacgatgatattagagtagtatctggtagtttagacgtggtgtctagattacaggatatcattatttggggttatatattgcggatgagaggtgggcctctgatggtgacagctcagtacgggtattcctccacgcctatatataatcctaagttaatttcctggggagggtactcctccatatttagccccagttggatggtcatgacgagctgtcgtaaggaactaggcagtcaggggtggcttctcgaagtaccaggagggcatcggatagaaggtattagctagtatatcagttaactagaatgtatgtatactatgtatattaaaagtatagaaatagattctctttctcttttcttttcgcctagcttagattatttattatgagtagtaatgcatgtgtgtcactctacccttggattatcttaacccctacttagaatatgattatcacaagtattatataaattattagttgagttctctctacgtgatcttcccacgggataaaatgaatacgatacccttggaatactctcaggcgaaatgctacaatggtatatccatgcgcttgcggatgaactctgtaaccataatataccagaagtatttctgcgccattgctgggaattatatttctagtaatgtcgttaagaaataccaacacacacgcccccctcagctagaacaagtagcccgtcgtgttctcctcggggtccgcgcgatcgaccctcagctggtggtagatgtcggccatggcattacaacagctcttgaggtacgagttcatccagacctcgcgacctcggagagcctccacggccttgtcttttttcacgaccacgagcgatagcccaagttcggtgacctcaaactttgtcctccaagaagcgatgcgtttgtctcgttcggcgatgacaccttcgagatctgcgaaggacaaggatgtaggagatgttgcctccttaataagataataagctcaaagggacaatttctctatgacatcacacctgagttctcgcgagggagcccgactatgcccggactaaacgggccagaggccgcgcccacgcctccgagcacaaccgcatccgtaacgacatcgggagcaggcatatcgcccaaagagggcaagtcgatcatcgcgacatcgggacatccgcattgctggacatcctcggaatccacacagctatgaagaataaaagacgctacagattaacaagtgacgtgaagagaaggaagtcactccgcctaggagattaacagaagtacttgtacaaaaactacaatacaaggtaaaaaaaagtttactcctcataaagggggaggacgcactccccgagatccatcacactagagacatgtcctcgcgcgtggcatctgctgcccccttcgacaagatctccttgagatcggtgacagggagagccagcttcacgcacgcgaggacgtgacacgccctgtgtgaatcccgttggagatttccttcgagaccttggcagtatgccgcgacgggatgacctccatctcgcccgccagctccgacaacgccaacgtcaaggacgtctcgtcgaggtgcgtcgggatagaagacatcacaccacacgccaaggctagctggtgaaggcctatgaagctcttgcggagggagtcgcggagggagaagaggtggtcctgcaggtcgttcatcttcttctccaagccctggtgctgcatcttgttactggccacgatctccttcatcttttgaaggtcgtcgttggcgacttcgagttcaatctccagccgggccacctttccgtccgacgctgttgcacgggccaccgcgcgatccatctgggccgccacctcccgagaagtgttctcgaggaggcggcggcactcggccatcatatcggaccaagttgttagttcgggcgacgacgcggccacaggcgcgacggcaggcccggcggactcagtgacaacaggagcgacctccacgcaaggaatgacaacggcaggaaacccactggtcaccgcctagtccccgctttgcgcggagatcgccgaggctttcctgccaatgtcaggggacatcattagtaaaacttacagatgtgacgacgaaaggagtcaagagtttcacttacttgccggcgagcagctttagcacccttctcttcggaggaggagcgagactgctcgtatcctgagtaagatggcaaattatgacctcattctaacacttcaagaaagaagctaaaggacgacaatgatacgccttacctcggagccactagatttctgtcgagaaccggcgggagcgctcgacctcgcccaaggcttcctctgggtcccgctgcctcctgcgatggctggaacggaggggatgttggcgacttcgtcggcatccttgtccttcaacgaggcggaggcctggtggttgacaagggggccgataacgtccgtcaacggcagaacctacaggagttgaagtcactttgcgccttcagggaatagaaacatgaggaggtctggttctcatttacattgatagcagccgccttgtagactgccgacttgccgcaacgcggagccggtgtttcatcgaccgtagaggaaggactgatcaagacttccttgacccgctgcgccacgatgttggcggggagatctgaaataaatgaagatatgagaggatgagttaggctttggcctcgaaatcatcgtcgaaagcaggaagaagattacaacataaggacaaataccccgcgaagagattcgagttatatcctctgctcccgtgtagtcgaacacggggtgagcacgggcttgtagcggttggatccgaccgctgacaaagtccttaatgacttcatagccggtcaatccttgctctcgaaggtcgctcacagcgttgacaaaggcttggagagagggtgtcaacggaggtttagaagtccagttctcggaatgctccggctgaacctcgggtatgacaagaaccggttcaagttctttgagctctagatagaaccatctcgacctccattggctccgggatgtgtggcattggaaagagatgtatcttgccttcatgccatcacgaaggcgaaaccatcaacatcttgaaacccgattggcttccatccaccggagttcatagaaaaagcaaaaaagatctaagaaaggcactacctcgatgtaggcctcgcaaaggtgagcaaatatgctcaaaaaggcagtggagttggggtttagatgcaagagagaaaggccgtaaaagttcaagatcaataaaaggaatttagaaggaggaggcaaaaaaccacagcggacgaaatcctctagagctaccatgcgacctaggatgggggaaggatcaatacctcttgcttcccaagccatggtctgcttcagagggacggccccctcggtgtacagcttcttcagcgcgccgcatcggagaaagattggtcgaggtccgccatcggaagaagatcgtcggaacaagatcgccagtgggagacgtggaagattagggattttagggaaatggaaagtccgaggaagccgaggaacagtgagggttttttggcaaacagacttgaaatggatcccagaattccattaaataggcgcaccacctaacggttcgtattttgaggaaaggagagagattgccgccgaaaatttctaaggcccgttggaggtagttgttcagacttcaatttaaattcaaattttgcaccgttggactccctctagcgttgtcgatagctccatgtctctacggtcagtaaccgagatcgacctagcgagcacgacgagacgctattaggagaagtcgtgggcgacaacatgaattcatttaagttgaagtcgggggctactgtcagggttaccgataaggcataccttctatcctacgacttatggaatataccaataaggcataccttcacgtacatggattgtttccctatacgtcgttaggaatttgtcttaaattacggaaaatatccctacgagttaaagaaactaccaaagtcctactcggaggggatagaatctctgttatattgtatcatattacatacctccaggccttacttgcgggtcaagataatccacggtataaaagtggacccctagggggaggtgaaggacatctaatatcatcgccaacacacccaccatagcttacgaagccagagtattcggagccaagtcgccgggagatctcgtcgaatccatcaactacgatctcgtcggtatcgtctgttccatctactctctttgtactctgttatcatcgtcatcaatctcatataaactagactaaggctattacgtgttagggggcctgatccagtataatccttgtcttctatttgcttgatgtcgtactacgtagaccctctttcaaacataccccaatactcaacttatccggtccacgagcatcacttgtcgacaatgagaatttcttaagtgtatcctaaatgataaacattagggtagttatttatctacggggtatattctatatatgtatcaaatgctttatttttgtacttgtttatacccataactatttaatggaataactctatacttttaacatttttttagaactttaacatattttcaaacgtatatcgccctcgtatattgtatattgaagtgattatatgttactaattcttgccaagatttattctacccacacaatatcatattattataatttgcgtgaaatatatttgatatacgacataaaattaattaaaactcaattgcacagatcatataaaatactttttgctaacatgaaattttaaaagttattaaagataatagaatgcacagtagtgtttagcatgggcatattactagtatatgtaaatgactaaatgttatggctatttggctaaatagaagaaaaaatgttgcaacaatatatacagttttcagtactacatatgaaaatggagtccttattacctagaaggtatgtttacattatcacgagatatagtttttttatatatattcatgactgccatcgaatacttaccatagtagataaaagaagtagctccttctagctgacttagtggagaaaaagaattaaattttaaaaaacaaaaccaagagattctaaatatatcggaacgaattagcttaaattaatacacacgtgaccagggacgggctgttcggtggctcctttttttatttttgaggaagacctagtattcggtatttcgttatatttcattatagatatgtactatttttaaagcttcgattagactaatatgagtgctcattcatacgatggaccgggctgtgactgtgcgcactgctctgggtggagagcatatatattgatcgatcttatttatttttcatgagaaaatataacatttatttatggcaagacgttattcacgtcaactatggctgtgttagggagtagcactctaaacaaagccgcatttagcgcataattaattaagtattaactaaaataatttttaaaaatgattaatatgttttttaaaacaactttaatatagatttttataaaaaatacactatttaacggtttgaaaaacatatgcgtgaaaatcgaggaaagtgagttgggaaagtagagataagaatttaagcatatatctatcagtcaatgtggtactccctccgtcccaaaaaaacaaaccaaaccatgtgttttcgtgtccaacgtttgaccgtccgtcttatttgaaaaaattatgaaaaaaattaaaaaaacaagtcacacataaaatatcaatcatattttatcatctaacaataataaaaatactaattataaaaaaaattcatataagagagagagtcaaacattggatacggagactcagcgtttatttttttttttttatggagggagtatatagtagtacaacaatgcaacagccaatttccagttcgatcaggcgtgtgcgtgccgttgcgtccagctaaactccacgacttagatgtcggctcgtgtgtcaaatgcaaaattctcaagaatctgccgcagccgatcgatttcatcggattcttcgtggtttgcgtacgtcgtgcgttgtactatcgcgtgagtgctaacgagcgcacatccaaaaaatagaaactgatgcagttctcccgtacgcgtcttttcaagaaaaaaaagaatcgcgcaacgcaactgcgatcctacccttgtgcgtgagtttttcttgctagcactctctccgtaaaaaaaatcaaactcgtagtacgatgtgacatatcatatactccctccatcgaaaaaaaaggcaaatactgggttttcgtatccaacgtttgactatccgtcttatatgaaatttttttataattagtattttcattgttgttagatgataaaacatgattaatactttatgcgtgacttgtctttttaatttttttcataatttttttcaaataatacggacggtcaaacgttggatacggaatcccaggtgtggagattatgggtaccacatacccacacggcatggttatccgactggttataggggataacttatatctatgaaatatgtaacagatcatgacttgggtattacgttttcccgtatattatggaatggcctaaagtcctggtttgataagattgtaaagtagatttaggaaaccgataccgtattgattaaggtttctatcttgtaatcctgcccccatcctatataaggtgggtaggaggccctctagggagcatgagatacaactagatcgtcagatctatactacacccggcggattcaaatccccaaacaggagtagggtattacctctcattgagagggcctaaacctgtctaaatcctttgtctccgcatccatccacttttaggtctcgtgcgctaccccttttattattgcctaattcatgtttcgacagttggcgcggcaggtaggggtgcgtcgaattacccatcgaaaagtgcaatggaatcaactgcagaagaaacggcgagatcaatctcaccgacgtcgatggctcaactcttcaaccgggtttgtcgtttcaatctatctagtgttttttaacaatgtctatgacagattgatttcctggtgtactattattattgtagtactactgtcgacgagatcgtcgatagcatatggagccacctgggagtatacacggcatgctgcaacccctgtcctcagaacaggcgtagtgtgcggttgccggttggttgcgaatgttttggcccggccgactgctttgattgccaaagtaacagtctagcacgcttctcctcgcggcgacgtaatcaggggcaccggaacagctgcgttgatcgcatgcatctactgatcaccgccatatatgcaagtatacatgctggccaataggccaaccaatcaggagtcctgcgtttataggctgctaccaacatgcacaggcttgaatccaattattcaataagcagctatcgacacatatgagtcaattaatatataggagtgtatgtagttgtatgcatgcatcttcttttgtttactaatctgatttgactcgtatttacatgtacttccatggatcgatggccatggccctgagatatcgttctgatccaacaagccggtaaagcaatccttctactattactgggtgggttgtcttcatcaccggccacacattggagcagctgcctacaatttaccagatggtgatcatatgacaaatatcgtcatgcccgcaactggcgccgtcaactcatcgagttttatctcttccaacttattattctatattattagattgatttctaatttcagattaatctcttgctatttttgttgttgtttgcatataattacacggcactactgaggcgattggcgttggtcatggactcgaggtgtctcgctatgcgattagttggccatgagtctactccaccggcttgccttcaccactgccgttgctaatggcaacaacgtcttcaccgccggcctgcctccgtcgccgccgactggtgtcctcgcctatacgattggttggtcacaccaccgttcatggacgtctacgtcttcatcgaccggctggcctttgccgccgccgactggtgtttccgcctgcacggccggcctattatgccgccgttgttgggcgtcaacgtcttcaccgccggcctgcctccgtcgccgccgactggtgtcctcgcctatacggttggttggtcacaccaccgttcatgggcgtccacgttttcaccgaccggctggccttcaccaccgctgactggtgtttccgcctgcacagccggcctattatgccgccgttgttgggcgtctacgacttcaccgccggcctacctccgtcgccgccgactggtgtccttgcctatacagttggttggtcacaccaccgttcatgggcatccacgtcttcaccgaccggcgtgccttcgccgtcgccgactggtgtctctgcctacacggctggcctattatgctgcatttggtgggcatcttcgctttcaccatcgaccaccttcgtcgctgccgactggtgtctttactgttattgatggacgactttgttcccacattggccacctctgccatcaccaaggggaatattacaaagctaagtcatcattaattttctttatatgatattttccttttcctctgcctcactacatcaactggttcgccgttgactagtgagtcgggggactatagatgtcatatcatattttttaacaatttttcataatatttatcttgattgcttgcgaaataatccgagtaacaataaagttcctatcgagttatggagttctattttcctatgctttccatttggtttgtcgatggatagttgcctttgggccgattcctagcacccgggggctcgttggatggaccgagtaacgcaaggtcctaagtattattcggaataaatcaaaagcatagagataagataaatttattttctgctcttacaattgcaaaagtacccgagtagtaaattttgattcgtgaaactttgttccattaatgacgaactcatgtcactcatatgcatgtttgggaagtgcctaaaccaactcccgatgcttgggggctatgactagtcgggcagagtgtttaaacgtacggagtcatctgctcggggaaatcaaaattgacaagaggagaaatacatatttataaatattttaaaatacttgaatttttctcaagtactgtgcttgcatcagatactactcattctatatgtttgttctgcaggatccagatccagatatgcataatagggatttatagctttaagcttatctcctacgcttcaggaatggattagtcagaatatcaccattggcttgctgtcgtcgtcgccgactggtgtcctcgcctatacggttgggtggtcacatcaccgttgttggacgtcatcgtcttcaccgccgacttgccttcgccgatgtcgactggtgtctccgcctgcacggctggcctattatgccaccgttgttgggcgtctacgtcttcaccgaccagcttgccttcgtcgccgccgactggtgtctccgcctgcaccgctggcctattatgccgccgttgttgggcgtctacgtcttcaccgcctgcttgccttcgccgccgccgactagtgtcctcgcctgcatggctggcctattatgccgtcgttactgggcgtctacatcttcaccgaccggccacctcgtatgacaccgactggagctatcgtattcacggctggccatatcgccgccgctaataggcgtcatcatcttcaacgtaagctgtctacgtctgctgctgactggtctcttcacttacatggctgcatgattctgatactgttgattggccttatcgtcttcaccgccggtcgtctcgtctgctgggattcgagcccaggtctccacgaccacaacgtggaattctcaccactaaactactgccgactggtttgttcgcctccatggctgcgcgtcttcgtcatcattaactgggtcatcatcgccgtttgccttcgccgccgtccatagtgttttcactttaatagctggcctattttgccaccgttcatggacatcttcgttttcatcatcatactacttctttcgtcgccgactggttatgtcgccgctgactggtgtgtttatcttcacaactacacgccttcgctaccgttcgcaagatttgctacttcaccaatcacgacatctacaagagcttcgacatctcgacatgcgtcaccaaatatgatgccttattattttactatagcaagtggtgttctaatcatcaatatttctactcggacatcttcaacacgtatcttcactcaagcaatggctactcgacgacaagctagagttctcgactctatgttcagttgttttccaactaaccaaagagtcgggggctacacaaatacaaggctcaaaatttgacatgttttttgtcaaaatgaagcaatcaatgaatcaacaagtaaattttgggagttattatcttggtcttcgcttcagagccgacattttacttcagcgactctagttatttcgtcgattcaacgagttggacaacatcatctatttttcttcaagtgaagcatcttctacagctacaacaccaagttctactgtcatcttcataaatcaagaggcgttgcatcaatctacattacgcgcactctagcgtcaacgaaattactcgagcttcgatatcttctcaacagtttgatggattattgtcactgacctcattaccaacgcctctactttatcggccctgacgtctacgccattgctaatgggtgactacgtcttcgccttcggttgcttacgtcattgccgacttgttatttcgccttcacggttgacctactacgcaaacgctgatgagcgtcttcgtcattatcattagctgctacactgcattgactggatcaccgacttgtcatcttcatcaccatcctgtcaagcttcttcgacatagcctactctactactatcgatgggcaacttcgtcatcatagtcgatcatgtctgttgctgctaatcgtcattaccgtcggttgcatttgccgtcgccgactattttcttcatcttcatgattgatggatttcgccattgccattgatgagcgtctacgttttcaccaccggcttgcctccgccgccgcccatggtgtcttcgctttcacggctggcttattatgcctttactgatgggcgtctttgtcttcttcaccggctgtctcgtctgtctccgactaattatttcgtcaccatggctacaaaactccgtcgctattgctgggtgccttcatcttaattgttagttgatctgtctgccgccgactggtttcttcgcctccatggctatgcgacttcattacctttgattggtatcattgtctttaccaccaccaacatcttcgtcagctttgatgggtgatatcatcttcatgttagtcatttcgtctccatgtcgactgcatcagctattgccaatggacaattttgactatgacagaaggacaagctatatattctcaggggcttatcaactcaaacactaggatcataccttcaagttggattttgttctgagattattttctatgctcgaagactgaaccaatcattattctccgtaagggctatcaaccgaatacttgcgccagtcgggattcaatttttatatctattttggagtatcccataagggataatcactcagatcagaagctattcatatgagctacacttggtctatattacccggaagatttattactcgggagcatgttatatgcgtcatcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatgcccaatactttggaaatttctttattcacaacattcaagcttttttatagctgttttgctatgtgtattttcaatgatgtagtcaactttaggttgctctcatcaatttttacaaagcaatcggtatatcacttggatcatgttattcggggattcacaccgcatatgctatatatcaagtcatttggttgattacaattatcaaaaccactcggttggttggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatgagacacaactagatcgtcatatctatactacacccggcggattcaaatcctcaaacaggagtagggtattacctctcattgagaggacctgaacctgtctaaatcctttgtctccgcatccatccacttttagatctcgtgcgctacccccttttattattgcataattcatgtttcgacaccagagtttgtcttttttttttggaatggagggagtgttcagattcattgtactagtcacattatagtactagggcctcgtttagttccccaatttttttcccaaaaacattacatcgaatctttgacacatgcatggaacattaattatagattattttaaaaaaactaattgcacagttagaggggaaatcgcgagacgaatcttttgagcctaattagtctatgattagccataagtgctacagtaacctacatgtgctacagtaacccacatgtgctaatgatggattaattaggctcaaaagattcgtctcgcagttttcaggcgagttatgaaattagtactttcattcctgtccgaaaactccttccgacatccggtcaaacattcgatgtgatatctaaaaattttctttgcgcgaactaaacaggccctagttgtctattttttttgggacggaggaagtacttgcttgtgagcctttttgttgctatagcccaaattaccccgtgtccgtggcccatgaaaaccagtcgcttccgtcctcctctgtgtgtcgggcatcatgtaggaagtctaggaacgtatttacacggtgcacaaaacactcatcaattctaattagtgcacacattgtttaacaaaaaagatatagcatatcttgtcatcaatacaacgaatctagacaacgggtagtctagattcgttattctaagaggggtcgtatccccttagagattgagttttctttagaacggaggaaataggtggcagtagaaggccaaaaagaagagggaggtggttcagcccatccattgaagcccatgtttgtcagccaccaaatctatgaagccaagagtaaaagattattatctgtcttatagtccatgcattcctccataaaaccaatatatgattcatatattgatcataattcctcgttactagtaattcgctagtacagttgaatgcaaaatatattgctgtccactgctataaggaagtaagctaagtattgaaaggaatacgaattaaaagtaaagagagaaaaacgataggaaattcaaacatagatccggcgagttttctctgaggtataagagattcggcaatctccactaatactcgttggagcactctacacaaagagtacactgtctctgatagtcacgaagtccattggcgctctcatcatggtggttcttctccgctctgaaaggtgaaccccgaaacctccacaaccacaccggctctcccacaatcttcttgacagatcaccgggttgccttcgagactggctaggcatgccaagatgccaatagttaacaggaagagagccactcctcctgttaagaacaggattcttgttggtgcacactaagccactcttttttgacgtgaaacagtaggaaaatataatttacagggagggtggcaagcaccagaaaaaagcatactctcaactcaaactagcactaaattagtgaagaaaattatcacaattagctcaatgatgctcttagactctcccatcaattgctcagctcaatagggttccaaaggacaccggggagtcaagccaagggatgtataaagccccaatcaagctccctagcggtttgcagccatcgtaaagaagcagccaaaactgcaaatcgtcaaacagtatggcaccgacccgaactattctgcccttcatacttttctgattgtaactgggcaagtagttgttgggccataaagcataggacaatccaacatctcctagattgcccaggacccctttgtccacacggtgtcggacaatccgcaatgttcaaaaaccaatgaccagtaacaatcgaatgaacatgccagattaaccgacgtcgtgtcgaactgtccgctagttgccaaattaactaggcatcagacaattcgagagctgccggacagtctagccagttcatttccactatctagtcaacatggtcagacaatgaactggctgaggatgtttcttttgttgcgtacatatgattgtaaggatgttcagtgcagggttgtccctagtaatttggggcctcgtgcctaatataaaataaggccttacctttagaaaatactattatataatagattagaattatatattatttataatacattaggtgggtatgccctctcacagctcatgagtcatgaggagaaagagcggatgatgggtcccaatcatatgattctcacaactagcataccccctcatctactctaaacgaacctttggctgcctattgcattcttaaagtaagaaacaacaataacaaacaccttccctgaatcgagtggacctagtagccagagtcttagatggtacaaagaagcccatgatgaggaggaggtagtccaatccctgtattgaaacctatgttattagtttttttttaaaaaaaaggaagaaacatatgctattaactattagatgtactcacctattttacctttgtattaatatatttgccgtatagttgacgcatttcaatgtaaaccagcgattcaaatattgatttttttgaaagatccaaatatacaaacgttactaccaatctgtcgttgaagataagtcaaaaacaaattcccatccacctatttaagaaggtggacaagtggatggttggtaggcccaccaacgtgccccctcacacctcctgagtcacaaggataaagagcgaacgatggagcctactcatacacttctcacaccttgcacacacaacacaacccatctgttttagccggacctttggccgctgcactattaaaatgtagaagtagtgcaacccctattaaaacccatgttattaaatactatgtctattcaaccacattaatgttgtatttatatttttctctatagtcgttgtattctaaagtaaacgagtgattcataaattgaatataatttttcaatagatccaaatataaagtctaacaataatttgtcactacatatgaatccaaaacaaaattttcatccacccatttaaggtggaaaagcggatggctggttgccccaccaacatggccttcacacctcatgagtcaatgaggaagagtggatggtggatcccagtcatatgactccgacaactaacatacccactcatgtagtttagataaacctttggctgcctagcaatatcaaaataaagaaacaatgttaacaaatacattccctgaatagagtggacctagtagccaaatacttattaggtggtataaggaagtccatggtaagaaagaggtagaccaattcctctagtcaaacctatgttattcactattaggtatattcatgtatcttatctttgtgttaatttttttataattgatgaaagtaaaccaacgattcactaacagattttttttgaaagatccaaatatataaaggatactagtaatttgttgctaaagattagtccaaaattaatcacctatttaagaagttgaaaaagtggacggttggtaggcccaccgacacacccctcgaacctcatgaattatggttgtgtttagttcacaccaaaattggaagtttgattgaaattgggacgatgtgacagaaaaattggaagtttatgtgtgtaggaaagttttgatgtgatggaaaagttggaagtttgaagaaaaattttgcaactaaatacggcctatgattaggaagagtgaacggtggggcccactcatatgcttctcataccctgcacacccgcccatatgttttagccggactttttggctgttctgctattaaaagaaagagtaaatcttccacgacgtgtcataagcaggatggcatgtactaatcatatgcctattataactagcatacacacttatctagtctagaaaaacctttggctgcctattacattctaaattaagaaataagtaacaatagtaaacaacttcccttgaagacctagcgtattaataaggaggtagtccaacccctctcgttgaaacctatgttatttaacaattagatatactcacctactttacctttgtattaatatctttactgtataattgatgcaatcatcacatattgtatatatatatttttcaaaaggtcccaatatataaagacaacaatccgtcactaaagataagtcccaaaagaaatttctatctacctaactaaaaggggtaattgcacattgactctcttttgaaagctaactatcaatttgaccctcttttatcaactttaattatttaacccttttcttaaaaattgaagatatggtatgaccctattctattaagggcatctaacgatgttaactgaagcacaaaatgtcccttctgcccttactcatttgaccctattacatgtgggacccacgcgtcagttctctcttgtcctctcctccacagctccacacgcagggagaaggccgcgagcagcgagagggcgagccagcgccgaccagcagctgtggagcaccgcctccactcctcgtcaccgccgagccgtcgttgcccctcccttgccggatccagccatcacagctccatcgctgggttcgccaccttcctttcttagtgcatgccggtggcgcctcctcttccctccgcgcgctgaccgccgctgctacctccctccttccgtgcgcctgccgctgccgccgcggcctcctccctccttcagcacgcctatcaccgccaccgccaggcccggctcccctccctcccttcgccgcgcgccggcctctgcctccctcctcgctgcacgcgccgccgcctcacccgacggtgcgcgcagctccactgcatgctgccgccaccaccgcaggggaactgtcgccgccgtcgcagaggctcggcgcagccgctcccttcctccgcaagccgacgccggtgcagatccctccatccgtttcccaccaccgccgctccttcccttcacaagcgtgtgccagcgaggatcccctccacgcgcttcccatcaccgcggcccctgcctccacgagcgggcgccgccgcggatcccctccgcgtgcttcccgccggcgccgcccccttcctcccttcagacaccgagtgccaccaccgcaactcgctggcaggagagagagagatacacatgtggatagggttagggatggatatggtttcctcaagggtattttggcattacgaattttatttatatttctttgtttttttaaatcaaatcttaacggtgtagtggaaacagggtcaagcggaaggttcgtttttgaaaaacatggtcaaataagcaaactaaaaaagtagggttaaattggtagttagacttcaaaatgggataaaataagcaattgtccctattttaaaagataaacaagtagacagttgataggtccactgatgcacgccccctcacacgtcatgagtcatgatgaggaaatgcaaacgctgggacccactcatatgcctctcgcaccccgcacacccacccatccactttagctggacctttggccgctctaccctctatcaaagtaggaaataacagcagcaacaacagctcacagccgtaaaagctcacacacctcctcctcctcctcttccacgcgcgtcagtgggccgcgctgcaccgcgcattgcttcacctctgcacacctgaaaccgaaaaactcaatttggagtgaagcagggagagagagagagagagagagagaggagagaggtgtcgtggagggaagtttttgaacaaaaaatttccccaacccgttgggcacgatgccgtcatgatccccccttacctcactgccaaaaaaatttcaatatctcacccacattaatcaccttcctcacgagtctaacgagcaaaaatcccatttcatcatcattcatatcaatcctctcgatttcttccacgtccccggattctgtttcctcctcctcccccgtctcgatccctcctcctctttccctcgctccagcgcgctcgccgtcgcccgccgcccgccaaccatggaagcagctggactggaggaggaggaggaggaggaggaggcgatgccatggtggtgttgccgcagcaggaggaggcggcgtccgtcgaatccaagggagtccacgtcatcggcagccgaatctatgatccggagaacctacaggtggtggcaactagagcctacaggcggggtaagctctactgcgataagtagggacgatcttggcaggggcttggtttgatggaggggttggcggcggtgtaggaaggtgactgggtaagggggtgtgactgtggaacggtgaacttgagctggcacacggctggctcaggctcaacaacacgagcaccgctccatgcacacgaactcccagtctaccacaaacgccacactccctaacgacattaccgattgggagggtgagggagagatgagaaagaggctaacatgtggccctatcctcgtcttggatccagatcaagtccatgagggatccatgtggcatatgcccacgttgtctcatggagcggatcaggggctagtttttgaccagtgatgatgcacagtatacaactcatacttgaagggttgatgcataaaaaaataattttcatgatgtcattcagagttcaattttgatcccttctactccaatgaaaaaaaaagatcggttgaaatgggacaggagagacatgttttttttgtggcgtacatatgattgtaaggatgttcggtgcagggccgtccctagcaatttggggcctgtgccaaatataaattaagaccttatctttagaaaatactattatataatagattagaattatatattatttataatacattggggtgggtatctaataccacttcttttttcttgatctgcattgcaatcaatggccttctatccacatcaagaaagctagctttaatctaatgctactttctttagctatatccacaataagcatgaattgtttttaaccaatgataactatatctatgtcaaagaagttcaccaacctacatctgtaaatgttatggcaatccggctaaatagaagaagaatttatgggatctgaaagtgcattttgagaattcagggacttcgatgacatatacgaacaagtttagggactagtcgtgtactttactaaaaaatactagtaatttggtactacagctgcgtccaatacaaatttccatccaccctacttaagaaggtggacaattggacggtttggaggccctcacacacctcgtgtatcatgaggaggaagagcaaacggtgggatctactaataagcctctcacatcctacatgcccatctgctctaaactgatctttggctgcctaccaccttgtcaaagtaagaaatatgcatcaacaacaaaagggatgtttagatccaggggtgtaaagttttggcgtgtcacatcaggtattatatagtgtgttgcatggagtgtttgggcactaacaaaaaaataataattacagaatccgtcagtaaaccgcgagaagaatttattaaacctaattaatctgtcattagcaaatgtttactgtagaaccacattgtcaaatcatagagcaattaggcttaaaagattcatctcgcaaattagccgcaatctatgtaattagttattttttagcctatatttaatacttcatgcatgtgtttaaacgtttgatgtgacagggtgaaaaattttgaggtgggatctaaacagggccaaaaacacattcccaaaatcgaggaaacctagtggctagggcctaaggtagcatatttacattaattattgattaggtggtacaatgaagacaatagcaaaagggagaggcagtacaactccctattaaactcatgttaatatctatt

SEQ ID NO: 46927 - DNA, 5827 bp, Oryza sativa
  unsure (1)..(5827): unsure at all n locations
aatttttcatctaatcatttaagaaagggcgaaaagtggatggctgattggttatgccccctcatagctcatgagtcatgaggaggaagagcggatggtgggtcccaatcatatgattctcacaactagcataccccctcatctactctaaacgaacctttggctgcctattgcattcttaaagtaagaaacaacaataacaaacaccttgccttgaattgagtggacctagtagccagagccttaggtggtacaaagaagcccatgatgaggaggtagtccaatccctatattgaacctatggcccgtttggttggagggagtttttaggagggattgggagtttagagggatgaggctattaagtgttttgtttggttggaagacatgtgaattttgatgggatggagatgggtaattgaggaaggaactccctccttttcaatacctgggtaggggcaggtaattgggagggaattcctcctttactttgtctaagcaaatatcagccatccgtttttattaatgacataatctccaactaaactccctatcaatttccatcacctctaccaaacaagatattgggattaaaaatcaaattcccatcttaatctcatcatcaattccctcgtgtaaactcccaatccccttccctcgagttaccaaacaagttgctatgttattagttttttttaaagaaaggaagaaacatatgctattaactattagatgtactcacctattttacctttgtattaatatatttgccgtatagttgacgcatttcaatgtaaaccagcgattcaaatattgatttttttttgaaagatccaaatatataaacgttactaccaatctgtcgttgaagataagtcaaaaacaaattcccatccacctatttaagaaggcggacaagtggacggttggtaggctcatcgatgtgcccccctcacacctcatgagacatgatgataaagagcgaacgatggggcccactcgtatgcctctcgcaccctgcactcccacccatctgttttagctggacctttggccgctatactattaaaatggagaagtagtgcaacccctattataacccatgttattaaatactatatctattcaaccacattaatgttgtatttatatttttctctatagtcgttgtattccaaagtaaacgcgtgattcttatattgaatataattaaacgcgtgattcttatattgaatataatttttcaatagatcaaaatataaagtctaacaataatttttcactacatatgaatccaaaacaaaatttccatccacccatttaaggtgggaaagcggatggctggttgtcccaccaatatagcccttcacacctcatgagtcaatgaggaagagtggacggttgatcccagtcatatgcctctgacaactaattacccactcatgtagtctagacaaacctttggctgcctagcaatctcaaataaagaaacaatgttaacaaacactttccccgaatagagtagcccgagacttatgtggtataaggaagtccatggtaagaagtagttcaattcctttattcaaacctatggtatattcatatatcttattctttgtgttaattttttttatagttaattctaaagtaaaccaactattcactaacagaattttttaaagatccaaatatataaaggttactagcaatttgtttctaaagattagtccaaaattcatttctatccacctacttaagaaggtgaaaaagtggacgattggtaggaccaccgatgcacccctcaaacctcatgaatcagagcgaacggtggggtccactcatatgcttctcacaccctgcacacccgccccgtatgttttagccggaatttttgtcattctgctattaaaagaaatagtaaatattccatgacgtgtcatgagcaggatatcatgtcttgatcatatgcctattataactagcatacccacttatctagtctagaaaaacctttggctgcctaatatattctaaattaagaaataacaatactccctccgtcccaaaaaaagtgcagttttgtactattcatctccaacgtttgaccgttcgtcttatttgaaaaaaacttatgattactatttttattgttattagatgataaaacatgaatagtactttatgtgtgactaattttttaaaaaaaatttataaatttttcaaataagacggatggtcaaacgttggacacggattttcacggctgcacttattttgtgacggaggtagtagtaaacaccttcccctgaatcgagtggacctagagtattaataagggggtagtccaacccctctcgttgaaacctatgttatttaacaattagatatactcatctactttatctttgtattaatatctttgctgtataattgatgcaatatcttcacatattatatatatatattttttcaaatggtcccgatatataaaaacaataattcttcactaaagataagtcaaaaataaatttctatctacctactttaaataagtagatagttggtaggcccactgacgcacaccccctcacacctcatgagtcatgacgaggaagagcaaacggtgggacccactcatatacctctcgcaccccgcacacccacccatccgctttagctggacctttggccgctctaccgtcaaaccaagcaagctgtcaaaggaaatagtaggaaataacagcagcaacaacagctcacacagacacacacctcctccccctttgacaattgacaccccctcctcttccttccacgcgcgttagcgggccgcgcggcgccgcgcattgcttcacctccgctccgcgcggctgaaaccgaaaaaaacccaatttggatcgaagcggggagagaggacttgaggagacgcgtcgtggagggaagtttttgaaaaaaattttccccaacccgctgggcgcgatgccgtcatgatcccccccctcgcctcgctgcccaaaaatttttcaatctctctcgcccacattaatcaccttcctcacgaggccaacgagcagaaatcccatttcatcatcattcataccaatcctctcggtttcttccgcgtccccggattcagtttcctcctcctctccccccctctcgatccctcctcctcttcccctcgttccagcgcgctcgccgtcgcccgccgccgtccgccgaccatggaagcagctggagtggaggtgaacggaggaggaggaggcgacgtcgtggtggtggtgccgcagcagcatgaggtggcggcgaagcaggcggcggcggcggcggcggcgaaggggaagtccgtcgaatccaagggggtccgcgtcgtcggcggccggatctatgatccggagaacggcaagacctgccaccaggtaacccctcctcctcctcccacctacctgcctgcctaccatctgttcgacaccgtgtctagccggtgtcctatgaggagtcgtgcgtccctgttcttcctccccggtggttgggtcgggttggatctgaggaattcttgctcgcccccccttgtttttgcggggaattcttgctcacccttgggtttagcggttgctctgtttcttgctccctcgcagtgccgtcagaagacgatggacttcgccgcgtcatgccacaagatcaagaagaacaacaagcagtgcacgatccagtactgccgcaagtgtctctttaacaggtgaggggggaatttcttctcgtcttctttcttagcttcaggaggcagagcaaggctggctgaccatgtgatttctgagtgattcgtggcgcaggtacggccaggaagccgagaaggtggccaatgacggcacctggacttgccccaagtgcaaggatatctgcaattgcagcttctgcatgtgagctgaccaaacctgatgctctaccggtcatgctgattatctgtggctcgcgttttgttgtcagaagtgatggatggactttgatttgtttggcaggaagaagaaggggctgccgcccaccggaatacttgcccatgctgctaaggcttcaggttgtgcttcggtccatcatttactgaaaaaggggaaagaagcggtggctgccgcgcagaggagcacccagaaagtgagatctacacctgtgaaggtgtgtggtgttcaggattggcacgatcctttgtcacattacaattcgctgttgcatggtacgattgttcactatgtttgatatgttttgctgatcctttttttatgaacaagcagaagagcccaaagagggccatacagccagatgctgctgctgatgaacctttggctgaaggggatgagaatgtatgcattgatttcaatgctgctccagtgaagaagcagaagagaagcaggaaggtgggtaatggtgtggctctgacgaaggatgaaagccctgatgctcccaaggaacaagttgttctgcccaagggcactccagtcactagtgttgccggtgcagagtgggagcctgaagatgttggtcttgcacttcagttcttcgaattctgccgcacatttgctgaggtagttacgaaagaaagatcaaggatatttaatagtatgattgcacatgccttgtcagagtaatatcttactagcatttgcaagagaataatagatcgagttttttttttctatttacatgtctgatgcatgttatgttttggtatgaagtatgacaatgtaaaaaatgcttttactggtaagcaccgaagtgttgatattagagcttcctacaagtttggaatcatatctatgtgtttatgtaggtaaggcatgcaatgccatgatgggatacaaatcataaagggaataggtattcggattagaatttggagagggagatggtggggtgaccgggtgacagcaaatgggcaaaaggaaatatatgactacctgttgagttcattgtacgcattaaatggatgcgatttctctgcgtgcaacatgctaacacctagatacaggctatctgttaattgccctttaatgtgtacaatattcgagttcctatttgtaattatgaggtttcttttttattgcatggcacttcttgtccatatgatatacatgttaacattgataaactggtcgaaaccttccaattatatttcttggtttgtaatttaagccatgtagtagctttcatataacccaaattaaatgttattatgttctgtcgaatttttttatttgtgataggctgcgtgttcaactgaactaccaaagctatgttttaaagttttttttttaaggaaactaccaaagttatgtttcatcctatacaatatctcttgcaaaaggtatgtataaagctccattgttttacacatagtttgagcaaagttcaaacttctgagcaaaacaactatctattccatctgttccaaaatataagcatttctgactatttacctgaacggaaatgcttatattttggaacgagggagtaagtgatagcgaagcttattcttttctgtgcgagtttataatttatttcttctgttatagaccaaacatccaagtccttaaggcataattttggtaaccagcaaaacattgtaacagttgttttattaggcgatgtgatagttatcttaatcttttatgtttatttctaacaagtgtcatggaacaattagtgtaaaatttttgcaactaccgtgagtcctgttccattacaattgttgcatcatacttcctccgtttcataatgtaagactntctagcattggctacattcatatagatgttaatgaatctatacatatatg

SEQ ID NO: 46928 - DNA, 3015 bp, Oryza sativa
aactccttgtttcaataataataatacaaggataacgcagtaattaatttattgagattgctgtgggcgttggttttgaactattcttttttctgctattttgttttacatatataaagcatgcatttattttctggtgtacttaacaatttgagaaaatagtcacagtttgctgctagcattacaggctttttaattgaatcagatattttaaaacaatatcttgtttccttagttaatatactaatctgctctacatgctcacatggtacattgagattatattttgtattgcaaatggaataacatactgatttttccccacagattttccaagtacgcaagggtcaaccagaaagaatccttcgggacatagctggaggtcgtggacttcgagtggtgtcctcagtcatcgctgacttccacataactttgttatccatcatccaagaaggccgaggaatcaagtaagtagatcccaaaccgagccttttttttttctaaatgcagttgataaaattataattatgttgttttcttctcaggcctatcacatattcaagagataatgatgcatggattgttgatactggaaaatgcataagcgagtcaatctttgtcccagagggacttccccttgactccctaagtcagggggtatcgggatataaaaatctgagcccttcttgtaagctcagtgttctgaactttttgtgtgatgaaagtctttctactgagtaagtattgcctacacatttgttaatacttcccttcgctattgtgatgttgttatttctgattttttaaattactcttaacattgttcaggaagttgaggagctgcatattatctgaaacaaaaaacccctccagagaaaaagctcattctgcaaaagagaaggttttgatcttggcttgcctttcccaccttgtcacatggttctagaacaattgacaaaatatctcctgtttgttaggaggagccaaaagaagaaactataaagaacacagatgaagcagtgcttttgaaaactgaaggagcagctgttgctattgaggaagataagaatggcatttctcaacaaaaggatgtgaaagaagtaaagaatgcagacacaaatggtatgaattatattgctaaacatgcttcgtcatagccttttaaacagattactttagaacattttgcatgatctcctgcactgtttatttcctgtaatgcgaaggaaaataagctgatcattgttattaattttgttctcaactatgaactatggcaacatcagaaaagaagcatggaggtttccttaggactaatcctttcatggtagacaaaaaggtaatctattggaagctggatgactattgtaataacacaacaatgatgctccaaggtttgttggaaagcgttattcaacatccttccactaatttcagttctgcattataaaattggagacgattaacatctgtctgtatcagaggttgatgctgatgatttaatggggaacaaagacaagtggtttatgcttaatgaagatgaaaagaaaatagttgaaaactatttatccacaaggtaaggatttctccatatcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataacttgcactgtccacacattttcctagctgaagtgatgcaccacattaattaattatagcttgcattgtccacatattttcctagctgaagtgatgcaccgcattagttaagagtttattttgcatatcaagctagtggttccttattttctacttgactgaaacttttgtataatacagggtttagtatgataattgataatgaagtgagatattgagatgtaacatctttgttccccactagttttatgttgtaatttcaggaaatattttaaaaaaataatcaaaatttgacatcagaagtttagacgagtatgcagagaattactgccaagattggatgaccatcactggcttaactattaaggaattagtttatttattactatcataataatgcaatcagttatctttttaataacagaatccaaactatcagttctgatgttttcactgttgatctaaaggtgctatacaaatgtttcaagaatcaagattatataggttacaaaaaaattgccatgtatgttgacatgctgaagtttcatcttgtccttgtgatgaatgcaatgatacttgttgctcattgattaaaactaacgtattagcatattctacttccaacttctgaaatagcatatcagtaacttgttatcgctttcctcaattggcaatgttttaatacctaatattgctttcaataactttctctctttactcttatatcagatcacacaagctaactaagttcactttgtttttgtcaactccatgaatagtagaaattgtctttgtcgacacagtttgtcactgatctgacatgtgattttaactggtaatacaggcctaaacgcagggggagaaaagctgcacaatagtctactgatcatactctctaggttcctcacctggctgaaggtaccct

SEQ ID NO: 46929 - DNA, 4131 bp, Oryza sativa
  unsure (1)..(4131): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcaggtacaccaaacacacacttatcagggttcagctttatgcgggcggagcggaggttctcaaaagtttccgctagatccgaaagtaaagtttcttggttgcgcgtttttacaaccaagtcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgctgtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttctggggcctgccgccgcactttctgccggaccggccttgcgcccggccgcacggcgagacggtgctcaatcacctccctggggaccccgggcatgtctgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcgatccgctgcctcggggcggtgggggcagaggtgccaagcctctcgtcaccaccctcgggcttggtcgcagcagcgaggtggtccgcgcgctgctccatgcaagcgagcgcgactttaaggtcgccacggacggagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtatgccccggcgtcacaccgataatcggctgggacggtcggagcaccatccccggggccttgatggcatcaaaggccgcgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaaatgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatctccatcatcgatgtcaacagcgggggccttctgcttggcctcacttcgccgtttgccggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttatcgctcgcaggcctcccctttcgagtggcccgcggagcgccctcgacggcgaggacatgactctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcaatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggcgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccgaccgggggcacggagggctgatcctcacgtccatgtcgaggtgacactctggacgaagaggcgccctccgttgcgcggggagtacgccggttattacgccggcgctcgatgtcgaggcgggcatccggctccccatgctgatcctcccgagttggaggtgtcgacgagggagtggcagccgaatgacgtgcagccgccgccgctcgccgcgccctccgccttgatgacacggaaccggtggtggcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccggcagcctgaagcgcgccctgaggcgtgctgccgtcgccgtagacgaggaggcgacgctccccatctcgccgttctcctgcatcacccacgaccggtgatgctgcggatttatctaccctctcgagcgcctccccctgcttagggctttggcgaggaggaggtgggggagtacgagctcgacggcgcgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctggtgcgccagatgacggagctcgtggctcctcaccgggagaccgcgcaggcccccctttgccggttcggccgggggcttagggtgagatctcaagctctctctctctctgtgtgtggaaagatcgtctgctagcaagaaacgcgagacaccggcgatgtatacaggttcgggccgctgagaagcgtaataccctactcctgtgttttggtggatctgtgtatgaatgagctacaaagtgtgagcccacctctcccccgttctaagctctgaatctggcaagaatcaaccaaccccttctctatgggcaaggtcctccttttatacttcaaggggataccacatgcacccttccctttccaaactggacttttcttctctttatgaacggagattggtatggttgccgtccgaatgacacttcgatgggacagcccacacctacctccactcccggcggagacgggcgcaacgtgggatcgtggctgcccgttgctgacgcgaccagtgtcagaccggtcattcttgtccaccacgcgtcagtttaacaacgtgcatgtttgcccttcttcgtgtaacaccttgcctgtaatggttaggatgaagcctggtattcatctaatcagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgaca

SEQ ID NO: 46930 - DNA, 3272 bp, Oryza sativa
tacacatatatatatatacacatatatatatatatatatatgtctaataggtcaacctgaccggcgatagcgtgaccacgtcaccctcagtgctgtgctagcggagggaatggttgagagagaacacgagtcgacgatagaattatcgccggctgcagcacgcaatacaatgaagaaagagaaataagcctgatgaagattggttcatgcttaaaacaatagtaaagaatgcagtaattagtgggacccatatcaattaaaaagtatatttgctgttaccataaatgataataacgaccattcttatataaatagcctatactaacagactatatatagatgatgttttatagcaagcaagttgacgatattattaaacctgctcttacacactctacctgtctagctcgaacgatctgcatgcattatttatattttttttgcgggggcattatttataattaactgatccatcatcttccagagataattatcattgtcattacatttacttagtgcattattattctttttttttcggggatacttagtgcattactatagagtacatttatttacctgttctgcttttcagccgttgttcatgtcttgaagccatgtatttgcaaacgtactacgcctcaactaactctgtgttcctgtacatgttcgtgcactacgcgcgtgctcgctcatgtgtgtgtagtgtgctgcgtgcagtgcaatggcatcatgcgcgcggcggctgcaagttgcccagttgggcacgccccgcgccgtcatccttcgcggacaagcccagcactgggcttagcttctgcttttccttttttttaagactcatgcactttatttaatataaagtttagatgcatggtacatgagaaagcacagcaacggaaagaacatccagtttgcagaaaggctcctcagaaacggtcaaattattgagcatacattgggaattttgcagaaaatgacttaaaaagaatgggaaaaatcaatcggattctctgtctgcttcttccaccggaccagcgatcctgcttgtgttgacggcgatggtgaagatgatagtatggcaagcttcaaaacatagagcaggagcaatcccagttggggcctctccgctatggaggttgaagctaccatggtcaaaccaataaatcaaagttgccccttgcagatcggcgctcttgtgtgagtggttgctggaagaaagttgaacggctggcacaacatctttgcaatagaaactggagaacttcgagttgcgtatgcagaagagtagtaaggcatacgtaactcacccgatggtcaccagccatgtggcatatgctaaagtaagcttcagtaggtccattcatggccgaagaactccaggacaaagaaggtagatgccactatctctttttatttgagcaagagaaggaaaaggaaagacccacaacgagatttacccgactacgaaacaagctcgacaagcccacttccttgccccggcaaccaatggagaggagaggggatctggcaaagagaaaagtatcacctcaagaacatctttctggggaagtactgacacggagagacttcaagagagtccacccactgggctagctagctagtaggccacatgtctcgatgcatgggcatatagtttccttcaactatttttgaattgaccacgtaaagatttaatcaattaatatttattaaaaatatgtaattacgtctagaaatatgggagatattttttttttggaaatatctagggaacatacatatccttttttattccataactttgaaggctttgtattttttgactttgagtaaattccatagtaccacaagtaccatggttcaaaatttagagaaaaattggggttttagcatatattccctccgtctctaaaaatagaaacttaatctaggaggggatgtaatctctcctattacaacgaatctggacataaggttatccatatttattaactaagaggggataggttgagttttttttacagagggagtaagtaacaaatatcttagtgtactaaaagaaatgtcaattttatttcaataaacataagtaaatacccatacgggctataaggaaaaaagaaaaagaaaataacctctcgacctgaagaatctcgccaaacatctcagataaaaaaacatggtcagcttgatagcacgcatgtcacgcctggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcagtaaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaacaaaacagttaagtaataattaaacaatattaatccaacgctatacaacataccctgttgtataggcccaaccatttctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctggccagaggtgtaccactgtacccacaagacacaacccacatcatgttaccatgtgcctcaataccaccacggtatctcggaaaggagttgtgacaatacccctcgcataacacaatccactgcagcgcaccatcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattat

SEQ ID NO: 46931 - DNA, 49715 bp, Oryza sativa
  unsure (1)..(49715): unsure at all n locations
atctagttgaaccaatataaataaagttcaaccagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaatttagggacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcggctagggtttgggtggaccggcgcatgggcggcggttcacgcgaacggacggccgagatttaaccgatccaagatggacggccgagatcgatcggtctacgaccggctcacagcgaacggccccgatgacgtcagcgatgacgtcatcaccggcggcggcggctcggcggctcgggcttgcatgctcgccggcgaacgacggcacagcgacgcggacggaaggcaccaacgggtagcggacggcacggcgaactcaccggcgaccaaagcgacggcggaggaccaacggacggtgacagcgacgaggttgaaacggcggcgctcttcggctcgacgacggcgacgatgctccggcggtctccgacggcagcgaaggggcggacgaggacggcggcgacttggcgagcacgacggcggtcttcccgagcgacggcgacggctgaaacgacggcggcacacggctggagcggcggcggcgacggcaaaagctagggcacacggcgctagagctcttccggcgacgagaggcgaaggcgagggtggcgacgggtagaggagacaccgggggtccttttaaaggggctcggaggcggcggcgaaggcccacggcgacggcaacggcgaaggaaaccttcggcttggagagagggaaaccgatccgagtcgaactcgattccaaagctttccaaaacgatttaaccgaagattccaaaggagaaaaggtagaggagatcccggagatcatttcccctctaacaaatcggccggagaaggaaaggaacggccggatttggaaaggaaacggcggcggcgcgaaactagggtttcgggcggcggcggccgaaggtagacgacgactgacaggtgggccccacctgtcagcgggcggacgcgcgctcgcgcgcggcggactgggccggctgggccgaggagagagaagagaggttttgggccgactttcggcccaaagccaaaagagactttttaagacctttttcaatttaaattattccttaaatgcaattccatttattaaaaatacttccttatctcaaataaatcccagaaaaatctaggaattaaagaattaagcaaagtatttaatgaaattttatctggcccaattttatattggaatttattaattaaacttagattttcttttcaagacttttaaaattatttctaaaaattccatttaaacaacaatttatatattttgaattttcagggtgtgacaacgcatcacacaccacatcctacaacaccagttaactatcaactaaaagccctggtaaggtgctctctattagtaggataaataaatccaaaccgttgatctgtttttatttaagggaccggatttaattataccaccaccttaatcaataatagtagtataaatatgagagagcataatcgtccatagaaatataagcgtggacggtcacactcgtaattttgcagatcagcgtattggctttgtatttccgtgatacacgtatcccctagttatgatgttctcatccactgttctaggatgtcgtcgttcgtacttccgcagtcgacaaacgcgatagttcgctgccatttcgcgccattgacacaagcgatgcatctcgcagcatcttcgcttgtggtgccgcactgccacctacccatccgtcgtcgacgcagatgatccttcgaggcctcgtaccgtagaaacaactatgaatgcaaactccggcagaaccttgccaacaaccatggcgccttgacaatgaagcatgcattaatgactaatgaacactgaaaattccggtttgtcctgtatgtattgcgatgagttcttgaaaatcctagatatcaacatgctagcacacttctagaaaattgatttttcatgacatcaccctatttttttttctctagtggttatacgtggaaaccgctagcataaatattacgaggggtgggaggctacgaaccgccagcgaaaatagatttttactggcggccagattaagaggaccgctagcaaaaatatacctattttcgctagcggctcacttaaacaaccgcttgcgaaaataggattttcgttggcggttattttcaaaggcggccgataagaggaccgccaggaaaactaaattccccatattaaaaccgtccaaactcgcaacctagctagtcctctccttttcttcctccctctccctctgtcttcttttttttttttttgcgcagctaagtcctcttcatcttcctcctccctctcagtcgccggcgcgccccgtctcctccttcctccctctccctcagtcaccgaatccgccacaggtgaccacgagcacgagcgcgggcggaggagctcgggcgtgggcggggagggcggatctgccaccgtcgagccgcggggagggcagatccgccgctgccgggccgcgggaagggcgcctccaacctcgtctttcgggccgcgccatccaccaccaccggtacgtccgtctcctcctccttcctccctctcggcctctccctcagccgccgaatccgccacgggtggccacgagctcggacgcgggtgaggagggcggatccgccgccgccgtgccatggggagggcggatccatcaccgttgggccgcggggagggcggatctgccgccgccgcagggagggcgcctccaccgccgcctccaacctcgtcttctgggccgcaccaccaccacccgccgtcgcgtgcccgcctccgccgtgcggttcgaccggccctccgcggtgctcctgctcctgtccgcggcggagacgggcttgtgcaggccagggcggtcgccgccgccgaggcatcctgaggcatgaatcctagagagagagaacactgctgctgcatgcatggatggtttcagtgaagagcttaactagatgtgattatctgctgatgactttgtgggtgtaaatcagattatgtgttgttaatctgtttatgtgttgttgatgatgccaatgttgattctctgtatttggattgatgccaatattatgtattaattttgaatttggggtagggggtttttggcgggctgggttgattttcactaacgcttatctttaagcaaccgccagggaaaatgagttttcgcaagcagacgtcaaccgctagaaaaaaatcatttgtccgcttacaaaaatcgattttcgcaagcggaccgaaaccgctagcgaatatcgtgtgtccgcttgcaaaaatctaaccgccagcgaaaatcttatatcttcactggcctttactttatggcggcttcaaatttcgtcagtgaaaacctaaaatgaccgtcacgaaagatgattttcgtagtagtggcatttctagtaggccatatatgtgtgttcattaaccatggtatgattgaaatcgttcaatgcaaaagaacatggatacaatttccaaatcatttcaatgtgtcgatgcgtgtgtatggtcgtcgatcccatggttaccgtcgacatcccaaacttgtcgtcattatcgtgtactttgtgcaagttcgctagctacggccagcgaaacgacaacaggctggtccgctggctttaggcgccgatggcattgacaccgggtgacgtttcttggtcatcaactgtgttggctggcgaatggtccggtctccggtggctccatgtgccgagggcgtcagcattagcgtggttatgctgtgagtcaccggccacgtcggattaacgaaaggaaaaaaataattttataaattacccttaatcatagaggttgtaaagttatgatatgtccttataaatcgatgtttaaggtcgtttctactggtagtgtaataatattattagtatagagcactgtagtggctctcatcaactaaacaaggatacggagcccaacgacacagggtattgttatgcacagcttgtcaaaaaaacgacacatcagttttggcttcacaaacacacacatatatatgttatcgttgttgagcttgtcaccttaatgacacagcaacccctacctcatatcaaacacgtcataggtaccaactactaaaatgatcaagcaactccagttttccctggcggacatcagacaaagccaagtgccacttcctccacatagccagtaccaacacatcaagaaaatactacatgtgtcattgttgctcaacttcgttgcaccccaacagtaaagcaggtccaactccagctaccaatatcaaacgaagatgtctagtcatccatcgtgaaacaagtggaaccaagtaggagataaccttgtcataggcctaaagagctttgcagccggcacaagagaccaccaacggccaccattgcacgaggaagattgtcttaagcggagcccccacggaggatgcaacgtgaaacacccccatcattcgtccgtatattgtagcaagatttcatcataaaagatttggttcgagaggacaggggccataaaaaacgcctgcaaagagggaaacgccgcctttgggcattcatctttaagttggccattggctcggcaaggttttcaccgttgattctactcgagttacatacaaaatcaatccacacaatgaccgtcgccggaccaacatacagttcctccaactaccaggctcatgagacgaacactcatgaggacccttaattttaggacactcacatgagcacaaactattatgcataatttattttttttttggataaggagtactccctccattccattttaaatgcagttattagtttccatgtacaacgtttaaccgtccaacttatttcgaaaatttataaaaaagttacgcatagagtactattcatgttttaccatctaataataataaaaatactaatcattaaaatattttaaataaaacgggcagtcaaatgttaaacatagaaacccacttaaaataggatggagagataactgttttctgaacgtaaggacaggagcccaatctaccaatcagaattaactagaaagcgtttgcgccgttggcgcactatccatatagcgtgtatagtgaatttaatattgtttatttgtaaaagagttatatcttaagaaaaatcttttagcagtttttaaattttatgtcagcaagtccgagaaaaacattatgtttgtaaacatttaaattacatagcagataaagcaaaacaaagggcgatattaatttatgttggctgatggtcgatttgattgttattaataaaatcaagctaaaaaaatgaagtaaacaaattgcttgggactttcataaattagagatttatataataaccctaacaattgacatgcttttttaattggtcatactttatgggaaaatggaaattattttgttcctttcctccttcccatattttttttatttcagcctatataaccttttcattctatttatttattttacttttagagtattaaatccattattttgatggttgaaaatgttatcatttgtatatctatcactttctcgttttctcttccaatatatgcttatctgcttattacttagcaaaaatcgtcatgatcgcgagagggccacgtggtgcacatgctaagagccacatgtgggttggcgccgagggggggggcgcctccatatgtattttatatacttacatagttcattcccattaacttaatctcatcccacaatgtgtcacatcacctcaaattatatggccattagatcaacaatcgatgattaagattcactgatttctattctaactaccgatgtgcaatgaagaacacactacacaagagtctctttgtatgccaagccattccatccagttaaaatgatgctaatcttttatggtaagtaatagcccatttagatgatagaaaattatatagctctatcatctcttagatcattcgcagtacaaaacccttctataaggagcctcaaagtgtcttgtatgatgaggtaacatgtttgaaaattgtttatcccacaatacaaagttcatgtcagctgtcatgtttcttaattcaatcctaacattttctttctaatttaaaacgtagtcaatattttatactgagcatcctaaaatctcccctccctatccttttccaaatccatgcttacctatttctagaaaataggtgcgtcggttagcgtactaacttaccgctatgacatatatttaacataattaatgttattcatgtttagagttccaaatgtagtactttagaatgcttttttcaaaaaaaaaattcaacccttttctcttccattaaacagagtaattgacacctattaacaattggtatgactatacggttagaggactgaaaactaagttttttttttcaagtctctctatgagaaatttcttgtgctaatctacccatgtgacctactcacatctctggtcttatatatgatattccgtcatcttaaaatataacgatcatcggttgattagctaatcataggtacaattgtgagagcaatattgttaacaattagagtaatataattatacttcaatatttcaagatatgatttgtgaatgggcaatttacttgtttaagcttctctgtatgcctttaccaagtactttgaaagatgtgtcttttgaattagtaggatttacaaaatttgtcaaattattagaaaatttcgaaatttatgtattgaatattattttaggtaaatgactcctatggtcaactcaatatacagagacataaaagtttactctttactctttgtacatgagatcggttttggaaagttgaaactttcaaggtcctggacatcaatatgtgagtactaatataggggcgtccttaaaaatatttagtacttagtgaagtatagaataaaaataatgttaggggtgaaaatgaaaaattcctagagtatgatgccacgtgcagtgcaggtggcctttgggagcggtgacctgctgctccatccttcattatccatctctgcctttccccttcaatctatcagttcacttagggagtgtttgaagagaaggggattgaggagattgggaagatacgcaaaacgaggtaagccattaggtcatgattaattgagtattaactattttaaatttcaaaaatagattaatatgattttttaaagcaactttcctattgaaattttttgcaaaaaacacaccgtttagtagtttgaaaagcgtgcgcgcggaaaacgagagacaatctctcctatctccacctaacgaacactcagtcttttctgcgtgagggaggcagcggagatggccagctctgcatgcatgtcggaggcagcagaggtggcggcgaaccggcgatcaacaacggcgggttagtaggagtagctgaaggcccgacaccctcgccaatcccgtcgtgctcaccgccggccagcctgccatcaccaactcggttgtcgtctctgccagcagcgccgtctatcccctctatctccccggcgccccgcttctaccctctcccggcgacgccttgatctgggcgactaggtaagatcatgtgaggtcacggtggtggcggaagcggcgagccggcgaggaggttgtcgaggaggcgatgtgagcgatctatctgtcgcagaggcggttgaggctggcgacgagaaggatggtgtcgagccgagctgttccccatggatatggcgatggcgtggacccccgccgcccctactcctcgctccgaggcggcgctggccggtgagctccggggccgacgcacgacaaggcaccatgcgggccggcaagctctgggtcaatgcagcggattaaggctgggcggggccttcttccggtggtacatcgagctcgaggtcatcgtcccggcatggagatcaggcgaggggaatatacaatctgttgttttcgctggatttttctcgctctttttttttttgctttttttttctaggagtttttcctctgctcccgactgttctagatgaggtcgtgcatttttttaaaaaaataaactctcgtgcaatttatatttaggtctgttggatatatttttcaccattgatttgtcatcggacggttgcgggagtgtgcgaatacgtggcatgcttctccagccgataatacgaacggagcacagcgcatgtgccacgtggcccaatgagaggtccgggattggacccagaaatcgtatataaagattgccaaatctttactgctactcaagctagattcactgcggttgcttcaggcaagttgatgcacagaacaaactttctggcctttggatacgtacgcttcacccacaatctagcacatatctacccgtccaagatttgacggcgctggccgccgcaaccatgccggatatcccctataaatacgcagccatctcagtgatccagtgcactcaccaccactgcaagctagacagcaagcaagccatcgagcgagctcactcttcttgaactcttagctcgtcgatcactttgctctctgtagcttgctgcaatggcttgcactcaggaggttgctttcggcgtgaatctgatcggcaacggcgccggcgccggcgccgtcgacaagctcctcctcatcctccgccgccgctgcctcacgctactgggaggaggagcagctcgaagcggagctcaccaaggtgcacagcctcatcgccgccgagatggctgtagggtggagcgtgtggcccgtcggcgacgcgcggcagcacgtcggcgccgagctcgccgccgtgctagagtcctgaggcctgacggaggaggttgcggcggcgctgaactgccgctcgctcgccgcccgcatccacccctgcgccgcacccgctgagaagaggagaggcctggccgcctagatggtttggctcgtgagcctaacgagctagctcgagctttcaaacgagccgaaccgagccagctcgctattcacccctaagtacacccatgcaaacgtcacattccgacctcgcccaaaagtgggcatggcaggccatagtgtaaattttgttttgaaaactcatgtattttattgattatagataactaagtacatatcacatgagttatccctagtggagagtcaactgcaagtacaagcagttttgcataaaggccccttgaagattgtcaaattgacataagctcatgaaaattgctatggacttctaaagaaactagaaaaaacaaccaagtccttctcttttccactaggttgcaacttgcaagcttgatcatgacgaggacggtgatgaagaaactatgagtagctacagatgaaagtgcaaggaagcatacccaaaagagacctccacttgaaggttgaggcttccattgtaaaacaataaaaactctcagcttctctcctaggcttgcatccaaggttgcctcgccggagatgaacaaaatgcccggcgcaaccgtttgtgaagcaaacttgctttacttccagtcggggagcgttcatggcaaaacccaaagaccactccatggatggatttggccagaatccatggaaaagaactgggacaagagaaacacgatgctgatgaactacacaaaagcaccaaagaagaagagaaaacaattagggtacgggaagaactatacccccttccccattgccggcaaccggaaccaccggaattgataaaggaaaggggccggacggagagggacctcctttatcgcctggagagaggacaccgacagggacagaaagtcccctcaggccgtactgtaaaatggatcgcaattttcaaccttgaaggacaatggcaacttggcaagtactatctgcgagtttaaagaaacatctcgtaccacgaccaagcacctttgtgcttctgcactgcaaaatcttacaaaaagaagctgctcaatgcaacatcttacatcctgtgaaactgtcaaatgtgtaagctaatgttgtatcaaaatcggatgccacggagaacaaatgatgtgtcggtatcattctttcttggggacaacatgttccgcctggaactgttcctgtggtttgcttcgctcctgaatcagcatcttctggagacctgatggctgaggatgccaaaatctcccactaccaatcttttttggtggcttcgagactccgaatagagttgtcgcaattagaagttggaactagaaaaatatggacagaatgagtcctccagcagcatctgcattctcattgatctggtaagctctgcatgaaaaaacaaccagataaatagcccttctagaaaatagagaaacgtgttcaagtaaaacaacaggaataggattcttgtgagcaaaggtaggactctggtgagccaattaaagagcatatgtagcgtaagttcatgattgttgataactctagcttgactgcccattaacctataaaaaaaaataaggagatgctgttcctcctgactcctgcaaactctctgttatgaatagcttgtgtattgaataatagccctaaggaggcaaatatatagggctacaagaggccaaaatatgtatagagataaactatacatgtaaaggactctatttcttaacatcctcccttaaatgcaaagcgtatgcaatagcattgcaattgaaagagattacactaagtactaaaacttagacaatataaagctaatacatccaactctgtaaaatgtcgtcgaagcgtgaatccttgaagacctgtcgaatgaagccgaagataaagtcgtgacaatggcaatgaaaagtatccttggtcaagagcagcaagcaaaagcggcgaagagcagcaagatgacaaagaaaaatgatccactaaagctacaaaaagacctagatgatcttgttgcataaaaaacgacaaggagattaaccaaacaataaaattggctaacactggaggaagacagcagatgacaggagtatgtggacgcacagggcaaatatgaactcaaacagaaaatagaatgaggacacaacggaagaaaattcaaagataaaaagatttgagtatgtggacacagcagaaacaaaagaaattggaaccatcaaaaatcatcaggcaacgaggaatagagcctgacaaaatacgtggaaggtggattttctttttcattatcctgatcgatctagcagagatgacagacatgtaaagcagtgcaaaccaaaaggcgaggagcagcagatcaaaaaggtgcaccctaaccagagaagacaacagccctacacatcctaatcgatctgctcaaagcagcaaactaggaatggaagcaacaaaaccaggaaccagcggaggaagcagcgacgctggtttgatgagaaagtgacgcagagacagcagcgacgcacgacagccatacacggtggagaagcacagcggcgatgtcagagacctggcggcaaggatgagcggccaataatgggaagagccatcgacgacgagaggaaaaaacgaaaatggggccacccccaagagatcaatctcctgggggcagcacggatcagatgctctgataccttgttatgaatatagcttgtaataatagccctaaggcaacatatagaactaaaaagaggcccaaatatgtaaagagataaactatagtactatacatgtaaaggactctatattccttaacactctcttgctactatttgttcttgatatgtaattggatcaatctatgctggtttagttcatccaaagattgttgagcacaccctatatatctggaaaacatatgtgcagatctacatacttcatataccctttaactaccctaggaactcttcagccaaatagttgagtagcatacttgcatttgccacaaagttacttaaatataactaatatgccacaaagtaagtgtgaatttgctcctttgccacattggatgctaaaccaggaatatgacgaatgagtttatgctctggaggctagggtgcacaggacagcatctggagttgacgcacaaggtagtggctagctaggccacagccatggccagaatggatgagtgaggggagatgattggtgcaaaattttcattccatggtgttaaagagcaaattttcaccggacattttgtgttattttagcaatgacaatgaactgtggaaaatgtgagcatgccactctcttatatggcaaagtaacaattttctcttcaaataattactattttaataggaataaattcacttttagcagcccagatcatcccatattctaattttcacctccaatttggaaaccatttactacatcctccaaatatcaaacccagtctctcttcccgaaaagaaaaaaaaatccagtcagattggataacatcataaggtcaataagctccagttctgtcaattatgccatggtggtagccatatggcatcctagccaaccgaccataaacggaagaacatcgtgacttcggtagcaaagtcaaggcatgcggttagcttatgtaaatacactgtccactgcatccaacatccgtcctgagttgctgctttcttggcttgcctaagtgtagcccagttcggcccaacagcacagcacatgacagcatggagggaaaagacaaagttcatagcaatggtgcagagagaacagaaatcattgctcagttttggcaccggttaaaacaaaataattgtgtagcttattcatcaatcatgaaacgaggtcacaaattcttgagcatagcatgtacctatatttttagcaatgtacaaaacaactactcaaaatggcatattcattttcttaaaaaaaacatattcattttggggatgtttcactttatggaaatgaacctttgttttgtactggatggtgttatattaccattttagtagtacttcaatactgcacttctgcttgcagtataaagtatcgcagttggttcccgtacatagcattaagtagcaagcaacagcaaaggtcatcttagtaatgagtcttttggcttgcttgctacaatggatgtatatttaggtaagctaaaaatgcagcaattcaggatggatgttggatgcagtggacaaatatttgaagcccaactgcacactatgagtttgctaccaaagtcaagaggatccgtttccctcacagaagcccacaaagcccactggaaggagccttgccctagaccggggaagtgtccacaggcataagcattgctgccttggaagttggaacttgggaaaggagaaatggggtgtggaaattataggcatttattgtccatttcactttcggttgctgattgagcatgtttgttgtattcagatgccacatagttgaaaaccaggtgtgttaaaaggtgggtttgtttgatctggtttaagaattgaggacaaaacttaaacagtttttttattattattattttttgttattgcggggaagaaaagttttgaagttgagggtgataggtatactttcaaaagagttaagggacccaaagtaaactttttccttgaagtattggcgttatgtatcctgacgtcatctgcttattaatgtataaatgtcgcttatcttatgtatcctcacgcatttggttagtttgttaggctttattagataaggttgttcggaggtttgttaggagccagctctatacaaggagtggcatggcagtcaattggaatcaatcaagaaagaaattaaaccctatcgctagcctcccccttctctgttcctcaacccggctccagggtggcgaggctagacctcatcatcccgttgaaggcccactccccacccataacaattagttgtatcagggagctttaatttgccctaaacagacaaacaacagcacactttacactcaggtgtagaattttcactttattgagctataatatagcagatatattgttctactccaaaataaatcatgggtcatggctattacttaccaggccaagagcttctgcagcagttctgatattaccagcagtacagatgctcctatatagagataagagatgaaccctttccgcaacttgtaaattcttcttaagtccaccagcaaccatttccatttccgcctgtaggggacaaagaaacaaaaagttgcataaatatgtttccattaagaggataatatgcagaaataacattgaaaattgcgaaaaatataaaacctgttttttttgttatattaaggttatttgcatgcatatgcatacagcacaaaaaatggtctcattcactcaaaaaaattcagttagaatctgttcatataatagcaatgacaatctcagaagcatatatatctttctgaaagtaaatttcacaaatcacaggttttgaggcacacatatcacaaaaccacaggttatacattttatttcacaatacaacagactggggggcaaattgtaacacagaacccacttccaccaattcccgtcaactaacaggtggtggtggtccctgttcattagccccaaagcccccactttcttccccattcctacctgtggcagcatggtgagagctaaggtgtcatgtgaagtgaggtcgaacacagggtggttgcacggcaggaaattgggagctggacagcttcatcaacgacatggcatctgcagattgcccaagctcaagcctctcccatcaattctcatgttggactactatctggtgaatttgccccgtgagctctacctccattccaagaaagcactactgccagcgccgccgatgacttccttactgctctcgtcctcctcgctgtcgctgtgcatcaaggaatgactccattgcttgcctcactgctctgaagattaggaagagggtgtctttgtaactgatttttttttccttgcaaatgacaacagttgatttaattcccctaaaaatgtgatagctaattcatatataatggttgattgctcaatgattcgcttcttgttggttttcctggagaaattccataaattgcctttttgggagttcatattgcacgagctgctagctctgtataccagttgctgtcggggctaatttcttgctgctgatgtttgcagtgatggagaagggcaagtgtgcatagtggcaggtggcagaagagagggagggggaggaaggaagaggagcgatgcgctgaccaccacctgctgtttgctcagatccgatctgctagaaaggaacgtgagaaagggatgaggaagaaaaaggtgaagctgagaggtacggcccatgtttacagctgacagaaataggggttttgttatactcatgcctcaacagctggggttttattaaaaaaaaattatagaaccctgtggttttgtgaaatttactctataaaataagctcagttatgctcaggtagacagatatgactgagggaaataacattatgacacaactgatcatgaaactagcacaaaaaaaaggctaagcttcatgctagagacaaataaccagtaagaacaaagataactgtgtagtacccaggttgaattaaatttctaaagcattcactaaaaaaaactactggtattatgcacagggatggaacatgctaaaacatacaccagactcagaaaacaactgtagtaaatcgcttggctttctatgtctactcttccaaaaaggaaagttggccttggtgttaatacttggctacattggagtttggatatatatcaatatgctgtcagaatgtaaacaaattcacaacataaaattttgaccctatcatgtaaaggcattgggacaacagaaaacttgtaaaggcatcaagacaagttatacaactaagggttatacgtgtctgaaaatgtaagcagaaaaatagtaatgctcaaaaccaagttgaaaacaaaaaccaaatacatacagaattttcctctggagggaacatgttatgaattctacaaatctttgagagctcatctagagcctctgaccgttttccttgcatctctagtgcctgcatgcggtgaacacataacatcagcatgaccatgagatgggtaaaaacacaatcaggtttgaaaatcgaggtaaatccgtacccagcattgcaagaacaaagaacgtgtgcgagcagcaactgatgcacaaacaagtgtggcagcacggaatttatccaatccaatattgctagcaagaccagcaagaaaattccttggattctccccactgatttgtgctgctccaatgtcttgtgctgctctttattaagcagaaattatcagcacagtgcagatcaatggagatgataataaaatcaatagtaaaacaaaaggaggtaatagcaacaaaggttgaagcaaaaacaaaaatacacctgctgcaatcatccagaacaaagtttattgccgccctatagaaagaatcacgagcattctctgtgtcaaaagagacctttacacctgatatcttgcataattgccttagctacattcaaaagaaagatataattaggcaagagtggaaagccctatcattagataaactgtagcaatattcaaataacatctctggtgcacctaagattggataactttggagtgttctgccaaaaatatcttaaatcatccgtttaacaacatttagaacagaatagccaaggatcttaagatcatgcctataaaccatattactagaatattcagggttcatttattgacatgttaatgcctaacatttgtatcattccataaattcatacaacagatcagggttgtgatgctttctccaaagctcgaaagttctataacagtagggaacaaaacaagaataaattgcattaatagccatcatattccgatggttcagatatgtcactgatctcagaaacgaggtaagtccacaaatttctgttagtgccccaagcaagataattcattttgttggctgaataggtgcttaagtggaactacatgctgccatgacaaacaacatccacgcaagagtcaggataagatggatgacctaaaatagtctggttctaatccatagaacatagtatgaagaggatgccaatgcctctcaattgcaagcatagaaattatacagaaatgaaatatcataacactatatcctctatggactacaggtaaaatgaatactaacttgaattgcatcatcatatttgtaatccttccccgtgattctattatcaatgattgctggcacaaggaaatattgaaaggtctgagaaatgaagcagcaagtttctcatgaatatggtgaaagatggtataaattacctgccaacaaaaaaggtaagattattaggtatttactattttgtataacctaccacataaaaccatatttgttcaaaagacaggggaaagaggtattgtaggagattattcaaatgatcataacaaatcttaaggatgaatattttctatttggatcatcatactaacgatgagtgttcttatattctataaaatgccaaaaaataagctagtagctaaaaacaaactattgccaaacttcacatatgacaatacaatagcagaagaattcacatttccattttgatagaaatcttagaattggttaggctcgatgccataaaacaataaagattgacttttgaagattataccacgatttggtcttgaatcggtactgaagcatagcaattggaaaagttattactaacaagctctcatgacctgatccattctcatatttctgaaaattcaaagactatgctcctaataatgatgaattgaatgggatccaaaacaaaacctttttgcagtttttgcattgttatcatctattagtaacttagcatgagtgatgatcataacaaataaaaagatgttaacaccaccctcagtatcccaaatgttaccaccacaaatgaattatggatttgttctcagtttcccatatgttacgcgtatttaattttcaaccaaggtgcatccaatgaaagactagctaatataaaacaggcattcacctcggaccaatctattcgctaatctcgcccacttttccatccctggcccctgatccaccaccacctcctctctcaattccggccaccattccggaagccttgcctttggttccctcctcttgacctctcttgccggctcaggcacacggctgactggagccgccaccggggacgacgacacagcgaccaccacctccttgccacccaggctgcggtccctcctccgcactacggccgcgccttcccctccgcgccaccccaggccccgccgctgccaggcgcggacggcccaccccagcagcgcccacgccgcggcggagagcgcgagcgaccagaggagcgcggcggcggcgaagcgcagggacgagcggcggaaggtgaggacgacgcggtccccgccgacgacgcgggcggagtagcggaggtcgcggtaggcctcgtcggcctcggcggcgaggcggtgaaggcgcagctccgcccggcgatggaggcgccagagctccgcctcgagggcatcgatgccgccgccgccgccgccgtcgtcgcgggcggcggaggtggtgggagcggccgggacggaggcgcgcctcccgcgggggcggtcgctgctagggtttacgccgcggaagcggcgcgcggcgaacgccacggtggacgcggcccggtgggcgcgggggagttggtagcgagagagcaatgggagggatggcgagaaggtagcggcggtcacggaggtcgccggcgcggtggcagcgacggcggccatggcatgagcttgcgagagcaggggggccaaagattgagatgacgtggcacaggtcaaaagattactcgttacatggttagtcgtgtctcgtgtgcaaacacatttaacatggttaatcatacttagaggaagtttaatagtgtagcccattgcttactccaatttcttccacatcatcttcatcaaacttaagaggcaaatatagtacaataaatgggctataatcatgatgcatcatatatttattttattccgcatgatcgtgatgctgcatcgatcatcctatcctcccggctcccgcaactctcatatgcttgggcccacaatttctcggaacacgcatatagctcggtgactaattagtcgctcgctgacgcgttctctctcctccagcgcacaatcaaaaccaacgtggagccgttgtcaccggcaaaaggatcttattgtacctgctcttataccaaagacaactatactttatatatagctgatacccactaacttttaaagtttaacatgcaagtgtgccatatcatcactcactagcaattattatacagagtattctagatttcatgccaacatgatatatcatttgtaatttagtttgaactttttttgacgaaaaaattttgtttgaacttatcacgcaagcaatgttaaatcaccatcttcacattatctaaacatatatacgtctatcattttttataatgtataatatacattcatccacatatcccgcagtaaagcgcgggcatcaactagtttaacatggtgccacaccccgaaactccgaattgaaattaacacggtgccttgatattctactccctccgtttcagattagaagttgttttggactttggtcaaagtcaaactactctaatttgaccaagcttgttaaaaaaagtagtaatatttttaactcaagacaaatatattatgaaatatattcaattatagatttaatgaacttatttagtgttgcaaatattactacatttatctacaaacttgatcaaacttgaagtcgtttgacttcaccaagtaagtttattaaatctataattgaatatatttcataatatatttgtcttgggttaaaaatgttactacttttttaaacaagcttggtcaaatggatggagtatataagttgcataggctgaaaacaccgaaaggaccgtagagccaatacagaaaagggcctcgacattactccctccataatgtaaggaattttgggtagctaacttcaatagtgcaggttatgggtccaattgcagaatttcaatccaccgaaatactccctccgtttcaggttacaagacgttttaactttagtcaaagtcaaactactctaaatttgactaactctgtagaaaaaaaagtagtaatatttacaacaccagcataatttcattaaatctataattgaataaattttcataatatatttgtctttggttaaaaatattactatttttttctataaaattagtcaaacttagagtagtttaacttttactggagtcaaaacgtcttatgagtagtattgcttctcgtaatgtttgactatccacctcagtttcaatcttaacaggccaaaaggaacaaaggatagagcagcaacctgtggttctgatttattcagacaggatatctccgcatgttagagataaccattggcccacatggagactacacgcattcatgtatataaactcacaatgttgagatatatagttttacacacaataaaagcagcagggaagaacaggacacctttttagaggtcaatttggtcccaaccacacaaacaatgctcatgtcgatgcaacaaatgtagtaatacttgggccctgtacttgtttggttcaaatgctaggctacaatgttgttgcaataaacaaatggctgacaccacacacactgatactgttcatcaccagctgccgttacaaggattacaaaactgttttgctttaggacgaaacctgctgctacgattttaattcccaaaccctgttgtaaagattgcataactcatgcagttctacagcaaaaaggttatagaagctcaccatcgcaggacaccttcaacgcaaaaatgtatcctgaaccaaaggccactaatctggacatgacaactgagtcggtatatggtaggaaaagaagcacgtattggggatttgaaacccagaggccaggcctatttaggaaaatggataatcatttggcgcaccactggtcacctcatggaatggcgtatgtggttgcatcgagaaatcaacaaggcctcgagagcaatctgcctgtcacactcacagattgattcatacaatggatgtgacccggacagagttgtctgcagacccagtaatgtacattggtagcgtcgggtgccaatccacacttgtaatagatgcactatgagcaagtgtcctcagcccactttcatggccttgtacctgaggaaaaattatagatgatttgcattggtatcacttctgcaaaatgaacctggaagtttgggtgattgtggagacctgatatataggagcccggacaagacccgatgtaaccaacagcctcttgccatcagaatccaatgatatctcatgcatgcgtttgctaaagctctctggactgcaaaacctggtgatagaaatgcaattaggaaaaatgaggaaatggtctgataagttcactttgcaaaatatactgtgtttgcagtccgttaaatacagcatctccaatcaggattgataaaatgcagctcaatctgatgtgtaaacaatgtttctttccaaataataatgtatattgcgtagacaaatacaactctcttaactgataaaacatacaatgtgataaacttccaaattttcatccagtatcaagaaatttaccatcatatcagatattagaatctttgtattcaagtggagatctcaagattactataaaaaagggacaatcttaattatccacacgctgtatctaaactatatctaaattcatcaccagtatatgagagtttcaagcaattaaaccaaaatatgtccacaaatacttctgggactactgggtttcctccacacaaatttaaagaaatggtgtgatgtccatgtgccaagcaataatgcaataattggttgctcaagagaacagagagaatgaatagattagcatagagatcttgccaggattctagagtggctacagtaaacacgtttaatttataaaatctcaacccccacaactccctgaatcatatcaagtttgaaaaatatttgtaccaattctaatagcccctaatgagtaaaccttattagcattagttgccatttgagaatcagcaatgatttataccaagtgccacatattcttacctactgcaatctcttgaccaaagaatctggccttgattgtgcaggctccactcaaatatctaagaaccatatagttaacattagataaaataatgggactatgaaaaataacaaaagaaataattgtacaagtaaaaaatgaattcatggacttgtgacgtcaacattaaccttaacaaacgctagagcagttaattttcttacactgattaagtattgaaaaaataagaaaattgtttttataaccaaagagtccagtccttcataagaacgtaccacagtgctatacaatgttagaatcaacgtgattactaaaaggggctacatacctttccatctgagcccaaactaaatatactagtttcagcaggcccgaaaagaacagagctgacaggggaatcatgggcaggccatccagtgatctgaagaccagcagacatgtctttgtgcagttaagtaaactattgatatgggatctcatacaaacaatgcaccaggtagtgataccatattccagatcaaaagcaaataacttaatatatacgtatgatgctgaatgactattaataaaataattaaaataaaaaaggataccaaacatgtgaatcatcccatctgttgcagaagctgccaagatttttccattatgattgaagcaaactgaagtaatagcaggtgggtcctccccaagtggtagaactgtcttcataatagaagaaaaagatattatcatggaggaagagcttactagccgaatccacacataggtttaagacaaggggataagcaatagaagtaccagaggtttccatgttttcatatgccatacagtcaaggaagcaaatcctgttctgtcaaatatagttgatccaggcctgaaagtaattcaaagctcaaaataagcaaatgccacctagattttaatcatacagtggtgtaggaaatctagaagatacaacatgataaaagcttttataaagttaaatggcatgtacaatgaaaatataaccaaagcttttgtcacaaaacagaaatgcagtggtccctgctattgtaggaaaaggaagctatcaatttgaaataactggaaatggatttcttatgaaaataaggattcaaaaagtaccgtctagatgcagctgcagagacaaacacaggttctacagggctacacttcaaatctaacacactgcaagagatcaagaagctccattagcataaacttaagtgataagcaagaaagtaacagttgtaacctgggaaagtcttttgatgtactgaggtcgcaaacaactctctttgcatcagcattccaagctttaatgccaccattagctgtgcctatgagcagctattgtcaagagaaatgggtgataaaatgaaatgtcttaaatatgttttttcaaaggtcaaatgctgtaaaaaatgatataacaaaaaaaatccaatatagacatcacataccaagcggtcagatctgcattcccaagaaagagcactgacttcagacccacagtatatagtggcatttttggatgatggtgttgaggaatcatatgtccagattctttttaagaattgtaaaaccaatggatcaaaatctagaaacatcagttaggcaaccaaaggaaaatggagatggcacaattacctcactgtaccatcaacggaagaacttgcaacatttgatccagatgcagaaaatcgacagcagctaattgaactgttatggcctaaaaatgtttcctgttagcaggtttgattagtcatatagggaattaaaaaggatgatatactactaggaattgattattgttacctgaaaatccactttcacttctggaaagtcatcctctgtcaccaaaatctgctcgttctctgcaacaaagaaacatgtgatgcttcagtgttgccacatgtaagaataaatttagtattgtaaatatgaataaaggcatccaaagtactgaagaatattaaagtgtggcaatatttttggataatgcaaaaaaaacaatccaaaccataagggcatcagaaaggattatgaaaatgggagtaagttttggtgtaagtgaaataacaacagaacattgctcattttgcataaccaatggtaaagagacttatatgtgccattgaaagaatatagaactaagacgtaacctgcattgcttatttgaaaagatttgtgcaatttctcatctcttgtagaagatttcactgagctcgaagactgtgaatcaaaaccctgtgcagcgcttctcgaagctgaggattcttcgaaaactcctggcatatcttgtccttcaagagaagagtcagctgcactagtgttgggaacattcatgttgcccaaatcaacaccagtactattcctgtatttatcaattgagacataaattcctttgggcagaaggtagcgtaatgttgacatttatgtgaaatccaagaaatgagtttgaagtgctctgaatctaaatgcttgacgcttgaatatcgagtttgaactgttcagccactgcgaaactaacttggtaaggcaagcgagggcatgaaaacaaatgaaacacagcagtttctagtttccgagtgtgaggctgtgtatgtatgtgggtggaggttagaaatcatattttacttcatgctttacattaactggatactgaacgtaataagaaatgaaggtactgttagattaattagtgaacataattttcctagtttcatccaatctccacaaaagctacgcatgcatgtgcaaacagattagttatgctgcagtgtaatgtataaagagcatagatttaccttctcaactgagatatttcagtctccttcatctctaacaatgcttgtagctctgataatttgttattcagttgctttatgtcgttctttaggcatttaatggtattcttttcagtgctaattttgagaagagctggaattcgtggaaaaattaaggagaaaacattgttgagcaaaacataatatgtttgttaacccaaatataggtaacaatcacattaacaaacatacaatacaatttacttgatgatcaactagaatgtggataaaggtgttatgcacttatgttgtatcccatttagggagttcttgcatattatagaaagcaaacatgtttactaccaacttgaggaagaatagaagaataaaacaaataacatgttgttcaaggatatgaagaccattaaatatcccgctcaaaaaatttcggaatgaaagaatcaaagtgtccgaccattctttggagaaatatacacggaattgtggatccaagcttgggctcgtgatatatggcatagctgtgtatcacaattaagaacaagaagataagaatgaggttgacacttgatggaatatagcaaaaggaactaagaatacgcaccaaaccatgcttgccagtcttcacgcttctgcagcagataattgccattagcaccgaagaattcaactactttgtcttgtcttccagatttcaatgcattgacaacataataccgtaacaccgacagctccaatttaatgagagccgagaaaagctccgcatccgcaggtgaagtgaagcactgcttaaaaaaggtaaacagaccttgcaacctatccaattggtactttggtatatacaccgagaaaaccaaatctaggatcttgtctacttgaaagttcctcccgatctcggtagacaattccgactcgtacgattgcagagtactcgtgaagcctctgaacacaagaaattccttgactagttcttcagcatactgcatgttctccattcttgtccagtttcactgaaaaaataggaggaaaaccgttcaaaaataggacaaagagtaaaagcgcgaaatgaagctaatgcaactgccatcgttgcttcctctcgctggagcatgtgatttgcaaccaacgatcaatactatatgtatctgcaagcagtgaagcctaaattggcatgggtggacctagaccaaattttcttgggaacaaactaaactgggtattagtactagagctaaggcataaggcaacgagagaagcagcttccagatctactcctggaagacaagctgctagggctaactcaaaatcgagcagaaagagatgagaaggaggatttttgtgcggaacggatggatggatgctcaccggcggggcaggctagcgaggatgcggtggaagcagcagacgccggcacaggtggagctccggtcgcgggatggagatcgacgcaggcgaggcggcggcggcggcggcggcgggccaactccgggagtcgagtccgaggggtgggtgattgcgactatggtgcaaggagtcatgggccaagtatgggctttttctctagcttggtcttggatcggccgactagtggaccagctgaaaccaaaaaaaacgtaagtctatttaacctccctattctcttcgttaaaccacatcctcggtcgcaaatcacgtgtactcaacttgggcaaactgccttcctgtggcactcgccgactctgcagggagctggctttcggggcttccgcgggaatccatttcgttccgggggcgaggttcgggagcggttcattgccaacttccaaggcatttacgtctcgtcaggtcaggttctcattcaacaacgaaaaaacgagtcattgaaggactacatcagggccgagttcagttccaaaatttttcttcaaacttttaattttcatcacatcaaaacttttctatatacataaatttcaacttttccgtcacattgtttcaatttcaattaaacttttagtttactaattttaacgtgaactaaacatacccctagtgtttctcggaggcacgcaacatgatcctgaaagtaaggatgagatcgttctcactgcttttcaaaacgggatttgtgatgagtagctgatttgaacattttcaaggaaaccatcgacaactgtcgagaaacattttgagatgaagctgagaaacccagcttttccagattcttagaagctggcttccaaccagctgcttctcagaatcttaagctctctcaaataggcccctagaccctcccttaaatagagaggcatacctgttataaccgcatggtaatttagtataggcgaaaggtagcggttgccaacgtcgtccgaccgagggtcgtttataactctgatacattataattattcaggatccgggaggagcactcataattagtaccttgcagatgtaggtttcgactaaatttcgttagtaaatactccctccttttcaggttataagatgttttgactttggtcaaagtcaaactactttaagtttaaccaagtgtaatattgtcaacccaagataaacttattataaaaatataattaattattaatttaataaaactaatttggtaatgtaaatattactccctccatctacttttgatagtcatattttatcttggcacatagaccaaggataagtaattctacttatcatccatttaaatatgctactagtcattcctcgtaaataagcgattcattaatatttacatttctcaatgcccatgtagccaatcatgtgtggaagaacgaagagtcatgcattaaatccaagaaagtcattaagatgataagttgttggattgaaatatgcctatcaaaaataaaattttcagatttggaaatatgactatcaaaagtagatggagggagtattatattttactataaacttagtcaaacttcaaacaatttgactttaaccaaagtcaaaatatcttataagatgaaacggagggagtatcatacatcgctatcgtcatcctgcttgaatctcttatgacattcttacgtttagctaccaatgttgattttgaggtagcctcgagctattttagtagccctaatttcatccgacggctcctctgtcgactgaagccagtttgagcaacggcgtgtgttgacgaaaaaaatcgaacacaccggcctgggagatttgcttagctcctgtgtaggcccaaatcttgatgagatgcggacgtgctagttagtttgatcctgcaactgacaagatatgcaaatagtatatcaaaacagccgattggctgacaagccgatggagtagttcaagccgataaccgataatagccgatgccaataccagccgatagcgatagggttcaagcaatcggctatatgtccaatgtagataatgatataaaggcaatcggatgatgatgatgatgtaataaaataacaatataatccagtataaaccaatcggcaaataatgatatgataaataagcatcgatccgaaggttaaagcacaaatcggctggatgtccgatgtcataaaatccacaagattagattaaacagtgaaacctttattgtcatcggctaaatccaacttatatgtatatgtaatccttatgagccgatgcaacgtcgagataactcaccggctgaaaccccgatgaaacccttattggcaatcaagaagcaggctagagattatggttctaagcacgacttagtagatcaaacttaactgatgcagcactaaatatgaaaagaaacataatatctagataatcaagccgttgactgagttttcagagtggtagatgtctaagctaatctaatctagcaacgcgatttagtcgataccggcagaaatcctaaaacgagaagcagccgataaagctaaattgatatgctaagactagattaacagagacatatgataaataggtaggcaaatatatcatccaaaccagagcaatccaagaggtcgaatgtactgatgcagccttgaacgacgtcaacgtaaatgatacaattgcctgggccggcggatcattggacttaccccttagccagagatcgaacaccgatgcagccccatgtcaggtgccaagtcccgtcggacgataaaataaagtagaaaagataaaaggtggcgatgcgccgaattgtattgatcgtgaagataaattacatagaccacgagtgtacatatttatacctgtgggttgatacaagtccttgtcggacaagaaagaaactttcctaaagataaaaggaaaacataaagtccctatcggacactaaacacaccttcctaaagataaaggaaactaataaactattcctaattaatagataaactgacatgccacatccttcttgaactcggactcttctggataaattccctttagttgatccgactccatcaagaacacggttgctggcgatttgatgactcccatcggctaattccataactctgaagccgatactgactctaagccgatgatgactttgggcttaccaaatttcgtcgttaacagcgtgttattttggctgtgttcggtggtgggtgttgggaacccatcacccacgtacgaaaaacggagtagtccattaacgcgtgattaattaagtattagctactacctctgtttcaggttataagattttctagcattgctcgtattcatatagatgttaatgaatctaggcacacatatatgtctagattcattagcatatatatgaatgtgtgtaatgctagaaagtcttataatatgaaacgaaggaagtattttttttaaaaaataagtagtttgaaaagcgtgcacacggaaaaggagaaaaaggagagggggggggggggggagttggtaactcctgctagcgaacacactcaccacccgaaaaataaaaaacgatagagtcagagacacaataatcaaaattcggccacatagacagccacattaggcaggcactcggctgatctggtcagcgccgctactcgccggacgcgatgcctttagggagttcagcgcgtagggcccgccgcggcggacggacgacaatgttttgaggctattcgctcacggcagccgttgattccccgaccgcatcatttctacccaaaaacaaagttacagcactcagtttctttttcctaaagagaaaaatgaacagaacttgatagaagaacaacgtgatcgtttctaactttctatttctcggggacacgtaactgttaagggcactcttaaccctccaccttagctaatttctatagcattaaggacatgtacaatgattatttataacaatgtcttagctttcctaattaaaaatgcttgttgacataaaatagagagaaagagaatagataaaacatcattgttgcgggtaacaataactcttagcctctataatatgaaagcatggctgcatgaggggaaaaaatggaaagaatagaatcaaaagaatattttttgaggtaatggttagagcttttgtcatcttactgttgtaaagatacgatctctaaataatcttgtattgtataagaaactatacttattcaccctaattacactgccacataagtaaagagcaaagatggcaagagagttaatgaagagagagggaaaaatatgaggaaactaattcttaggaaaaaaactgctctacacgtaaacgaaaaatgaaaataaaggataggtgggtaaaaggagagagaagaaggtgattggacgagaatttattttgaataaaccacccattgggcaaatagttctcatgcataatatctatatgatatggcaagtatgaaaattataatattttttggagtaaattgcactcatggtacaccaactttacaagtgggtgcgatatagtataagaagttgagaattgaacgtccgagtgcaacaacttgacaaataggtgcgttctagtataagaacttgataatttagaattttggtgcattaatttggctaagcatacgctaggtgattttttttcacgatgtcaatacgccattacatagtaatcctacggatattaccttataatattgaatttaatctttaaaaattatactgcacatataatttacatccaatttgtcagggttacggataaggtataccctctacccttggatgtatgctatacggaaatacgatatagcggtgcatatacggacgttatctggacacgctaaggaaatccatcacggagtctaccaatggaaaggttcctacccgtgtaggactgggtcgttactatatcgtacagggtctgatgtctccgagttcctacctggagaccgcctgaccagcgatataaaaggaaccccccgagggaacttaggggatcgaatctcatagcctacacaacgaccacagcctacgaagccggagactacaggagccaagtcgccgggtgatctagtcgaatcaactcgactacgatctcgtcggtaccaccgagttctattattccctttgtaatctgtggttctctcaatataatcccacatcaactggattagggctattacctgctaaggggcctgaaccagtataatctttgtctcttgtttccttgatgtcgtactacgtagatcctcgtaccagtgtaccccaataccctctatatccggtctacgggtacccaccgtcgacacaattaccttttaagaattttttgttttcttcaccttctcaaatatcaaccaaatataataatttctacattcagtttaattgaaattcagttactagttactatgataaaaatataaataagcttcaaataattaagttgccacataacttcttaattattgtatcaaaatcgtacctaccttgcaagttggtgcatttatgtgatcacttataaaatttttatactaaattacacctatctaccaagttgttacactagattgctcatttctcaagttcttgcactattttgcacccacatgccaagttgatacaccggcgatgcaatttactctattttttgggttggattgccctaatactttgctttcttgatgatttatttatcttgactcaattaacaagctttgatcgatggtgtttgaaagttctaagtgtttaggacagcttaattttctcataaagaaaactaaaatactaatattctacagttacggtattttgtgcttataatgaaacggtcaaaactttaatcaacatcgatcaggtataactggcatccggagtattcacaaacactaatggagtttctattttaggacaagaagaaaggacaatatgtatgtcgcatttttttttaaaaaaagagaactgctacatgaacttttaataaaaatcttatactccataacacaaacaaagttcacaatcatttgatcaactagatattcatccacagcgagatatatatcagactttatcaatctcaagttaccaactcagtcttccgaagttactcttgagggtagggtacatgtacatgcacatgttcacagtgatgagcgtaacacgttgtgaatgtctgtgtttctaaaagaaaataaaatctatatttagtcacggcataccaaatgaaagttttgtaagaaaaaaaggtatcgtataagcgaatagcctcttctttttaaaacccgtcttcttgtaagaagagtaagagattagagaaaatcctctactatggaatcctaccgaaaatggttttgaacaaaggttttgttctcccttcgccgagcatctctcgtgtcatgctcactgtgctttccagcaaaaaagggtcatatttcaaaagctcaaaggcggttaaaggtagtccttaagcactaattcttcaacctgaattgactcggtgtgtagtctttttatctgatcatctgactttttaattaatacattttgtgggcacaaataaatgaattaaatactacaaagttgaaagttaatttaaaatactattataagaaactgatatattttttcaaaaaaaccatactgtacttaaatatgctcgtaaatctatagcatgtaataggcgctgttagaataaatgggttaggcccgatttatttctattaaatctcaagggcccataataaatattaaagataataataccaccttgggaattaaaagtggagtaactcaacttaaatagggagttattggaggctccatattgaccggttgagatggggatcggaaagccccgcgcgcgcgccgagccgtggtgtggcgtctcgtctctctctccttttgcatcggttcagaattcaactccacgagattacctctgtaacgggcacgggcaggcgattcaatactcattgattgcgtcgttactgcggtaacggaagcgaatcctcctccgtgcattctttccaccgcttggttcatcttcctctgtgtttttggggagtgcttccgcacgattgctccgctcgttttcttcgtctatgttctgcatcacgatgtctactggtggtggcgtttccggtgtggcaggaagtggtgcgccaggagcaggaggtggcgcgccgatcgataacaccaacggaggcactgcatcgcgatgtctactggtggtggcgtttccggtgcagcaggaggtggtgcgccaggagcaggaggtggcgcaccgatcgacaacaccaacggagacaattctgcctcataatccagcagagagactttcacagggtataacatccttctgctacctttcattcggttaaatatgttagtcgcaatgttattgcgttgtcttatagttgatacttattttaccttaagcatactcatggttatgtttagttttagttttatcactagatcatttcacactgtgcaagttatgtttattatcttaatattttggattaaaatataccgatttatgatcatatttccaaccggcgcttcacttccaattggtgaaattgaggggaaaattgatcggctgtgtacaagaaaacagaaaaagaaaaagatcacaccaacgaaagaaaaatgataactaccggtcccaccatgtttgcctacgtgccccataaactaattttggatctaaatttccttttgcctctcttgaagatgagaaaggtttttgggcctactttttttttcctaatccattgtttataatttttgttatctgtcttggagatgctccaactcacttatatacatacttaggtataaggttgtcaacaaagccgaggctcgagagcatttcaagctcgagccaacatagaagaaatgtaagtaggctaacccgtgaacctgtatataggtaaaattagtggtaagtcgcggattgacccgtgagttacctattaatttgatctataaataagtttatgagttaacatatttatatcttgcagcaagccggaccacgacgcgaaaacccacgggttaccacttatttgatctataagtagactcgcaggtaggcccgcttgcatcctgctacgtagtcacatggttagttgacagctgtatttaggtaccaccgttacagaacccatccaaagcgaagtcaactacatacataaatcaagtagggcaatcaatttatgtatcttagataaataatggacaaatgcatttccatatactagcgtggttttagcctaaaatctgtccacaaaacaacgtagtttagagtgatgcagtagatctttttagccactcaaccagtagtattctctcctcctctttttctccgcattaataaggtaaattttgctatatgacacttaatgtgtcgctattgaataataacacttccaaaaactgataatttgttgcaagatattacaaccattcttagagacaaattttacctctctatttggtctaaaataatatagaggtaaagttttcaaaaagacaagaataccccttaggccacaagcttctgacctagcgctcaactgtactaatgtgtaatgtgtagaaatgatgtataataacaatacttggagcgtcaacggtatattgggagttgcatcatatgtagtttgaaaatttggggaagaaaacaaaatttttgatctggtttagaatttggacaagttgcaaaatgtagttattactgcggctctagggtttttgaggtagaatttggacaagttgtaaaatatagttgtcactgcggctctagggtttttgaggggagacggggagaaagcctggttcgaccaaacaagccgaataacatgtgctggcccgtgaggcaaaatcatcatttaacatggtttctctttttcattggattggaaataataaaataagagttgcggtatcatctagtaaattattagttttttgaaaatgtccttgttggtatttcttatggtcacacgtaaatacacgagcgcacggatactgctgtagcattttacccaagagtattccaaggatatcgtatttatatttccgtagggaaaacaacggtgtaaagatagagttcatatattccttaatcagactataattatttcaccatggtttgacatgggttaattcataaatgataatgggatagcatgacacacaggagattcatctttaataatgatacactaggcaatggagaagaactatagaaagctaagattcatatgtatgtctatatttgtaatgtttagtttacatttagcacacacatacttaaggctaggacttagttctaggcacccaggtactatcgagagaccactcagtgctggtatgccaatatagttatgtcattgtatgaactcttacgtaatacccggacatggaggaatacaaaagacggacagagctgtcactacttgccacctacctcacttttcataaggcatacccacatccaacaacatttacctaacctaatcaccatgcttatattaataaataatgtcactaattcccccgagactcccacccttcgcatggataagttagaactagtgcaatccattaagatcattaaaccattactgtagcatagattgactagcttagtcgtgtgaagcatataaatgaagtataatatattcatagagcacataattaatgaactatgaacacaatataataaagaagataattcaattattgcaactattatcttacaagaaaagtaaagtactaaaaacgtaccggaatctcagagaagaccataggactgaagactatttataagccaaactccactactaatagagagaatataacgtatgaaatgagagaattactccttgaaatgtgtgttgcaagtgaagaagctctcctcctttaatagcacctgatgacgattgcttatgatgtttgtttgtcggtaaccacccacaaccaccatcaggagtgcaggaggaagtgctttcggcctagggaaggcaatgtcatatatgctcgtatcctacatgaactgttcgatttctacttggacaagaaattgcctacacgtataaatatatagccctcaggaagagggcatcgaatcatgatccatagccacaaaccacatcgaatacaagctaggatgaagccaatagctagtcactgactcttaagtcatcggattagttctcgacgaatactagttggtaggctagattagctagctttctcccccattgtaattgatgtgagatacatttaagagccattcatataatttggattaaggatattacccacctcaggggcctgaacaagtataaaaatcactgtctcccatctactttaccgctatctcgcgtatatcctggtattaacgtcccctatatttaaaaaaaataccgttgtcaggtatagcccgtcaataatactcttttagggacggaggaaatatgtattaagagaagcgacattggtatgagttagaacttagttacacataccaaaggaacagaaactcaggctatgggggttacattgcaacataagttataacaatgtgacttaatgtagtttctgtgtgtgtatgactttacctgacaaagtcaaaaccatagaaaccataaacgaatttagggtgtgttcggaacccctggttcccaacactaagtgcccgcacgaaaaatggagcagcgattagcgggtgattaattaaatatttgctaattttttttccaaatatggattaatttgatttttttaagaaactttagtatataaatctttaacaaaaaacgcagcgtttagcagtttgaaaagcgtgcgcgcagaaaacgagggagatgggttgggaagaggagctgccaaacacagccttagtgaggttcactatagaaattagttgtatatatgcacaacaaaaagaaaaatggcatggtgttaacgacgaaatttggtaagcccagagtcatcatcggcttagagtcagtatcggctttagcatctcggaatcagccgacgagagttattaagtcgccagcagtcggattcttggaggatttggttaaggaaattgatctattcaaggaagcttatctagaagagaccgagttcaagaaggatgcggcatggcaagttatctattaattaggaatagtttgttagtttccttttatctttaggaaagtatgtttagtgtccgataaggactttatgttttccttttatctttaggatagtttctttcttgtccgacaaggacttgtatcaacccatgtgtataaatatgtacacccagggtctatgtaatttatcaatctctcgatcaatgtaactattctcggcgcatcgccaccctctttcctgagatttttactttatcaaccggcggaatttggcacctgacgctgggctgcatcggctttcgatctctggcgaaggggtaagtcctacgttccgccggccctggtgaatttatcggctacgttggtgttattcaaggctgcatcgattcgatctcttggatcgctctggtttggttgatatatttgcctacctaatatttcaattctatctctagttgcattgtgtttagagacgcatcggtttagttgggactgtctcagttaggtccgatcttctatcttagccgatatatctctacaatcacaatgctgttataaatagatttgttatatccatcatattagacagatctatcggctcatcgagtattagattatcatatacaatctcgtgctgcatcggttaggttcgacctactagattgttgttgataatataagtcttgttaagccgataggttcatgctgatgttttatcggagtgctagccgataagttatctggatgttgcatcggcttatagagattacatataagttggacttagccgatcgcaacaaaggtttcattgtttatctaatcctgtggatttaatgacatcggacctctagccgatgtatgctttaaccttcagatcagtgcttattatatcttgtttctagccgattggtttctactggattatattgttatttcattacatcatcatcagccgattgcctttatatcagccgattgcttaaaccctatcgctatcggctggtatcggcatcggctattatcagttatcggctggaactactccatcggcttatcagccaatcggccgttttatctgttgtttgcatatcttgtcagttgcaggatcaaactgactggcatgcccgcatctcatcaagatttggacttgcacaggagctaagcagatctcccatgccggtgtgtttgatttttttcgtcaacacacggtagcaacaatccataggagagtgtatcagcgagttggtaacgccaaatgaactcaggcatacaaacaaattagcagatttgtatatgaatcatgaaatttgtgaagtacatcactattattgccaatttaggctttgtcggaacacttgagttttctgcttcagatattgtgatatcaaactatttgttttaagaaactaactataaaattataatgtgccctagtgaaatcaagaggtagacctccttttgaactgtgaagaggttttatatagaaatatatactataggaattttcataaataatcatatgaaataaaggattgggcttctttgaatcgtataaaattcatacatgacttattagggctcctttgaaagatagcattgaaaaaaaaaggaaggatagaaaaaaaaaggattttgatagaaatataagtgcataacacactaaaaacataggaatcggatcaaagaaattttttcaagaggttgaagcctttcataaattttctccaaaatctctatcgggatgtccattccaaagtaaatgaaaggatttaatcatttgtttcaaaggtcttcatagaaattttgttgtataagattgaaatcttccaaatttcctatattttttctacaaatcaaagggattaaaggggaccttaatctataggaaatttaaagtattgttcagcatcatgcaaaaaattattttggatatttttctctccttgtattcatgtacctttgatatggagtatatccaaatggccatttcaatacttatttcttgttaattatttgttgtgcgcttttattttgagtaaatttttatgagtacttagttatatctttatgttttaatatttttaaggagttcatgaaggtttgcgagtactttctctctcatatcataagatgttttagttttgttgcaagtcaaaattttctaactttcatcaagttcatagaaaaaataattatcatcaacaataccaataaataaaatatgaagatataatttatgatgaagtttaatgaaattaatttaatattatacgtgttgattcaactcttttataaagttggtcacacttaggccgcatttcagagaaagcattttggctgaaaatttttatagcatgtaaaacgagataatccattagtatgtattaattgagtattgtctattacaaacttgaaatatagatttatttaatttttaaaacaacttctatatagaaaacttttaatatttaaaaaatcgtgctaacgaaaaacagggagtagcttcctccaaccggagaaacaaacgcattcttagagaaatttgactcatgacaaaacaacatcatctttcacagtatggaacaaaaactttactagaaaaaaagagagtaaattgtattagcggtacataaacttatcaggtgtgtgcgatttagtgtatgaatttataaaatgctcgttttgatacatgaatttgtttggtacgtgcaaactaagactaaaatggcgcgacaagtccgatttttctatgttcaacattataaattacaaattagtagatgacttgcatgtacatagtagaaatgttatatttgtaaacttagaatccactttatctttctttgtttgtcccttgcatcattactcatatttttattttttatgcaatcattatgccttattatatgtttatccttcttagactaatgtttacatagagtttaaatcaacaacagaattaataagattaaccttgcaatgcgattttaatcttgttcgcacgcaccaaacaagttcgtgcaccaaaacgagcgttttacaagtttatgtactagattacacccacctgataagttggtgtaccgccgatgcaatttacttaaaaaaaaaacaaagttacacaacaacccctgaatcagagtgaaaaatatcggaaaacaatagggatgttactgcaattcaccgctggctacaaattgtaaccgaaccagacgagtccacgcccccactctccctcctcttcctcgcctgctctgctcgcggcggcggcggcggcggcggcggagcaatggcgcggtcggttggcggcgggtggtggcggtcccggaagaccctggtcgggctggggctgggccaactcgtctccctcctcgtcaccgccaccggcttcgcctcctccgagctctcccgccgaggtccgccccgttgccttgccccccaatcgctgtttctttctttgctctgattctttccgcgattcatcttcttctatctgctctattgttttccttttcttttccgattctctgcttctttctttttctagaggcgtgtgttcttcttctgatccttttcagactacttcactgcagttcaatttcttctctctctgtttttttttggtggatttttgtggagattgagcagtcatttccttggccatttctttaaatttttattcgatcacgcaatgtttcttctccctttttctgctattttggtggttgtagttttccttaatcacttgcttgttggaactgctctcttctgctgtcaatcagtcaatgtacaggctgatcttgcgtgccgttcgcaagctttcttgccgtgttatcgcccagagaaattaattaacacaattctcaatgtaacggtggtgctacttgtttacacttgcaggtatcaatgtgccaacgtcacagtcgctgctcaactacgtgctgcttggggtcgtgtacgggagcatactgctatacagaaggaagtctttgcaggttcagcaatctttgcattttcatatcaatttcacaatttttaggtttaatcgccgaatctttggagtatggcaattaaagaaatgttgggttggcaaaatgtttgagtgaaacttggtcaatggccttaccaaaaagctacccatcgtgagtgccgtatatagtgaaccagaggcatatctatgtttgggcatcaagaattcaagttcatttggttcagcagtacctctgttttaaaatatatgatgctgttggcatttggatatgatgtttgaccattcgtcttattggaaaaaataaactatgtaaatatcatttattttgttgtgacttgttttgtcattttagatactacttattttggttcagcagtacctctgttttaaaatatatgatgctgttggattttggattttatgtttgatcactcgtcttattggaaaaaataaactatgtaaatattatttattttgttgtgacttgttttgtcattgaagatactacttatattttttttcatatttactagccaaagcgcgacttttgatcctgtttaagaacttttatatatggtctattaatttaccttagctcttaataaggttttgatataagttaatttgtttacaaagtatctatacttagctagggcaatagataccaaaaacctccgtaaatttccatatgtttagcccatttgtgattttttttaatacatgcactctttcaatccaatgaccattatttatccgaactctttatccgacggctaaaatatttctgatgatgtggcacatcctcgtgcaagaaagcttgctgctttcactatataagaaggataagataagataaggtactaaagttttgaataagaaaattggttaaacgtaatgttcaaaagccaacagcatcatgcatttaaaaacattttaaaacggagggggttattgttatttagttaaattagcgtttataacttcaaaagcacacgtgcctagtgccttagtgttactgctctattcacttgtaacaacagtttgcttccttttgaaaaatacatctatttgtacataaactgttctcaaaattttaaataagcaattacatatattttgtggaacgtaatatccataactttatataatttcctactgatgctgtagtatttcaatttgtattctactgtggaactgatttatgcatgaactaactcttgcagatgaaatggtactactacttagtactagccttggtcgatgtagaggcaaattatctaggtatgtgcaatactttgttggttatttgttggataattcagcagcgtgttgaccaaaagttcctggtcatctatgctgaaataacaagacagtccttcctgtctactgaatagacagatggtgttacaatgttatactaactccctctattcttttctagttgtcaaggcttaccagtacacatctctgacaagcgttatgcttcttgattgctgggctattcctgctgtgatattccttacatggatgtttttgaagaccaactacagattcagaaaatatagtggtgtggcgatttgtgtctcaggacttgtgctagttgtattttctgatgtccatgcaggtgatagggcaggtaatagttcggtgattagtatttatatatgtctttgttgtttcatttcttcttcacttaccacaaaaaagtgcaataaaaccttttgtattgcagaccatttataattatggtaacaaaatgaaccttgagttcacattagcaaaaataactagtctgttttctgaagtaaggagtaaagactattccacagtttaatatgttgctagattaatggatttttttttaaaaaaatacagtactccagtcatgcttgacgaatatgtggagaataatttaagttttgcgtggaattttggaagtcatctttatgaccagttaaatcctaaatgaagtacaactgaaatgttcatggtcatgttgttctatgcagggggtacaagcccagttaaaggtgatatacttgtaattgctggtgctactctttatgccatcagtaacgttagtgaggtaaagcattgatctcaactgcacaggaaacacattattttgagatattatttttaatacatattaaaaaaactttgttaatagtctgtgccaaaagctattcatatttcacttctttattgtcaaaaaagactaatccaaagaaatggtgaaaatgactctcacgtatcacctgtttccatatgtttctcatccttcgggcttaataagtgcaagctttgtggtgtaaggtgtaaaactagcttcactaagagaccaaatccctcaatatatttatcttttgcatttcaggagttccttgtgaaagtcggtgatcgagttgagttgatggggatgctgggactatttggagctatcatcagtgcttgtcagatgtaaaatgatcctttgttttaaccatgtttaaacattttttgtttcataagcttattatcatagaatttttaagcaaatatcaaagttaaccccctaaaatgttgtggttgtcctgcttaacccctcaagtatgaaactaagtattctaccctcaaaaatatgaaaaccagttcaaataactgccggtagtggttttataagtggttggcttacgtggacactgtgacatggtgatgtattcagctaaatattttttaattcttgggacgtttggaaaagaagcacattagtgcttataagtgattcttgggcctgctgattggagagagaaaaagagcggttgggttggcttgagtaatatgccctattgtgcctgccacgtcatcttgtacacagtaaaatcactacaaaaccattccaagtggttatttcaaccagttttaaaacctttgaggggtgaatacccatacttaaggggattaagtaggcgaaccaatgtgctttaggcagttctttagaattctcttgtttccagaagagtttgttgctagtttgttaaaattgtactgtagcctttttacctcccgcaacgtgtttttattcattcaaaaagtttgtgagctttttttttctttatttgcttatgcagaagcatatttgaacgcaatgagataaaatctatacaatggagtgttggtgctgtaagtcctccctcttttattttccttctaaaaatcccctcattgtgacattggctttatctgtttttgtgacaccaaacacacctaatattactttcttgccacttctcaggtggtaccgtttattgggtttgcagtcgcaatgttcatgttttactctctagttccaattttactgaaggtatatcagcaaacaatgtttcctttgtgcaagtgtgtacctactaatttccttattcatgacttctcagttcttacatcccaagttcacttactgttccttgcccatctccttaaaaatggaaaaaaggaaaacccgacaaaagggatattgttgtactacgaaatggcactgccacattaagcacatggtttttgctctttaagtttctcatatctatattaacttgtgcagatcagtggttcaacaatgctaaacctttcattgctaacctcagacatgtgggctattctcatccgtttgtttgcctaccatgaaaaggtctgatcatcgggccctcaatctgcaattctgcatcaagcatactgcagtttattgtcttacatgtaaccagcaattgaatgcgctttcgctttccaggtcgactggatgtactatgtggcattcggtgcagttgcaattgggctggttatttactcagggtactcacctgttttactttctgttgtccttctccatgaaaaaactcaatactctagctttattagttgcaagacacaaggcattctgaagtttgacgttaatcattggaacattaattatatgtttttaatcaagctgtaattttgtaattagcggttattcgtcctgcaaactttataatgagcgactgaaaaataaggcaggaataaattccactatgtaaaaaaatccatcttccaaattacactatcacagctgttctttctgttcactaatgctgacatgttgatgcagcgattccaacagcgacgatggcagaagggggcaagttgctgaggccactgatgttgagggaaagctacctgatgaggaggaggctgctgttcatccaaaatgccagggtgcagcatcatctggcatccgaaaattcgatgatggtaaaactcctcccactattagacctaacgagccacatgctcaaacatgaaagtaactatggactacagaacatagtggaaacaaaaaagaaaatcgaacaaggagagattttgttaacgcggataattatgtttgtgttgaaggaaatggcccctatcatgccctcagcaacgaggagctgagctgagagttatctcgggaatgactagaaattaggattatagaatcatagtattggaataaacatgtgtggtaggtcagcatattcatgcaatttgctgtaatgtaattttgcaatgtattcttgtcttctctttggtgcttctaaaggaagttccagttagccagaaagtatttgagtgcaaaatgttgtattggggaaattctctgccatgtaactgggtaccgaagatttgatgtatcaggtgataaacaagcatattattatgatttttctcattttattttttcatacttgaagactgaaagcatagatgagcaaactgtttctttaacagccataactttagagggctgcataaccaaattgccacacatacgaaccttacataggggaagtgttcatttcctataaattttcttttttaaaaaaattgaccataaggttggcatttataaattgcagcatatcagcaacttaggggtttctcaatcgttgacaggaacatcatgtaatttgtggcatgacagattaattatctgtcagccagacaggtcacaatagcaacagggtaggaggtgattatcaacaccttgaactgaaattccaaacatcacacatgttttcagtaacacacaattgtgttgaacgaaacgagaaattggacattctgccactaccaaaagagggtttcgctcaaatgccattccacggattggattcgttaaaaggccatccctaggcgataccaaaccttttctttgccatatttgccaattcactggatttccaccattttttcacttgggttgaccaatataccccttcagtcgggttcttctacctcagccctcctggccactcgttgagcttaggaaaggggactaaattcagttaattttagaatctaccattgcaggatacaataccgcactactagtaaatagagatcatagggagaccatctcttacaacaatattctaagtcatctcttattcagataaaatataaacaaataaaaaaggatgccagcactaatattagtcagaacacaacatcgatggtagtagcattagatatgtgacattttgatcagtgagggatcatttgagttgcactttcccattgctgcccttatttgcatagccattggcatcgccgacgtgtggcactacctccacacctgtaaacacggtaatttgttcatccccaaagtcactgttgctgcggaagaacctagcgatgcagaacctgcctgagccaaggttaacaagttgaggatccttgcattccctccattcctctggcaggttgagttccttccaagggcccactagctgtggctaggagtccatggcagagaggtcagccgcagccaagcgacgggcctcagcagagaggccaaaccagaggttgaactcaggcacataatcaatcctgccatggaacggcagtgtccacttgccaacttggctccatgtgtggcttgctgtctccaggcagtaggtgccgatgccattgacagataagcaaatgtgtgagccaccgccaagcacagcgtaggagctgatctctgggttgctgcagctgtgccagtgcttgggttcacggacaaaaggcgggggtgggagttgatggcagtgccaggcctttgtgtagttggatattgtaggcttgcggtatatgaaggcctcaaactgatcgctgttgaagcccaactccggtttgggaatcctctccatgacaaagaggctgctgccatagccatcatggtcatagtcattgtcagccttggcattggggacgaagacggccaagggcatcgacttgggcttgtgaagactgggcatggttcctacctggcacgcatcagcgtcgacgaggaacgcgcggccagactgatccatgcaaatcacctcgccgccagcaagcgggaaacagtccatcctcgattggccgttgacgttgagagctgaagctcggaaggtgaagcaggagaagggaagccccatgctgtccatcattgtgcccggcggtctaaacttttgccagaattcctcaaccttgtgtggcggtggaggtgttgccggatagaacagctgctggcgcatcaggtcgaagcaccatagcgatttgacaccaggggtgcggttgcccacgatcagattaagaaaccgccgcgagaaatcaatcgtcgacggagacatacttaaaatatcttcaaagctagggaaataattaaaaaaaaagcgggtggattatttgcagagcagaaggaaacgaggggatccgtttgtcgagaggcgatttaagcagtagtacataccaagatccaggagacaattgtgaggaaggaaggaagagtacctgcaaagtcgattgcgcgtcctgtcctgcgatgtaatcgatcttcagccttcaaatccaagagccaaagatggcatcagaaaaggctagcgaaataaattcacagataagcaaattggctttcgatcaaataggaagaagatgaggcagatcaacaagcggggaacctgagggaggcgcaaggtcggagaagggagaagagagggccagcgccggagcagcaagcagcagaactgcgcgcgggcagannaggaggagcgtctagggtttaatgtaacggaaggaactggttatgctcatgggcccttgtgtttgggccttagccacacggccacctcttcttcttcctctcgcctcctccaacgcatctctcttcccatggtggatgctgcttctgctgctgctcgcatgacatgattggtgatggtgatggctagcgccggcgtcaacatgccgaggggcgacggggaccactccgcggccaccaagcaatgccgccgctgcggcttctccccgccgccgccgccgccgcggcgtccgaccagggggacaacaacaacgtcgctgcagccacagccggcggttcccgttcccgtcccggtcctcttcggcttcctccgatggcttgtccgaccgctacgaggaacaaataaaggcaccacattgtcaggaataaattccactatctaaaaaaatccatctagaatgcttgtcagatgtaaaatgctcctttgttttaaccgtgtttaaccatttttgtttctcttattataatagaattttgagtaaattccacattggactactttttcttacctaagtttcacattggaccatatctaacttaaagttttcacttagtaaaaagtacgaattacccctcgaactatcgcgg

SEQ ID NO: 46932 - DNA, 3019 bp, Oryza sativa
ccgcgatagttccccggggagggggggtaatttatactttttccttttcacttaacaccacatatttctacacttgatttcactttgggtggggtctattatttgggccagcccatccatgaggaaggaggcacgagctaccgtctgcgactcagccgtcgccgctgatctctacacaaccttgctatttctatcacatccccgtcaatgggagatcaattttctctcaccacctcaatgaccttgctctcggaggctggtctggccggagctgttcttttctccctgcacgcactcgctcttggtcatgatgcacgaagaacacctcccaagctttgcacccgcacggcaggaccctgaatcttgcagaaactccatttttgcttgcggcaactccgactgggcaagacctccggtgttggagaagagaatcaaagtattgcttgcttgcatgaatgggccaaagccagcaaagcaccccaaatcgccaatcctagtccaaagtgcaatcaaatgtaaaaacatgtggtgttaagtgaaaaacttgagtgggacctggtccaatgtaaaacttgggtaaaaaaaacctagcccaatgtgaaatttactctagaatgtttaaggaaaaaatcaaagttaaccccctaaaatgttatggttgtcctgcaacccctcaagtatgaaactaggtattctaccctctaaaatatgaaaaccagttcaaataagtgcaaatagtggttttataaatggttggcttacatggacactgtgacatgccgatgtattcggttaaataacattttaattattgggacggttggaaaagaagcacattagtgcttataaagtgattcttgggcctgctgattggagagagaaaaggagtggttgggttgggttgggttgggtaattttgccctattgtgcttgccgtgtcatcttgtacacagcaaaatcactacaaaaccattccaagtggttatttcaaacaactttcatacctttgagggtgaatacccgtacttaaggggattaacagacggaccaaagtgctttaggcagtttagtagacttctcttgtttacagaagagttttttgctattttgttaaaatcgtattgtggcctttttacctcctgcaacatgttcttattcattcaaacagttcataagctgttttttttctttatttgcttattcagaagcatatttgaacacaacgagaaaaaatctatacaatggagtgttggtgctgtaagtcctcctctgtcctcctcttttattttccttctaaaaatcccctcattgtgacattggtatccgttttttttacaccaaacacatctaatattactttcttaccacttgtcaggtggtaccatttattgggtttgcagtcgcaatgttcatgttttactctctagttccaattttactgaaggtatattagcaaacaatgtttcctttgtgcaagtgtgtatctactaatttccttagtcatgatttctcagttcttacatcccaagtttacctactgttccttgtccatctccttaaaaatggaaaaaaaaaagaaaaccgacaaaagggatattgttgtactacgaaatggcactgccacattaagcacatggtttttgctctttaagtttctcatatctatattaacttgtgcagatcagtggttcaacaatgctaaacctttcattgctagcctcagacatgtgggctattctcatccgtgtgtttgcctaccatgaaaaggtctgatcatcgggccctcaatctgcaattctgcataaagcatactgcagtttattgtcttacatgtaaccagcaattgaatgcactttcgctttccaggtcgactggatgtactatgtggcattcggtgtagttgcaattgggctggttatttactcagggtactcacctgttttactttctgttatccttctccatgaaaaaactcaatactctagctttattagttgcaagacaccattctgaagtttgacgttaatcattggaacattaattacatgtttttaatcaagctgtaattttgtaattagcggttattcgtcctgcaaactttataatgagcgactgaaaaataaaggcaggaataaattccactatctaaaaaaatccatcttctaaattagaccatcacagctgttctttctgttcactaatgctgacatgtcgatgcagcgattcgaacagcgacgatggcagaagtgggcaagttgctgaggccactgatgttgagggaaagctacctgatgaggaggaggctgctgttcatccaaaatgccagggtgcagcatcatctttttttagataatggaataaataaatatcccggcctttacttaaaagagctacagccaattattacatagaagcgtttgacgaacatagtgtagatctaattgaatagaacacaccgcaagcaacaataaagaatccagtctaacaaaggagattacaattattcaagtctatttgtaaatctccacccataattggcaaaaagttgcataaccgtagtctccagcttccgacatgcaactttcagaaactcttcatcatcttcacacctttatagttgtgcccaaaaccgaagccaatgggttgctctgaaaatgacctgcatataggaaaatgatggtgatttgtcaaaaactatattgttcctactcagccatattgcccaataaatggcagaagctccaacaagtatcagtttactcattttcttatcaactcccaaaagccacccatcaaaaatatgagatacgctaactggaagattaaatccaaaagaaaactgaactgctctccacagaaacttcgccaaatgacaatcgaaaaagagatgttgaatagactcattcttcaaacaaaacgaacacctcaagctaccattccaattacgccttgccaagttatccttagttaacacaacccctttaagcaagtaccacataaaaattttaatcttaagtgg

SEQ ID NO: 46933 - DNA, 1590 bp, Oryza sativa
acttttgacattcataagaccagaccaaaaatgggaatcaccttgtttcttgtcaacttgggttatagacttattataaagatatttcctcttcaataagtcatgccaaatcccttcctcattaattaacttaaacaaccatttacttaaaagacatttattttgtacctccagattatgaatcccaagacccccctggtccttgggttgacagacaacatcccacctagtgagcctgtattttttcttatgatcatctccttgccaaaagaatcgcgatctataaaaatcaattttatgaagaacccctttcggcacctcaaaaaagatatcataaacatggctaaacttgaaagaactgaattaatcaacaccaatctacccccaaccgataaatgcttgcctttccaactactaagctttttctctattctctcttcaataagtttccaatctttattagaaagctttctaaaatgcatcggaattccaaggtatttaaaagggaaagcacctaacttacaaccaaaaatgtccgaatattgctcataacactccttagcctgaccaaaacaaaataattcactcttgtgaaaatttatttttaggccagatagcttttcaaagaccgataaaatcagtttcaaattctttgcctgttgtaagtcgtgctccaaaaagatgattgtatcgtctgcgtattgcaaaatggacaaaccatcatcaacaagatgcggaattaccccattcaaaagaccagcctctttagccctcttaatcaataaagtgagcatgtcagctactatattaaaaagaataggagataaagggtcccctttcctaagacctttgaaagtttgaaaacaattaccaatttgatcattaacttttataccaacatgcccaccttgaacaaaagatgctatccactcacaccatctaggagaaaagcctttcattctcaaagtttgttgtagaaaagaccatttaactttgtcataagctttctcaaaatcgatcttaaaaattacaccacttttatctttgcgatgtaattcatgcaaagtctcatgtaaaataaccactccttccataatattcctcccaggaatgaacgctgtttgagtaggactaattaccttttgagcaaaatccattaatctatttgtagcaactttggtaaaaatcttaaagctgacattaagtaggcatataggtctatactgttgaatcttcatggcctcagcacacttaggcaaaagaataatagtaccaaagttaagtgaatataaaggcaaactcccagaatgaaaatccttaaaaagttgtaaaaagtcaaatttaattacattccagaacacttggtaaaactcagcaggaaatccatctggacctggagttttgttatgttccatttggaaaatagcctccttaatctcattttcagaaaattccttagttaaagcttcattctccaaatgtgaaacttgaggaatgccagcaatataattatcatcaaactgaagatcagattcattaggagggccaaaaagacctttataataagtggtaatatgcgactttaaattg

SEQ ID NO: 46934 - DNA, 1162 bp, Oryza sativa
cggtcaaatagccgttagtgccacgtggcgccttcccattcgaccgccgcccgccctgtccgcgcctgacgggccgccggcgtgtcgtgtcgtgccgtgccgcgggccgtgccgtgccggcccgctacagtagccgtgccgtgccgtgccggcccgcgggctcggccagcggcccaagcacggcacggcccgttactgtagcaggccgtgccgggccgtgcctgctacaggttcggccgtgccccgggccgcccgtttggcccggcccatttggccacctctagagccgatcgccttgcaaattgggccaagccaaggttaatctgaattcgaggcccaatactgattcccggcgagtccaagcgggccgaatgaataggccgcgaagcggcaaggtaagatggcgcaggcctaatggtaaggagccgactgagaatagtgtccagaccattataatttgtggaaaaagtacaccaaaggtccctgaacttgttcgagttaaaaaaacgtccttaaactgcaaaatcagatatccggcgtctcttaactaatcaaaaccgtcactttagatccttcggtgattttgatcctggttttatccgatgtgacggctgagtcagcgtgggccccacacgtcaggataccacgtcatcccccccttctctcctcggttcctcctctccctcagtcttctctgcctgtagccgatcggtggggctagcggaagaggaggaggacggcatcacgatggtggccggcggctgccaaagatgggcctgggaaggcggcagcaaggcggaaacggcacgggcgtcgatagggaggcgggggtcgtcgacggcgggcgcgatgctgtcgaggtcgctcacctcaccgctaccgggatcttcgacctcgagctcacccgtgccgccactaccaacgcctcccgggcctctccgacagtccgaccccaaggtcgcacgcgccgccactgcctcccttctcaagcgtcgcagccgctgccgcttcccttctctcgtgtcgtcgccgtcgccgctggggtgatcgagataacacgcagccggcggcggggaaggaggcgcagctgatagatcgataacgatgcccgatgattcgatatgatgtttttgaaaaaaaatttaaaaactaaacaaggcct

SEQ ID NO: 46935 - DNA, 8996 bp, Oryza sativa
tcgtttgggggagttaaagttattacagagtgtatctaatgagaccgaggagcgggcggaacgggttagaggtgcgaatgcgacaggaatcgttcgcagtactgtgttagaaatacgcataatcctgttcttttgtatcctaggatttgcatttcattttttcgttcttgcatatacatgaccgtatgtcgcagcgcagtggtaaacccagaaaaaaattattggggttcaatacatattaattatctaattattagttaatatataattaatgtgttacaaattattaaaattaaataatttacccaaggtctgacttggaaaacaaaacactacaaattcccatgccgcagcgtgggtgttgtgttgtggtcatgtttgtgcctagagagagtctttatagcaattctaaaagcaagtttaatagtatagccaactattagctctaatttatctatagccaatctaatagcttatttatacaatagttacatactacactattagtacctggacccacctgtcatacacacactgtgtattggagtccgtgctacagctggctacaaatctgtagctcgctcccttctctctcctcatttatatccttaaaatatgtttgtagctggtttatagcctgctattgtacctgctctaatagtacatcccactattagctctaatttatctatagccaatgtaatagccaattcatacaatagttgattactatactattaatatatggtctcacctatcatacacatagtgtgttttgaagtccgtgctgcagctagctgtagatctgtagccgctgctcttatctcttatcgtttatctcattaaaatatgtttatagttgactaatagcctggtattgtaactgctcttactcttactcttagtagtatagcatgtgaattgcttcaacatatgggatgtcaatttcacgtggtcgattgaagctagagctagttagttgaggggattctcggacttggttgacacactgcacctataatagtcgttgatgatatgtgggattgggtccacctgttaatcactatcaccgcaagggcagcactacaggtaatccaccatgtgcaaatgtacgtgtttcttaaattaaagctacatattttttaaaaaagttatttataaattttaatttaaatactaatgaaaatgattccatttgattaatactagcaaaattatccatgcgatctatattgtagatatcattactgtcaaaagtttcagatgaatatatttcaaaaaataattcatagtacgtactatcttttttatcattgctcgaaacttttggaattcagaattaatacaagctgtactagataggagtctcaattataactattcatcattgtaaattgaaaatcctcgagccaacaattattatgttatagttatttcttctttagtcagtaatattataattatatctgactgctagatttattcacaaagtgtaattgatatgaactcttatttcaacatgtggagtccaatacacttttccaatggcgtgcttattttacaccaattcttgatatgaaccagatcatgctgatatgatcgatctaatcaataaacggattgtttttacatagtgcagttagagcaggtttaataaggtagattgagccggcgatatgagctacacgtcagattggatgatgacatggacgagagaaaggtggaaagagggtgcgagcggatggtaaattagtcgctagcgcacacgagctcctaggcgcctgtgcattgctttttgtcagtgttgcagcggagtgagagagggaagggtaaagaagaaagagattgaggtgattaaaaaattaataaagatattacttgtttaacgtgtcaacggcttactattgtactctctagctataagatgacatggtacacatttatagcctgtagccggcgatactattaaacctgctcttagggctcctttggaacacggaatgtgaaaaacgtgtgaatactgaataggaaaaaaaacaagatcggaatgttaagtatgtgcagattaggcaggagttcaaaacacgagagttttaggcatactatgtttggatggttaaaagaatataaccaaagaacttttatagaattaaaagagagataaagagaggaagtgcatttgccttctcaacgtaaaaacaatgaggttagagctcacggtaatatcttctatgaaatcggtgcataggatagcaattcactcaaatcctctgctccgaagaacacatatagaaaaaaagtatccaaatataatcctttaaaattccttttattttcgactgcgtgaattttacattataaatgacaaattcttttcaaaattgttgcttaaataatattgtcaaagtattcttttttagaagccaattagtgctactttttgtcgctctcttaatttatttttagccttggaccttttcaaatatggaggcatgtctctgtaattgttttttctatttgtcttctcaatggtgaagattgggaggaaaaaacaaactgtaaaggcgcatgccaacctcctagtactagtagcttaaacagctgtgaatgacaacggaaatagtttcttgaaagcaaaggatcacaaggcaagcacaaccagaggcatctgcatagattattctcacaagttcaattgtcactaggccggcataacaaacaaatgaaaagccgatatttggagagagttttcattgacccgtccaagcatctactagcatgtttaccggtcagccaaccagccaactaaccctgataaaaacatgcagacaaattatcacaaaacactactagctaggactatgagaaaaatgccatgtgacagccaggaaagaaagcacggttgctactgccatttcctaacggagacgtaaagaaggtgattagtcgtagtaggcgagagagcactctgatcttgatagctaggcagcaaatgtaaagttggcgccattgaaaggcaagcaaagcatacatgataaacattgtagaccagctcaatatactttttgtgcttttcagtttactagtcacagccgtttttaattgattagggttaactctagtactacatggcttcacacgatatttttggcttctttgttttgttcgaaagcatctttctaatggccatcattgcaaggttttgtttgcgttttctctctctttttctccatggctctctggtcatggacatggacgctgcttaaaagctggcaagcgcctaccatggacagcaaaaggtaggggccattttggtctctcttcaatctctggactgttaaagcctttgactaccgggcgttttaatgccctgtaaggtcgccgctgcaacaagattcgtacactacgctcctcaattcaagccgtatgatctgtgcctccgtacatggtagatcaagatgatatcttttttttcctttgacgttttgaccatctgtactagtttcatggatcggtcggtttatatgtgagtgaaatgggtttcatttggaatacatgtatggtccatggttgatcgatgatcaggtcaactgtacaattactgctgctgtaagctcagggaatccaagaccaaacctatggaggaaaggaaagaaaacaaccgttgcttacaaaagcaaagggaaactcagaaagggacccattttttatttgccattctgtgtgacctgaagtcaatcattttttttctcccacctagcagcattcattacttgtttgctcaagtagcagcagtcaatgcgtgcacacacatcagacggatcagcagtatatacatatttatttataaagaaaaaaacgatgagaaaactactccaactatctcctgcaaacggtgcttcttcaaagtgcctttattcccaggccacaatgctagtgctctcctggaagaaagaaaaaaacggccgagtcataagcatcaacagcagcactgctccttggaccatcgccaaccaaattgactagtaggatttctgggttccgatctctcatccacgcacagtgcgcgcacgatccatccatccatccaccggtgccggatgatgatgatgatggagcctgcgaatttgccgtggtttcctgctgatttctctctcttttccggcgcaaaaacgtcggacgcatcagctatagccatcgcgatggactcgtggggaatagaccggttttttctacgcctcggtggtggcatcggaaaccgcgattcgttggtgcaaagcagcatcataatttccggtgttgtctttgctgtgtcaaagcaggcatgtgctcgcgctcttgcaggcgagcgggcggctcgagctgctgatgctgctgcctgccgggcctggatgctgtgccgcgccgcgccgcgcctgtcccaacgcgggcgaagggctgcctggttacttcacgtcatgggctaatgggtaataaaattttaattgggaaccggcgttttcactgtacgtacttacgggctcatgtcccccgatgctgctgcctgttttcttctgtcctctgctctgctcccgtgtgctaacttaggctgtgtcggcaaatgtggttggaaactaatctctgtatattatgattaattaaatattggcttaaaaatttataaaataaattaatataatttttaaagtaactttagtatataattttttttagaaaacatatcatttaacccttcgagaaaattatgcgcgaaaaactataagttgaaaaattagtaccaaactttggttactgtgaacactttgccacttcccatttttagctgtcacagtttgctagacgtgtatttggtttatattatgacctgttacacatttttaatagatgtcccctatatcatatatttaattttaccccattttatgattaacaatttattcgtcacacttttataaatgccacagcttacttaattttggttgtggctttgtgggtgataactaaacacgtgattaatgtagacccccgaaaatgggtggtacttgcagcacggaacaggcgaagacagtgggggtgggattaatgggggtgctttggtacaaggcgtgcaccaaatctggctataaattacgtcacgagacttggtgcgccgcagatatcaccgcaatcatgccccgcgtttacgcctcctctcccccgcattcatcaaggcgctacgcaagttgcagcctctcctctcctctcactcgtgatcgcgctccgtcgtcgcgttggcgcacagcgtccgccccgccatccgtccaaccatcgtgcgggcggggacgcgatcgcgctgcgtttctcacgttcttttgcctcccgcgtcgcgcgcgcctcgcgaaatcgctcgcaccgctcggctttgcggtggaacaccgaagcagcagccagcagcggcgttttccccgtttttctctactactcctaggttggttgcaacgcggggacacgggcacacggcggtacgtactacgtagccgctgggagaggtaggataccacggcaattgatttgattcagactactactactactactagtggggaattgattacaaactgagtaatccagcgagctggaccatgtgaccaatcgactgggatctcgtcatcttaaacaaaatcttggggctggccgtgacggccccccctctccttgtcagcgggcgtgcgtgacagacaccgtgacatgctgggacgggcaccgcacgcatcggtgccatgacgttacgtcgccaacccaacagcagatgtttgttaattcatcttttgcattccatttcacctgtcatttagccggcagcgacccaactgaccccggcgacggccgtgacaatgaccaggaggaggagaggggacaccctggaaaactggcaccatatgccacaaatttcaaacctgtggacgtttgaaagaacatgtccataaatttgaaagctggtgtgtgcgatggcatttatcacagtcaaaacagcaatatatacaagtgccccctaccctttaacccagtggttgtatgcctctatcggagccagatagcatgggctcatgtaactttctccttcttttcttctgacaaatgcatggcaatgcggggctctctctcctctcgtcttctcctggtgaaagcaaaggcacatggacatgttaaagcctaagggccgtatagcctatagctgccacacaaatcttttaaaaccacgtaagcgaatactcgattgtatcggagtaggtatacggtcatacaactagtagcaaagcatgtgaaggtactactactagttgtgtgcgtgagtgactagtgtgacctgctgcctctgttgcccaagcatgatatggctacagggtcatgtgaaggtagtggccatgccttggggattcctttctttgggacgatgacttctcatcatcaagaatcacagatgagatgtggctatgtgccaaggattgcctgtaaagaatgttcaccggtcactaccatctaggcgtctacctgtgcatgatgccgtatccatgtgaatatattcaattctcgtaggatttgtttatcccctttagcttttacttttgccttgttgtgacatgcaaactatgtatgttcaaataagatgactttagctgtgttgttattcgcagaggcagggaagacaaaagcagaccaaactcgtatgatataatgtttttttaccgtggtatactaataaattgtgggtttactgcttttgaaggaaccttgagcacacagccagccaatcaagaaccaacaagcacccaacaagtaaagaaattgatatgggtgaagctaccttactataattaaggatggaccatgtctatcacaagctagagtgcttggataatgtaaacttctccccttgtgaaattgcatcatgacctcatcatagcaagcaaagaacgggtgtggctggggccccattttttgttggtccaccaaagggttgcctaagatactcgaattaataaaaaaaacacttgtcattgcgcttaagaaacataaaaccagcggtttcaacaatgccatgaatcttgcaaatgctgcatgtgatgataagtgggtttccgacaatagcgtacaatctgcctatgggcatccttttgtgcatgttgaaacacagcgtcactgcccaaggcacatgtcggcttcaaatgcaaggcaccggcagcctaaagattaatataaccatctctatgaagagattagattgtatcctttctcactaggcaaaatgatgaaacgggtgaatcatcaggcttcatttggcattggcaatgtgctgatggggaagatcgtttgggttgcaacaggaccaggatttcatgaacagtcttgtgattcccacgcatcaattccatcctatcttctccattttttaagcgtttcttctgaagaattatccctctttcggctgaggtggtacgtttgcttgcacggtatagatccttgggtacattgcagaatcacgcctctgtggaaattcaggacagggcaatctgatcgactgcaacaaattctgcagaatagagtgaaacagctaccaactactaccatagatgaaatcgccaaaaagcatattctgaacgaaagttactggaaatctagctacctgtagttgtactctgatcaagatcggtagccacaagcagttgattaatgcgagtaatcgtacagtgcacggctgcgccttaaggtaccatacattacactgccgacacgcacaaatgcagtgccgttcaatatgttttttaggttccagtaccaacctatttacttgaacctttctcaatagtcacgaactttacaaaagttgcaaaattgctgggacctatcgtgttgctatcacacagaatagggtatcacagcctatcatccagatatctagcagaagttgtgtcatgtcttcagtttacgataatttcatttttatcgatgggtagagagcacattaaagtgccagccataacaagtaatggcttcagcaccaagaacatcacattaactaccttgaagcttcatctaaacaatatggacaaaagggccataaatacaaaatcgacctttcatgatttaggacgatgtgagcatggaaggctaagctaagctccacgcctatcaacttccacttctgccgctccattttgtgccatgagaattgtgtacacttttttagagcatgctggtcgagcccttctcttagaatcacccagaggaccttccaacctcaagtcttcaagcaaatgttctttttcatgaacctgtcaaagaacctgtcaagaaaaccgaaaagccaatgcctagcttttagtcttatttagaacctgtcaaaagggcagcactcacagatttactgtcatccatatacacattcagtagtgatctcatggacgggtacttcttctcaattgcaatagcttgtcctggactgactccgggaatagcaactaaagacttcagcctgttacagatgatttgaagaattagcatagtgacactctacaaatcattaactgtcaagaaaccaagaacactatattcgaatgcatagttgggagctagaactgtcaaaagtatgggggaccaaaattatcaagttgtcacaattaaaataggtagcacatagtcagaacatctctactataaaatcagaaaaaattaaaggccacacaatccgaaaatccaaaagtccatgcatggtctccatccacgggtccacagaagcatcacttaaccaccatgctaaaccgttaatgtaaatatagcttgcaaaccaacatcaaccaagcttggctgatatccgatgttggctgaatagatgatgtcatctacaaagaaaagaagtgccacaaaatatttatagacaaggttggattacaaacactgtcagttctgatttgaacaattcgatttgattgtaccaaagtaccaaaggaaagaattag

SEQ ID NO: 46936 - DNA, 3393 bp, Oryza sativa
actcgaatatagtagtaaaccttaaaacctctgaacgaagttttattgctaactggagtgaggcccaacctcacaatatctatttagacagtatttatgcaaattgattgcatctaaatctagacaaatatacaattcacaaggagggcaagagaagaagatgagagaaaagaaagatgcagaaacaagcagtcagagctcagaagtctaactctaaacccactagaaatattaactcaaaataagcttccttctgcgcagcaggaagtgaaaatggtacatcagctagaactgatggcgaaaaccccaaaagggctccacggtgaaacaagaagacaggatccctaagagcaccagcagtttagcaagagcggcttctgcaatcggcatgcatgttagtgtagttaagcaattaagccaaaaacatcaccatctaactagctccaaacccattaggtccttagcccaagctctagatttccccatcgttttcccagccagcaaacaaagaagaagatggagtgtgctcacaccgcgcattgacaaaggatccaaaagggcaagagtaaaatagaaggaagcaagattttcaagaactcaagaaaaggcactagtagccagtagccagtgaggtgaggtgagtgagctgaactgaactgacctccagtgacaacaggtggtggctctgctgcagctcaccaagaatgaactgccgctgcctcactgtgagcctgtgacggcatcctatggaggagggagatgaagacaaggacacaaaggtggatggaagggagaaaaaggtgacacgggtataagaacaaagcgatcgttcagcttttcccgtggggcaaccgctggggtctcactccgtaatttttttcttagtagatccttgcaatgacacatgtaccagcggatactgatgctgcgtattggctcactggcctgtggacccggggctcaaatttagccctttctcggattttagctatccgtatgcgcggtgaatcctgtgatgctgtgatgaaaagtcgatttagctcgagagtgtttgcctaagtttggggcttttaagtgtcggcggtgccgttggacaagagtagaatggagtgcaatagcagcattgcactccccattaaattactgctcctgttgtccccataagtacaggagtatcttgtgattccagcaagttatgacaataattacctgttttttgtccaggagagttcattgccagcttgccacagtacaaaatgattttcgtgagcacattcatcaatagtgtagagaagggatcagtgatgacagaagaatactagttgttggcacatatagtactaccgctactacaatggtttacttagtgattaattacatggatattggataactaacctgagagtggataggacctgcagcagtggcccataaggagggcgtgcatcagtggcatcgaccaccgtcagcttagaacgtttgtgaggtttacccacctaaatgattggcacttatcacatgtattaatggtttgatgcatgaatcaagggacagcggattgaaagtacggacaacttgtttgtgctacttacgttggaagtgtacacctcaagctagtgtgacatcggttcatcaatccatctgtcgggctgtcttgcgcaccaccaggaggaaagattgccagctatgttcctaaagcgacacatatatttgctgcacgataaatttagcgtcatataccagtcagtggcatcaatcttaattcacagtccacaagccaacagatctgtgaaatggatcggtcagtgtctcagtggctgattacttcaacgattagctccacgcagatgcagtcaaacgctaatttgacaatctgctgtaacggtcgttggacagatcgcagaggtgacaagtggggttccatgcagcgcagtgcagtaccacggacaagccttttctctgaagcaaaatatgaagaaaagtaacccgttgagaagagaagaagaatttacttcgagtaaaaggctgagctgaacatccaggtccagtccatgcaggctggcccggtgccaatctgctggaccaccagcccatagccaaaccaagctaagtagacttttgggtccaccggtccatcccgccgcatccgtggagtcacgtgtcctcatcgctcgccccatgctgcaattgcggccctgtcccgggtttgatgggccaatcgcgcgggcgcgcatgggcaaaacagcctcgccgaccgccgcgtcgcgcgttgcgggtgggctccgtgcccgtgccgccgcgacgacgatctcctcggtggcggcgtctccgcctgtcgtacgcgtgatgccgcgcgcgccgagccgaacaagtaaacaaccgatcggtccgcatcacccgccgtcgatcggtgagacggtgagtacgtaatccaagtgatgcacgggccgtatgcacgcgtgctgtgccggtcatatgtatacgccccagaaaaatgatttcatccgtaaagcggcggcggcggcggcggcttggaacgacacacgtcccattcttgcgtcattacaatcggtgtgttgattatgccgtcggcttcacagctcacacaagtcgcccatgtacgcctcagggtcatctcacgcgcacttgtgcccgtgctaaagacaagttcttcgatcgtcggtggtgccaaagtctaagcttgcacgacggttctacaggagattagtgccgcccggccggcctggaaccacaatttcaagggggcttgctcggacaattatacttggcattattgattatggctcaagagtactatacatcatatagatacggcgtcataacaggtcattggatggaaacgaattaggcatgcgggtacagcgtgtgtacttcctccactatccgtgaagtggaagtcaatttctgcaagatttccatttacctatagctaggtagcactactaactactccagtacagcaagccgtcctaaactcgtatcaaaacgtccaaacttcagctgattttcgtggaaattctgcttcatcagcagttccgttttaacccctgctcgtcgactgcctgccgggccaagcaagcaacaccaattcgatcgaggcaacacacaacacgacacgagacggtggcgcgtggcgggcgatgggcgatagacggatgggaagagcatcggagcgcatgctaggtcgtagccagtgagacaacgcgacgcgcgagagaggtggtggtggtggcgtccgtgcggagccagtctcacgtcgccatcgcgcactggcgccagatctggaccggacgggcgggggcgcggcagaaaaaaaagaatacgatatacaatgcgaccaatcgatcgatcgggagcggcttttgctggtga

SEQ ID NO: 46937 - DNA, 5042 bp, Oryza sativa
agcagctgacgtacgagtcgatcgatcagctccgcgctcgcttgatatttccggtggccggcacgctggggccctacgttgcacagttccacgcagcaggggatgccgagagcgcccgggccgtcgagtggaagcatcgatcatgcggcccgaggggggcatttttgccggggagaggagggcctgcagccgcgcgcgcacagtgcgcgcactcgcagctgctcatgtctcgctactcgctagcgacgccccgcgcgcgcgtcgtggggtctcacgctcgtacgtacgcgctcgcgcgcgcgcgccatcgggtggtttcagctagtttcgtcccgtgaaaccgagtacggccgcccgcgccgagaccccacgcggccacgccttgccggccgagacgtatccattgtggcacttatccatttactcgatcgaccgtgcaaggaaaccacttgcaacggccattgatgaagagagatttagttgcctgtatggtatgcatgccgttttttgtcatgagcttagtgaggataagctcatggatcatgtgggcctaaatgtgatatagtacaggagtttcttcgcgggtatatcaagagttcaataccatttgcgcagattatttcttgtagccacacatattaattgagagcctgcatgatgcatatgccatcgatcgttttctagctgcatgcagacccaggtccgcgagtcgcaaggggacaagaggaaaattttctttccccctgctattgcacaacagttatagtggctagtagaaatgcatagaacgcatgtgcatggcaccctcgcgagctggcccctagcaaagcttacacaagaaaagctacaagacacttgcgaacaagtcacgacgactagtcctgattgttgcttcggttagacgtactacgtccctacttactaagaatgatgctgaacacgcagccaattaatcctgccttgtccttgtcatatatctgatgctagcaaccggctgaaccaccgctcgatcgcattgcattttttttcatagattgccacaaacatgcacacggcacggaaactcaagggatccatcaggaggcacccctgttcatcaatacacacaagcgaaatctagaacgaacaccaaaacgatttctgacaagctctttccctgcccatccactgcgaacgataaaaaccaggaccaagtcctgaacgaggaacaggtggacgaagtgaggtgaaagtgaccaagcgtctgatgactgatgagatctggtgctagcaataagagcaagttcaatagtatagccaactactagctccaattcatctatagctaatttaatagctcattcatataatagttacatactacactattaatacctagtcccacctatcatagacacactgtgtcttggagtccgtgctacagctggctacaaatctgtagcccgctgctcttctctctcctaatttatctccttaaaatatgtttgcagctggcttatagtctgctattgtacctgctctaatggccacagggagactgaaaacggccaatgcgctcgcctggttggttgccggtgagaggcagctaaggtaaagcttagctccagggggcgaactgattcggagagccgaggagagcgacacggcatcggatgagaccacattaacttgttttttaccgcgagaggttggctctcatggtcatggcccagccagtggctggcccagctcgcttttgtgaaccagtcgcatacatacacatgcttgccttgcttgatgcccggttgctgctgatgctaccctgcactgcactgcacttcacttcactctctctcatctcgccccacacacattcaattattgcaatgcccaaattagaaacaaggaatcccctttctctagcaaaatgttacgcccacttgcatctatgccccggcactattctcttctcttctttttcagggaggtgcataggcaacacattttaaagcatctccaaggatataaaaaagcgagcggaaaagagatacatgcatctgcttattcctctttttctcttttctattcgggaaatctcatgataacatttttgttttcgcaacaagcaacagcaacctaaagatccgtaccttatcaaatgatcaagcacaaccgtacgtggtgggtctatatacattgattcatttttttttctttttggaagattgctatttaatcacgctttgaattcaattccaacaagtccagatgactgttggttgtctacttgtcttcgagatgttagatatgtgtgcaagtaacccaacactatgaaattaagagattattaggaagattctgcaaggaacagttcgatttttcttttcttgcattgcagatagggcccacatatctgattcctgttggtataggataccaaacgcagtcgtatgtcttttttaatttagaagaccaagcaccataaaacatctcttcttagagggagaaaagaaagaacattactttagtaccaacatctagaaggacgaatacttctatatgctccacatctcggcagttacgtttcttggaaagcaaagagccaaagcttaaatagttgacatatatgttaatctgatcgtctcttttgatgatgatagattacatgacagtagtagtagcgtaaagctagcactccgtaggatttataaagcgatgaatagtagtagaaaccgtgggtgtttaaggatgcttactagagggcaagtgttgtcggccaagcggaggtgcatggagcaaattttcccgaatcatggtcatcatgcagtgaatgatgcaacatgagaccgaacaaaatgagctgtgatgttgacacccagagtcatcgttgttggccatggtgaaagaaaagaaggaaagaaagcgagcgaaacggcaaaagatagatactcctacactgcttgaggcgacgcttggccaatctctctcgccttctagggagctcctcatttacatgcccacttgtgtcccattcatgatcagatccatctccatctcgctcgcccaatcaagaaacagagaagaagaaagagagaagaaaaaaggtagagcaaaagaatagcatccagctcttgttcttgctggtaaatctgcattgagtttttccctgcgtcagtgacacacacctctctctctccatcgatctttgccatgatcgatcgacgaggagacgatgaatgcagcgatcttgaattttaaatctttgatcatcttaggtgggccgggtcagggaatggaacccgttcttctgcagccaggttgaggcttgcgtcgcaatgtagggagggaatcgtgatgatgctgcagctgctgtagcggttgcggcggccgcggcgttggtcggcggcggcggcgggtgcggcgggtgcggccagctcatgccgccggcgttgccccacccctgctgctgctggggaggccagtgcccggccatgcctgcgccgatcgtcagtgacaggcctcccgctgtccccggatcaccattgctcaagaactagcagcacagacatcaagaattcatcagctcacggataccggtgaaaccaaacgcgagaaattcagcagcaaatggagcgaagtggagtggagttgtatagtgagctacccacttggtgatgatgcctgggactgaatggcaggtgggtgacctgcaggaccggaggcatctggggatggttcgagttctggtcgaactagacaagaaaacgaggaatttttaagcctttttattacgtgatgagaagacaatcggctgatgcggaaagcaaagtccccattctttttttaccttagctttggtgctcctcgccgccgccgtttgccagtcaaggtcgaacgccatagggacgcgctggtcggagcccgcgccaccgccaccgccgccggtgatctcgtcgtccccgccaccgtcaacgttgcccctcttggagcccgccgagctcccaagcgagaggtccaggttgtgctcggcggcatcacccgtggccgctgctgcaaaacagtgacagattttgtccggatgagcagtcacaactcacaaacgaacagcctagccatgagcagtaagcgcacacatgacacacccacccggcggctcgaactccccggcgtaaatgcttggatcgaagttcgtcaccgcatccttgccattgcacttgatggcagcgcggtcgtacgccctgtggccaagagacaagaaacatcaatcaccatcaccgctcgcccatctaacccagaagcgtaaactcgcaaacggcgcagcagccacactcgacattcaacaacaatggccgcgcgcgcgcacagtgcggcccaataattttacctggcagcttcctcctcggtgtcgaacagccccaagtagacgtacctgcagtgcaccaaaaacccacaagatgatttacgggagattgcccaagaacgaacgatcgaacgaaagaggaagaaacggtgatcgattaggacatacttcttgccgaggaattggcccatccgagcctcccatctcccgcacttgtggagcgtcacgcccctgtacttggagcttccccgggggaaccccgtgctctgccgccggagcacgtggacgaactcctccttggtcaggttgctcatctgcaatgatcccgttaatcttgcagctacagtaatagtagtatgatctaacgaaaccgtggcgactcatgaaaagaaaggaaagttcaggtaataataatcgatcgcgctctcacctgcttcaggtcatcctcgtaatcctccaagctgaaattgatgtcggcctccacgccgcggaacttgatcgccgcccgatcgtacgccctgcgattgggaaatgaacataacaaaaaagattagaattttgacagcgccggattcgattgggcgagcagggaatagaagtcagcgattggaagacgaggaattgagtccaacttaccgagccgccgcatgagcagtgtcaaatccgcctgcaaattcagtcgtcacaaaggcagccattgtga

SEQ ID NO: 46938 - DNA, 3060 bp, Oryza sativa
aagagaagagagagagagagagagagagagagaggagagagttggcaagaataacttgataagatgttgctatgaaaggtaaaaggagcagaagcaagaaatgcccaaaacaagacgaatccaataccaaacccgtccatgctgctcttcttttgctcccctttgcctctctctctctccttcttcctccgttgagctctcgaaaatggaaagaacgagcaggaggagacgaggatgcttaccatatgtgcgattcccatcgcccggtgcggcggtagaacgtgacgccgcggtactgcgagctgcgcgaccgcggcccgcgccggctcttcttggacaccgccgccgacgccgccggccccgttgcagcgaccggcggggcggctccggccaggcggagccacccggcgcgcgcgttcccgggggcggggtcgccgccgccgcccgggacggccggagggaagaactggcgcgtgacgacaaccacagcggccgagtcgtcgtcggcgtcgtcgggtatctcgacgacggcggcggccgaggacgaggaggcgccggagtcgtcggcggacggcgacagcggcggcggcgcggcctcggccgccggcgagtcattgaggtcccacatggcgtcgcccttcccccttcggtgagatgcctctgcctcgcctcctccgtcctcccccttgttgggtcttggactcttggcactgcaggagatagaaagaaagaaaggaagagaagagagagcaaggagaagcagagaaaagaaagagagggtagcagcagctgttgccttgttgggctatgcaagtactttctcttttgcctatctatctcgttggcaaagccgctgctaacctaggaggagagcagaggacgcgaaaagcaggggaggttgtgggtgtggccttgctgctgctgctgcgcattgcgcccgagcgattggggggagatggaatggagagaacgtagtaaagggggaatcgtggtggacgcgcggttataaaagcgcggcgtcatcgcgtgtttctccgtaagcagaggggcaaaaaattacacatgtttttagtagcaaaccttagccgaccgaacgggggaccctgatcgggggaggggggcggccgtgggttttcgcgcttggattcgattcgattgcttgtcttctcgcgtcttctccttttggtggcggcacgagggggggaggggccgcccttgcccttatcttggtctgcactgcactacactacactgcagccagggagggacggggcctttgctttgcttcttcgctttaccgttcgtccgtcctagctttgggtctgtgggcgcccgggctccgcctcagcaccgcccggatggactgtcacgtgtactcttgctattcgggatgcaccatcgtagtagtataaacggtagctcaacctcggtaccacgtacccaggttttaacgagcaagtctatataattagatagagtaattgagaaacatgagtttaaatagttactatctctgtcataaaatttagtaatctgagacccaacctaggacatgtctagatacattgtattaggataaggtcttatcccatactagattgttacattataggatggaggaagtacaaaaacagaacagacttactacgtgtagggaaagacgtggaaaacgactccatttttacagtagcagagatatgatttacgaatcggtttctttagtctgtatcatcttgataaatatggtagctacaatgattaagccgttactattatccactctatcttaaaatagaactgatttaaaattttaaaaatgtttttaaaaaaaggtagctaccttttacttgctcctacatcactattataatttctcccatataagaaattggtttcccacagcctagattggcatcattttcaacgttggatatatgtttttagacaagagcatttgatatatcaggtgtttatttccacctgtaaaagtagtaaatgttatacctaaaactttgaacaaaacttgaacaactacgagtggcactatttaccacagtagtcccagcatctttgctagactagagtacgtagtagtacgtgcatagctaggacctctttccatctttctctcatttcttgttaccgggatgccctctcgatctctcagtcaagaactcctagtcactacgctgccgcggtacttgacattctgacatctactgctctgcgaccaacaagccaacaacctatctagtcggagtacctcagtatcaatgcatgaagcaaacggcttgacaaaccggacaggtccctatataacgtcgtattactactccttactaggaactactaacaataaacaaaattggtccggaagaatatgaattcaatttttaaatccaaattaaaattatttgtttctggttaccgatttgcttaataatctggcttggatcacaacaatccgaacgtccttttgctctacacgagaaattatgatccttacatgctccttctgtctccaaatatactacctacatcccaaaataaattcagcatttttcacacatcccacacatgccaatacaaaagaaaaaaaatagaatatccatactctattaaatcctaatacaactattcatttttttatctactccaatacaattattcactgctttttataaactccaatgcaataattactctaaaaataaaattattttaggacaaataaaatgaactaaaaaaaacttaatatgagacggaggaaatataacacgtactttacagattcgcaatagtaagatatatcctattcaatataagattgctactcctatacatattttaagaatgagttattagtgctatgatcctagcaccagcagtcacagctgcttgcatctacaaacaccatagcctatggcatgaaccatcaaaggcatcacccataattccaaaagcttccgaaagaacgacgagacaacttggaaggtgagcagtcagcgatcaaggaatgcctcttagctaacactagcagccatctcctatcggcaaaag

SEQ ID NO: 46939 - DNA, 3347 bp, Oryza sativa
agtaaaaaatgtttctccactagtgtaatttggagaaattgaagaggtcagctatctagatatccatctcaaagtcattttagaaaggggaagtgataacatggtcccccgccattgtcttggcacaatcttgagggggaggactggtacgccgtgaggattggttttccccctttttttcgatttagtggtgaattgtgtcgtacgtgtactatactgcaaatagcacgttcaagtaaaagtttaggatacgcttctgatcgatgcttgtcaattcttcctactgttggctccattttcttgcaacatccatccttttatgtgccgtgtcatctttttttgcgttcgagagatatagaaaattattccatttgtacaataatttggttcactcatcgtgtgaactgcgcatatcggtatttcaacatccctttttgtttgcgtatgtaatttttctaggattaatgtaacctgtcatgaacgatgctgctttgcgttccctttcacataaccgtgaaaccgacaagggggaacaacttaattgccgctcttttcatgacatatactactttctctcttttatttctagctacgaaccgcacaacaacgaccgtcatatatagctgtgctaactgcctaagcttgataatttttttggtagaataattgacaattcttaaacttgaggatattattaacaactataaaatatgaaaattacaatttgatcctttaaacttctaaaaccatgatccgtcatagccgttgtttagtcccattcaaatatctccattgtccctgtcgccacaaagtgagacccgcaccggtatattttactcttttacataagacaacagtaaacaaccaaccaaaatatatgcactcttgaagacgacaatatacaaaattaaagatgaacttttcttcatcagccatgcatatatgcagaggtgttgactctctaataaggcccttaaacagcgtgatcgatcgagattggcatatgcatatactccgctgtgcacgccgtaccaagaacgatatgttcagtacgaatattctcccctatccaattttaaaaggcctgctacaactcagctgtgtgcgtttcaggagttcagacgtttaaaagacgagattttacatatgcagcacagggctgaacaacagtgtccatcacctttctgttgttgaccaggagtacgtgctactagtatctatctatctatatagggccagaaagaaaaaggatggagtgatctgcattctgatcagtacaagtatactacattatcgtttgattgtacttcacttcgttgatcactttgcgaagtacttgtcttccacatggtcattctgagatcactttgacgcagaaacacgtctcaatgaacaaacaagttccgtacagccactaacatgcaatgcaaacttgttaactatttactccctgcacgttcacgttgttcgacgtgacccagctgggagagataaacagtgcttgtgcacatttgcatgcagtgtttacttgggagaagggaacgagaacaacaacagtaagacagtgtagttgtaaagtaaagtagtcgtcctagtgagagtagaagtacacgcgaataaggaaaccatagtttatgcctgcatgtcgagttggtccattggaccttagtagagcacggggtagagtagtctcacgctacagtgacgtctccccgactacaactacgagtccgtggctggctggctactgcctccatcgtgtataggttcgccccagattgggatcggtttccaagcccaaccgatgcttttacatgcatgcatgtggcacagccgcccctaccctagggacgtagtatcactgtagcacaagtagcaggacagctgggttagatcctatagcaagggttaaaaaaaattgtgtggttactctactgctcggctataagtaaaaaactcataaaattcaaacaagttttgtcgtaagtttttattgggtagtttctcgatttgtacgtaccagcttgaaaaactcgataaccaaatgtatattgttatatttattaacctttgatctcagcatatatattgatgtgttatttatgtacatgaaaaaaaatcaaacagctaagactattgtaaccaccaccgagtctacctcctctccttccttgatcacctaccaccgccactgatggaatacttctttttttatcttcctgatatgttgtctctctcctttcatgcatcgcacgcatccctcccgcctcatcgacgccagaagccatcaatggtgtcaaggagacccacccaaatcggtcccttccccacctcatgtctgaaccaagcagcggcgggtgttaatgccccgttgtcttcctcgtctccggtggctcacaccgtcggagacgcctccatcttcctcccaaatcagatgtgatcccaccaactatccttctctagcctcgcgtccactgcctccccgactatctctcttgacggagcgtggggctcctcaccgggagaccgcgtaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgtttttgggagatctgtgtatgaaagagctacaaagtatgagccagcctctcccttgttctgggtttctaatctggaaaagtccagtcccccctctaagtgggcaaggtcctccttttatatcttaaggggataccacatgcaccatttctctcttttttgtggggacttaccccaccttttcataaacagacggagacttgtatggttgccgtccgaatgaccttctgatgggacgacccatacctacctccacttccgccggaagcaggcgcgacgtgggaacatggctgtttgctgacgacatggccagtgtcagaccggtcacaaatcggtcattcttgtccaccacgcgtcagtttatcaatctgcatgttcgcccttcttcatacaatatcttgcctgtaatggttaggatgaagcctggcatatatctgaccaggactaacgtgccatctctgggaggtaacacgttagctccagctggggacgagcgcctagaagccctcgtcctgacgggatggggcgaggcgtgtgtcagatcgcctgtcgccacctaacccgcgatctgaccggtctgtgactggtcacagaccggataaacgagtgcactgcactgcgttacatgcggcgtgacacgctcagccaaaccgcaataaatgtggttagg

SEQ ID NO: 46940 - DNA, 1859 bp, Oryza sativa
catatttggccacatgattcttcctcctcaaaacacctccatcccatgaaatgtagtactgcttgagagcaatggcgtgtggagaccaaccttttcttttctaggttatcttgtcttccccaagagatacccacgcatgttgccggttgccattaaggcattaacaacagattactactactgatcacagaattttcagatgatgatactactgcttgatgcatactacgtggttcctgacttcacaacgaagtcatgctcctggcgtagtatcatgtcagatagtggtggttgagaccttgaaacttgaaagaccacaaaaaaaattgcagcttcagacttcagagtcgacagaccgccaacgagaacaagaataacacaggtgacaagtatggccgtatgggcatttccttctccttttcagtttgtaattactccaagattcaggctttcaataaccatgtgcccagcttgatccattttactgctagctgctggcctgctgccactcgatgcaaatgaaaagagaagatgtcagcagaaagtagcaacaccaaaccaccctgcagaaacagtcgttcacaggttcagaagcgtggagacactataacattttcctttccggtgaaagttgtccttctgtgttaagcagaagtggttagtaatgcagtgatacagcactgtactttcctgcagaagaaattgatgacactgtcaaaattgaccagtaaagaaaatggtgttgatattggcttcggctggccattcatcaagaacaaaggacctctggttcatctactcttcgggtctctgtttaatttaatgccaaaaaaaaccttatcaaattttggtatagttgctaaaattttaatgaacttgtcaaaattttggcaggatttcttatataattaccaaaatttgatagcaaactaaatatagccacttttttttggtaaatttgaaaatgacatcaaattaaacaaccccttcaagtacacatcagagcatcgagtgacccaccaaccgattttcatctcctcttcaagctgattgctcaattccccatcttttcctttcacttcttgcctatattcaggctgtacaagacgactagcctggcctgttccttcttttcacctctactagtaggagtactaatttactgcctcgccaggcagttttccccgcatgcagcatgcttcactgaaatgccttgaaagcaaaagccttttttgggaggcagtctccctgctcgggactctgtttcctccatctcgacagggatttttttactgggctatggcttgtgatgcctgcatttctcatgcaacgcgacaaatggtgcctgtacttgtgcaaaaaaaaaacagcaagtttcagacatggtacacgtcatgtgcagacgatatgtggaaacgaggcaagctgctctgctgtaaaagggggattggttgctgctgtaaaaagaggatttggtccagacacatggaatcaatgcaggccgtagactgaaaagctgcctcgtctcacaacagaggaaaacgaaacatgcaaaccatatgctcaccgtaaggaaaggaaccattttcatttgagagaactgcaaatatgcaatgcattggtccttggaggtgtacggtgtgctcacacggcagttcagggaaaaaaaaaagaacttgatgccttgcacattgcacaagcacaaaggtcaaaggacctgtttggactttggggcttggaacggaaagtttttggtcaggatcaagctttctccttgaatttcccgatctgagcgattgttttgtactagtcctacaaaaaaagtacggttcatacggactacgaactgcattcgtctg

SEQ ID NO: 46941 - DNA, 11155 bp, Oryza sativa
acttatcttgtgaattgataataccctatacataaacaagatgctcagtaatcttaggaaaccaccacacacgcatgcaactgatgctttgctgcgttaatactatactagatactcttacttagatcttgccgtttctttagggtctttaatggaaatgggagagggctttgcctatctgttattagtacttctacatactcgttctgtaccaaaataaacttaatctatgataagatatgatatattccgaaataacgaatctagataagtagttgtgcagatttgttgttttatgcatgatagattacattctaacttgatttttttataacggagagaatatgaaagaagaagtctactactctgtcctacctaatgtatagtaacttactactgaattggatattttataatattatgaatatgaacatactcttatctatctaattcatagtagtatgaaatgtcaaatctggttctaaattgttatatatttttttacgaatggagtactactaaattatgagtatcaagcaatattagttcaaccacattgtcgtttctcataattacttatcaatcatgtcttttttcccctcgtgatgttatcttatcagtcctttgcttgggcacaatgatagtatatgctcagcttggtaccggtagtaccgaaggaaggccacatgggaagaggcccatctacggtcgattttcaatcatatcgttttgatgggagcgtgcaatgcagtgagtagaatcgattttccttggaatggcaccacccctaaacccttttccggtagaatctctcgtggtgagttgaatgtagtgacactgctactgcgagttgctagaagtgatagatgttactcgctgtgggctgccccctgcctgtctcgtgcggtctagtctggtgtggtcgctgtcgtctccactagagaccactactactactcgcttgcatcacctgaacagtagggttgctggcctggcacgggcggctggggatttttttcgggacgcttcacaactgtgtgtcagtcattgtgtatcaatgtacaaatgtttgctcggcgaccagcactgccgagtgatacttacagctggttagcttcacggctaatttatagtagtagtagcagcatgtatgtacggttcgccacagtttcttagcaccgtgtctcacgtatcatggactcaaaatctgtagcctgtgacactcgtttctttgcacactttttatgacccgtcgaattttcgccatagctagacgtgaaccaaacaggcacttaactgcggcagaccgctgtttgcatctcagcatcctcagtggagtgtgttaacattggtggtttaaatggtgatgatcggtttctgccaattgttttataggaaaaatgaaaaggaactgtagcatgggctccgttttgggctgacctttgctatatccggccatctgggcctcagtccacctaataacagacccagagcacaacaaagttggagtaacctccatatataggaataagttcattataggtccctcatctcttgacgttgagtatgaaattcgtccctaaaccacaataacaggtataacaccccctctcacttttcaaaaccgatatacgcgacatcccaaggcagtatagcagttggtttcggttgacttgacaattgagttagtatgggacccatatcagggcaaccaatccaaatctaaataataaagattggtcaaccacacatgttagtgacacattctcttctccctctctacattttttctcggtggccgacgatgagactgtatggtcgtccaggtgttggaagagggcattgacattggcatcggtgagaggaggtcggcagcggcatgtgagcaggcaccgcatttaatgcatgagccatatagcgcgaacaacggcatggaggaggacattggtatcggcagagaaggacgaatgggatcctacggaggctgttgcagcctcgtgagcagtcggaccatctctggtcaacctctccacttatgcactggtaggcatcggcagaggagttagagggacgaggatcctggcagcacggccatcacgacgaggtgcgcaaccaacagcagtaatgccctatctcggatggcgctcactgtcaccacatcgtgggttgcctcatcagatcctgtcgctgccaccacaatgagaggagaggagaagagaacctatcgtaacctcgcaagtagtcgatctgcctctaagcgacctctccgcttgggcgctgtcgcccggcacggagtcggcccttctccccgccgcttgccaaattccggcccctacccctgtccacgccgcctgtggcctacatcttggcttggtgaagatggggatgagaggagaaaagagttaactgctaacgtgtaggacccatgtgagccccacgctgactcaacaaagctgaccgaagttaaagcgccacatcagatgaaaccgggagccatattgcctcgagacaaaaagttgatatggtttcgcgagttcgtggatggactatacttggtatagcggttgagagatgaattttaaacttggcgtcaagatgaggaatctaaagtgaactcattttccatatatatgcagatcatggtccatcttatgggctttcactgggctggaagcctggaaagggccatcgctcttcataggctacgacgcataaagtggcacaaccacggcccacaggcatacgagcccgtccgtgcttcttgatgatgcatgctttgtcgaagtacgtagaaacaaagaacatcggggatgccaggatatggacatcactcagttcatctcctacacattggcagattgctgcatctacaagaaaaaaaaaacgcatcaacctgccatgcagtgggtacgttacgttacgtagctgccgaagctggctgggaataaaggggaaaagggagtgagacgatgtatggttggcgtcgttgccgtggtcctcgaccggtgctcctttccaacgttggtgaatcatgatcggtcaatttgcaacgagagagtgatggaggccagtagctagccgcccacgcattcttcctcttctctctctgtgtttggaggccggccaagcggctaactagcgtcgtccaccgtagtgggtttcctccttttgaagcaaatgaacaatgatcggctccgaaaagaagagcaacttgtcaggtgtggtcgactatcacaccataagacctggcccatttgagtatgttccgggaattaagccctcaatcggcacaggcgaggagttctcatcaccgtcgcaaacacacaagtgtttgaaaccgggcaccggcaactagttgggctcgacatcaacacgagacttcgctttctctctttcttttttttccccttttcttttctgacagccactgtctgccccgagcagagcacgcatatatgatgatcatcatctaggactgtagtcttcccaagtgtacacgcccctccctttttacctttccgaacctccgacacccacgacatgttcgttagtagtactggtgctggccatgcctggcggcaaagctactactagcccccatcgtatcagtatagattcatgcacgctagtgggagcacgacgcacccagcgagccagccatcacgtaagctgataagccctttgccaaatcatatccccaccacgcaacacgggcaattcggcgcgcgtgccgagccggccgttccgatcctccgacgcgagtgggcgacgcgtcgcttgactcgcgcggcccatatccgggtggaaaagggggtccaaaaggggggagtgaattccgagttcgcggcgggttggtgcgcgccgcgccgcgcgctcctgcttgtcggcgcgcccgcctggcagcgaccgaacgaacgagcacacatgacacagcggagccggcaaagcagtacacgcgcgaggcgcggggggccacctcgcgcgcaccaggggccaggtacgctcgtccgctcgcgtcgctagtttaatcggtgggcatcaaacgctggctggaaccgtccaactgccggcgggcggggcggagtcggcagtggaattccagagcacgagcattatccactctgtccctcctctcatcgccccggtcgctctcaccgctactcccccaccacgcccccaattccacccctatctcgctcgcttattatatagcggcaccagatgaggaatcaatcaactcatgccgctgcacttgtttgtttatctttaaagctactagtatgtgtagctaggaacggatccatccatccatcgttgcattcctcgttactccaccccgtccttttgtttattgggagccacagataagatagcaacgccctccatccacctccctccccacttcgctctctcgtctccggccgcgcgcgcaagtccctgtcaactgctagccccgcctgcttcgctcacctcacccaactaacccctccctcccctcgtccggataacaaccaatgcccaccatcaacacatcatgattatgatatggccatgattgattgcagcagagcatctgcttaacaccactactaatactagagtatccatctctactgtgtctctgcgactatcacaagggcaggtagccgggcgggcggctggctggctggcccgttttggctgtaagagcatgtacaataggaggctataaaccagttataatcatatatcgagaagaaaagagaagagagagaagaaagcgggctacagatttgtagccggctgtaacacaaacttcaaaatgttatatgtgtatgagaggtgagaccgggtattaatggtgtagtatatttttatagttaactattgtatgaataagatattagattggctatagatgttttggagctagtagttggctatactattgatcttgctctaagggatctggatttggtgcacgctattcctggttagttattggacggacaagtacaattagaatatacagctcggcacgcgcatgtactgattagggcacatcgtccctgttggataaaaataaccaagccgtcccctagaggggatccaaacagatcgatcgagctgatatatactactcctcgaacacttaaaccatccacaagtaggtgtttttttcctgaacaatataatcgatccgaccaagcaataaccaacgctgccagaccaagcgaggtgttttactcctcgctttggctctctcagcttgtcttttgtgccttgcttgaacgaatacggtatcctatcctgtcatgccctggcctccccgtacgtcggcggtccagcaggaagccataaacgcgggccgcgacgtataaatgacccgtcaccgacaacatctgtgaactggaagtcgttgcgcgattcctaacagaagcagagaccgaaatcggtgcgcgcgcacccacacctacctacacggcggcaacacaacacacacgagcgcgcgcgtccaccccccgtgaaggccgtgacgtgacgtctcaaaactcggaactcgccgcggttggacggattcctcctcctcgcgctcacccaaaccctatcccgcgtctacacgtcgcgttcctagctaagccgcaccgacctccacccggaccgatccacgccgtccacatagtcgcacgcatcgcggccgtccgttccaactccgccgaccccgaccaaggtgggcggcgaggggggatggacgtatgtggcggggacgggatgacgatgcgctcaaccaaaaaaaaagtggaatggacatgacacgatgcgatgtgattagcccgagcttgcgctgctaatcttgcgggaaatctacgtcattagggtggagacgatgagtagtagtagtagtatgattgggattaggagagggaggggccggggatagtgggcgggcgttgccgtcgctggcaagcgaaaattgacgtcgcttgtccggatcagcacgagcgacacgtacgtgtgttggcatgggcgggcggatggaattagctagtgctctgtgcgctgcggtgcggtgccgtggacggggagggaaacgtccacgtcggagcgacgccacctagccgcctcctcatgtcgacatgtcggtgcctgcctgccggcgcgcgctacgctagcgagagctagccggaggagcggttgggggctggcccgaaattagtggtgctctcgctcgcgtcgcgtccaccgaacgttgtaccacccgatgccggtgcggatggatcatggatgggatggccgtttgtgtttatcccagccgcgacgcaaaagcagccgggctttgcaaccgtacggccgcaggctggaaaggggggggggggggggggcgctgcatgcggcatggagtaactgcgaacgtgcgcgtgtcagtttttaattgtgccggtggtgcaactactactccagtcaagagcagcatcaacaccgaaatttgtcgcgcgccgtacgtacttaaccccgcgctatcggttttctgctttgtcaacgcgtgcataacctgcgaggtgaaagtacagttaatcatatattggtactgttttgtcttgtgcgagagagagctctaccctcctatatatacgatcgatgtttccaagcacaaaagggaaccggatatactacagatttgggcgaaaacaacgttgacgacgtaaaaacgaggccgaacagttcttccgcgtgtggttgcgtcccagcaccggaactgaaagcgtgcacctttttcctggtttccgcatgcatatgcgtcccggcttttcttcgcctacaccagctttaggcctttagctactagtagtacattgaaatcctaccgtaccagcgcgacacgcgcatgcaacgcgaaccatcaagccgagctgctccgttagctagagccagccatcatagataatcagattcattcgtggtacgacgttattgcccacctatctcgccctcccgctccgacatgtggtggtccaatggcttccttttcacgcgcgcgcgcgggcgcgcgcaagcgacaaagccagcgatccgagccgagcccccggcctgcgtgcactactagaaaattcaccacgaaaaaaatcgtggcatcaatactaaaattatggcaatagatatatattatcataattttaaaatcgttgctagccgtggtaataaatagtggatttttatttagtggtaataaatttaaatgttgccacggaatagatgtggcaaaaagtcatattgcaacccactccatatgtggcattagttttacgtaccaaaataaaagttcaaatattaatctaacatcctatctatttatctatttgtttttttatatcgtgtcttggctaggattcaaatccaagacctatccttcacgcgtgctctactttaccaactcacctacacatcagttctgttggaaaatgcatatcgttccatttgagcctatctaactgagatttgaatcataaatttgaatatctaaaagatttcaaatgaaaaagttatcacctataaaattgtagatctcatcaagagctataatttccatataaaatttgtctcaatctgtgtccatatgaaaaaattaagttaaattataagacgacaatttttttattgcaatgaatttgttgatcgtgacaacaaaaaatagtgaaaagtaccatgtactgtgtaaattgccacaaaaattaaaattatagcgatagaacatgtttttttgcaacaatacgattttttttagcgatatctcattttctattgcaacaaaagtactaaataaaacaacgattgtatatcgttccattaaaatataattatttgctacagaaaaattatcgttgcaatagtacaatatattgctatgaattattttttgttgtaataatttggtgataatagcttaattatctggtattggtgtcgctccccgcttcgcgcgcgccacgtacgcgtacgctggcttgcttgcatatgcacgtccctgcgcctacccacgctacgtacgcatgcaggtcggtcctaacctaatgatgcgtggggggctcatctcatttgctcctggccggcgtgagtcgcgcgtcgacaaccttgaatctgcccagcccagccgggggccacggtgtactgttgtaatagtactatctatctaatctagctagttagatttgcatgatttagacccggagttctggacagggaagccggccgccggccacacggccagctattcccgcccaattatgcatgggggcggctagctgacgattgactccacctaaaaggagccaattatcaagggacaaattagcataattaaagtgtgtatattggctttggactacaatacatactgtataacttcgctgtaaagtttctttacggagaaaatgccatacgttagtaacggcccagaaatgtcgtcgtctcaagcttttggcgcaaagacagttaacggttttactttagtgaatgttaccgattgtgcttcatattaattaatggcattgacctgtgtacgtggcttgctgtctggtgtaaacaggcagttcgatcaagtacatatatacatatacatatttctgaaatgtgtaacgaattttcgacagctagaacttgaagtgaaagtacatgcatgcatggctacacggaggctcacccaaggtcaacacgatcacaaatgtggcgacaaagtgtgtatgagggttggtggagaagagaaaaaaaaagatggatgtgacgtaattagagatagtcataattttattttattttcttcgagctgcacacaatgtacggtgatgtggttgaggatggaatttataatcaacaaaacaattaccataacaatggcatgcatgatcactaaattgattcagcttgtgcagaaaccttgtaatattttagtgccaaaacaagcagcgcgacaaaccattttagtcattaaaatcgaatagggtcatatgtatacccacatgtacataggccaaaatgacgaaataccactattagtttttccctgacttaatgttatttcatttgccagtttgcggtatatgcgattttaatcataataagttaatacggtaacatgatatatacaattccttgtggtttctacgcaactaattgctgaccctaccatatgtttattgaacctggtttcaccatgcaaagcaatatcatctctctcatatctaagatgaatggtaaacaccataagtttttgtggctagaatagaaaggcaggcgcatggtgttgtctagtccaattgtggaataacacaagttatctcaatgtgttgtgtaggtgttggtgttgtaagatatgaatgatagcaataacaccaacaattaaacgacaattagtaacaaaatttgatctcaaattacatatttgtgtcgacgggagatacccgtagaccggataaataaaatattggggtacgttggtacgaggatctacacgatatgacgataaacatataaaaaacaaggattatactagtttagacttctcgtgaggtaatagccataattcagtttatatgagattgatatggaaaaccacagagtacaaagagaacagatgaatccgacgataccggcgagatcattgttgagatcgttcgatgagatctcccggcggcttcggcttgtgtccttcggcttcgtaagctatggcgggtgtgttggcgctgtgattcgatgatcctgaactccttcgggggtgtgccttttataccatgagtttccttagtctccaagtagaactcggagacaatgaaccttgccgatatagaataatccctatcccctcctagtgggactctgttaatcgccggcccgtgaggatatttttcataatatcttgtatacttcgttattgcatacggaaatatatcgtatgaaagatggtataccaatcttgcatattcggtaaatcgtaggatagaatgtatgccttatccgtaaccttaacactttgaaactctggttattaattagttttccaattgcctaattaacatattagattagtcctggaaagaaacatattctcatcgcctcaaaatataacaatttttagggatggcatatatatgcacgagaggagttgaatttgtttttaccttatcgggatgggtgaagtagttccgaactataagagcaagtttaatagtatagccaagtattgacctcaaatcatttatagtcaatttaatagacaattcatataattgttatctataaacctataccacacaaataatatttggttccacttgtcatacacacatgtatcttggagtctgtgctgcagctgactataaatctgtagcccactgtttttctcttttcttttttatcttttgaaaatgtttttataactggcttatagtctgctattgtgtatgctctgatagttccaagggatgataggtgcagtgcaacggagttatggagctaattctgatgatgtatttaaccgatttcgtctgtaggacccagcaaaggggcactagctaatcctgcagtatcatgtgtttattgatcataatttcatcatgtgacacaccataagtcactatgactggaatggaaatggaaagcgcatggctcgttgtccaattgtgacggagcgtggggctccttaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtccaatccccctctaagtgggcaaggtcctccttttatatcttaaggggataccacatgcaccatttccctctttttttgtgtggggacttaccccccttttcataaatggacggagatttgtatagttgccgtccgagtcaccttctgatgggacggcccacaactacctccactttcgccgggagcagatgcgacgtggaatcgtggctgtctgctgacgacatgaccggtgtcagac

SEQ ID NO: 46942 - DNA, 19922 bp, Oryza sativa
  unsure (1)..(19922): unsure at all n locations
ccctgggggagacaaagagaagggcggcggtatcacctcggggcccgaccccccccaaggaagttaggccacgtgggtgatcgtgtctgcctcaagtctctaagtcatgatactcccggtaaagaggagggcgaacacatcacctcgggcctgacgccccctgacggtgccaggccacgtgggcgattgtgtctgcctcaagcctctagtcatgatactcccggtcccatgtcaccgacagtagcccccggcgttatgccagggcgatcgccctcctcgagggaagcggtcgggcgtaacgccacttcctaaggcctggtgacaggtggggaccggtctccacacttgggcagaaacccaacggccacaaatcacgcatatcggcaatggtaactcggctgtcaataatgagcggtctcttcaagactgccacattactcgagtagcacacgaatctggacatggcgattcgtttcgtctagagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccaggcacagcgttggcaagagtataaaggcactgaggaagggatctgtttccttcctttcgccattattccccttgtcttcgccgcttgcgccctaactccttctttcctgtgccctaccttcgccacacgtgctcgctcttaatcttctcttcctccggcgccatggcacggggctccgctctgctcgatggtagcgtgctgccgccttcccgcattgtgagcgagaggcaggctgggctggcgcgccgtttcatgccgggatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaatgcggtgatgactttggccatcttcgcgcatctgtgcgagatgttcattggggtgcgcccatctcttcggctgttccggtggttcttcaccgtacagtcggtgtcgccgccatcggtagttggtggctgctacttccagccacgggggccggtgctgaaccgctacatcccctgcgccctccgcaagaagtgggacgactggaagagcgactggttctacaccccccttgccgacgaagcgcgcctccgacttccgagccagcccccggcgcaggcctctagctggcgggcgtcggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagactttatgaggacccaccagggagtgagatgggactgggctcctgaggacttcaagatattggtccaacgggtgctgaatctcaactccgtggaggcgtccctcattcctcaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgggagggggtcgtgcttctgggtcccgcgacaggggcccggggagtagccgccttgccgacgcccgggggaagagcaagcagggaggaacacctcccccatctcctccccgagggggcggggcggtgcgtgccagcagcaggcgcccggagggggccgcgccgacatcgcagcccgagagggagcgcaagaagaagcggctccgcaagacgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggtcttttcttttgtttcagcgagatcccgttgcgtccctcccgccattccaagtccggccagtctgaggccgaggatccggcggccgcagaggcccggaggcgggaatctgaccggcgagaggccgcggatcgcctacgggaagccgaggaggccgcccaggaggccgcccgggctcgccaggccgaggaaaccgctcgggaggaggccgcccgggcccgccaggccgaggaagccgctcgggaggaagccgcccgggcccaccaggccgaggaagccgctcgggagaaaaccggatttcgccaggacgaggcgatggcgacttccgaggcagctcgcgacgaggccgcgggcgcgtcgcttgggcccactccctcgggcgacgctcaggcgacaacttccggggcagctggcgacgaggctgcgggcgcgtcgcttgggcccactccctcgggcgacgctcaggaccaaacgggtccgggggacatccccgagtccggcacttccatcggcggcccgagccgcgtggcctcctctccaaggcggctcttccccacgccttctatcgctccactgaacgcagagccccttctgcaggccttggccgccgcaaacaccacggtgttggatgggttaagtgcccaggtggaggccctacaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgctgcccagggggtgcttgacgctgccgctgcccgagaacagcgggcggcggagaccgaagcggcgtcccgggggcgcgaagaggcccttgaggcgcgcgccatggcgctggaagagcgcgcttgcgtcgtggagagggatctggcggaccgcgaggccgccgtcaccatccgggaagcaacgctagcggcgcacgaggctgcctgcgccgaagaagagctcgcgctccgcctccgcgaggacgcgcacaccgagcgggagcgagctctcgagggggccgaggccgcggcgcaacagctggcggacaatctgtccctccgcgaggcagcgcaggaggagcaggcgcgccgtaatctggaaggtgcccgcgccgagagggccgcactgaaccaacgggccgctgaactcgaggcgcgggcgaaggagctggacgcgagggcgcgcagcggcggggcggccgcgggcgaaagcgacttagccgcccgcctcgcagctgccgaacacaccatcgccgatctgcagggcgcgctggactcatccgccggggaagtcgaagccctccgcttggcaggcgaggttgggcccggcatgctttgggacgccgtctcccgcctagattgcgccggtcggcaagtgggcctctggagagggcggaccgtaaagtacgccgccaaccacggaggtcttacccagcgcctctcgaagatggccggggctctccaacggctccccgaggagctcgagaagacaaataagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggctcgcgttccccccaactccgacgaggagggcaatgccggtggtgcagacgacagtgacgacgaggccggcgacccgggcgcatcggattgagcccccagaccccgccattcttcagttttttcttcttttctttcttctaaggccttcgggcctcttttttgtatagatcaacttaatctgtaatcaaaaatgaagaaatttttgtatcaatttcatcttgctgtgtgtatgagatgaggatgatctgtgccgtggtccttttgtgtcttagcttgattaagggttcgtgcccaggtcccagtcctcaaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcatgagtgacctatttcaagtcaagattcttcaaaaggaaaaaacagcacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacttcagggtgagctcggatgggagaaccgcttccgcgccgtagacgaggaagaaaggcgtttccccggtttctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtggtcaggtgaggcgaagcagagcttgatgcccatgtcttcgcagtagtcgacgaagagttcactagtgaattgggtgccattatccgtaataatacggttaggcactccaaaccgggccgtgatgcccttaatgaatttaagagcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccagtggggtctgggctcgcgaggacgcgagccgtgagagttcgtcgaccatcatgttatcccgtctgggcacgtgccgaagctctatcccgtcaaaatggcgctccatacgccgtacttggcgcacgaatgcgtccatctgcgggtcagagcaccggtactccttacagacttggttaacgaccagttgggagtcgcctaacaccaggaggcggcggatccccagtccagctgccactctgagtccggcaaggagtccctcgtactctgccatattattggttgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggattgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtgggtccgaccctcttcgctaggggccgcatccctggggcactcttcgtccaagcagcctcgcggggcgcacttgtcttccgtgctgatgacctcggggtcggaggataacaggtgcggccttcccacagtggcctcggggccttcctgggggtcgggggctcctggcgtcgtcggacaagcgggcaaagggccaactccagtcgtcaggggccttaggcctccgttcggttcgggggcctcttctccctgctttttcccgggtcgagtcagcacagggttagcctcggggtcaaagggcgataggtgcggccttcccacagtgacctcagggccttcctgggggtcgggggctcctagcaccgtctgacaagcgggcagagggccaactccggtcgtcgggggccttgggccaccgttcggcttgggggcctctcctccctgctctctcccgggccaagtctgcacaaggtggggtgcgcggaatgaggattgtcctcatcgcgctccacgaccaacgccgcactaaccacttgcggggtcgccgctaagtagagtagtaagggttcatttggctccggggcgaccagaaccgggggagagctgagataggccttcaactgagtgagggcacgctcagcttcctccgtccaagtaaacggcccggagcgtttgaggagcttaaataagggtagcgccttctcccccagcctcgatatgaaccgctctatacttgctgggggggcgcatccgctctatagctcgtatcttctcggggttggcttcgatgcctcgggcagagaccaagaacccgagaagcttgcccgcaggtacaccgaacacgcacttatcggggttcagttttatgcgggcggagcggaggctttcaaaggtttccgctagatctgagagtaacgtttcctggttgcgcgtctttacaaccaagtcatcgacataagcctcaacattacgtcctaattggctacccaaagaaattcgagtagtacgccgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccattccggatggatgacctcgcggatgaatccggcctccagaagtcgcgccacctcctcgcggataaaggcttgacgttccggggcctgccgccgcactttctgccggaccggccttgcgcccggccgtacggcgagacggtgctcaatcacctccctggggaccccgggcatatccgccggtctccatgcgaagacgtcagcgtttgcccacaggaaagagacgagcgcgtcttcctatttgccgtccagaagaccactgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccaccggggcccggcatcttcatctgtaggtaggcgtagtggaccgccgccatgaacttcaccaacgcgggcctccccaggaccgcattgtagggcagactgaggtccgccacatcgaagttcacccgctccgtgcggaagttggcgggtccaccgaaggtgaccgggaggtcgatgtgacctaacggccacgtgtgccccggcgtcacaccgataatcggctgggacggccggagcatcatccccggggccttgatagcgtcaaaggctgcgggggaaaggatgttgagggccgctcctccatcaatgaggacacgccccagcttcacgatgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgaccgcacggcagtccatgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcgtcggaatggactgacctcttcttcctcctcctgtcacgccgccctatctgagcggcggatccgggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacgcccccccctgaacgcgtagattaccgcatgtgcagggatgcatggtatggtgttgcggacttgacagaaccgctgaatgtacgagcgaagtgactcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccgatcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcggtcattacgccgccgctcgatgctggtgcgggcgtccggccccccacgcagatcttcccgggtcgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgtcgtgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcgagagctcagaagatcactcgcagagccccctacctggcgcgccagatgacggagcgtggggctcctcaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtccaatccccctctaagtgggcaaggtcctccttttatatcttaaggggataccacttgcaccatttccctctttttttgtgtggggacttacccccccttttcataaatggacggagatttgtatagttgccgtccgagtcaccttctgatgggacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggacggggcgaggcgtgcgtcaaatcgcctgtcgccacctaacccgcgatctgaccggtctgtgactggtcacagaccggataaacgagcgtgctgtactgcgatacaggcggcgtgacgcgctcgtcaaaactgcaataaatgtggttaggtgagccctgccatgctcacctaccccatatacgtggcgcaaagcccacaaggggtcggggcgcttcggccctcggggccgagacgggagcggcccgaccccttggggagacaaagagaagggcggccgtatcaccctcgggcccgacccccccccccccccaagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacaaattgcaaaataacataactaatatcttatcttttttttacggaaagaaataaattagtatctcaaacctccgtgtgttgagtagttatatatatagatactgtgatatgaatgatgacaacatcataaagaaataaacaccatgatatttgatgacagagttcgatcatactcccaccttttatagatgttagatttattctatattttgattttctttttcaaataagttaatcttatttgttgttttcatgtatttaaaatttaaataaagagacaaattaaatatttaatcagaatctgatgagttttcttaatactcattgattctatgcatgaacatactccttgatattttttacatgtaagataatataacttctcttttctcttgatgataaaagtaatatgtataactcttatagatacttatagatagaaggaagaagttccatatatacatctttgaaactctaatatcattattccaccctaattaacttagttttacattgattttaatctatattgttattaccgtttgaaatccaactataattttaatttctttcagaaacttttcaaattaaactttttttaagtatatgttaagtgaggcatcgagaaggaagtacattagtagtacatagagaggccggggactcggcgaaaggcagattcataggttgatcgatgccgcctgcagtatactgttccgaaatgctgctttttgcacgggtggttgtactccaagacggtggtcgtcgacctatacgatgtccggatgcaagttagccggtggacctaacaaattacgctgccgctcgctcagctcaggctcccctccaaacagcacagtacagtgctgccgtcgacgtcttcctcccgagctattttatcattatcgcaaccaaactctaatcataccaccccccacccacaaaatcccaatacaaataccacccatcaaatagatagcgagaaagaaaagagaagagaagaagaagccgcccaaccaacgccaaaagctactgctgcttgcacaggagagggcagagagagagagagagagagagagagaagagggcggctgcggcggcggcgcgcttcgctcatgcagggcgagtaccaccgctcctccagcgaggactcggctgcttctgctgctgctgctgcggcggcggcggctgcggctatggctcctctcgccgcggctgcggcggcggttgctgccaaggaggagcaggcggcggcggcggcggtgctgccgctgcagcagcagcagccgaggcggcagtaccgtggcgtgcggatgcggaagtggggcaagtgggtggcggagatccgggagccgcacaagcggacgcgcatctggctggggtcgtacgcgacgcccgtggcggcggcgcgcgcctacgacacggcggtgttctacctccgcgggcggtcggcgcggctcaacttccccgaggagatctcctcgctggcgtcgctgtccgagggcggcggcgcgagcgagccccgcgagcccgacggcggcacgctgtccgcggcctcgatccggaagaaggccatcgaggtcggctcccgcgtcgacgcgctccagaccggcatgatggtcgcgccgacgacccaccaccgcgagcggcagaagcaccaccaccaccaccaccaccaccacccgcacctgcagccgcacggcgaggagcaacaccaccaccacgagcgaagcaccagcggacggcgtggagcggccgcgccaagaacccggatctcaaccaggcgccaagcccggagaactccgacgccgagtagaagccaacaaaaccgcctccgcgcggcaagatcgatcaacggcttcgtcaacatgcagccagcgtatgatcacctccaccacgtacgctcgctgcatccatccacctaccacctattcgtccacccctcatctccacctcggcggcggcggcggcggcttcgtggcgagatttttcgatgcggttttggataagaacaagggaagggcagcgtcgggaggagggcggtggagacgggggaggaggacgccacaagtggcggtctttccaaatgtcaaaaaagacagctgtaacagtgataaaacaagtcatcctctctgtttttttttcctctctctcttctccgtgttattatcgactagataagcagcgattaattaatccgtccttccccctttaattcttctttggttgcgtcgtcgcacacacagtacagggagtatatacaatttgccaagcttgatccagttgctcatctgcctcaccccttaatccagttgtctgttggtgagcaaaccccggccggcgcgcgttaggttaggcagccagccacccacatcgttaatcactctcacagttaagcatctgcctgtaatgcgtgtgtgtgaacgtgcaaaaacgcaatcatgcatgggatcagtggacggcgtagtggtggtgagccatgtcttttggctaatctaatcaccaattatgagcttaccacattaccactagtactatcatgggggaggtagcaatcaggtcggtgtccaatggcaggagcccgtagtacaactaactcggcaggagtgtccgccttcctgcctgtgcctgccattgaaagtatgcgtcgcgtactcgcgttgcatatttgcatggggatcgatggttgttagcctggccggccaccacattggaaaaacgtcgtcgtgattggtcatgattgcagtggcgtgtactacgttttctcatattttgcatgagcttcaagtactcctacaaccgaccttctattgcgaaacaatggctgttcgtgccggaaatcgaatggattgattcggactcggcgtggcaggttatgaatcctctgggctgcatcatatcaacgatgggtgaacaagaacaacccatgtagtatgtacttacgccgcggcagtaaattttgctggaccatcagcacatgatggtagtaatgcaaaacacgggctagctgcagacgcatgcagaggcgacagcagtgcaattttttttcgtacgtacagacagtgcgtgccggccgcccccacccctccactgttctacctccccaattgttgtggaactaacttttgcatcaaactcgtcctctctcgcccgttaattccctcaaaactcgattaaattttcgaatggacaaaacactgttttctccttaagagagtactacattttgttactatttgtaccacaatctgacccttttccagcgatccattcatcaattgtcatcaactagctctccaggatgttgttactgttctttgagatttgttgtagccagactcagccagaccgaagctcgcctgtactacaaaggccaaagggaggggcctcggcggtgtagtttgcgattgctgaaagggaaggcgacgttgcctgccgactcgctaccttttctggcctttttgggcgccctaccgatcggacccaacaagccacccacgaaaccagcacgccatgacacatccgcttgtgtgctgctcctcccacgaaaaaagggccccccgtttgggggcgcgcacccgaccagccgcaccccaaatcatctggctgcatccgcatcgtctgtagccgatcacacggctcccacggctcccccctcccctccaaactgggcccgtttcgatcgatcaacctctgccaaccgcagcccagcctcgaatcaacaaggcccataacacgttgtaatgagcgcgcgaaaaactttcttgtgaaagtacaggagtcggaggaaggaatccgtatctaacgatgattgtgtccgtgttgtgcttgtgcacaaatcgtgatggggcatggaatcgagttctaacgtgtccggccgctgctagcgtccaattcgctgagcttgacggcgaatctaaacatgcagttccaaatcagggccctatctagctagctactactactagtagcattagcagcaagtgagggctagcacaaagcagtcgagtcgcgagcagtagatgagtggagcggagacgataccctgccggtgggaataccagctacagcgaccggtggccgcgccgcgacgtgcgtgtttttttgccgctttttgtggngtnggcgcgtccaccaacaccaagtcaccaacccctgcgtttgccggtcgcgatgccgcggcggggacgtcggcgtgtgggcggatgagagggaaaaggctccaaaagaggccgggggggagtttggccggcgacggcgacgtcggcaattgcgtgccggcttttcgcgccgcgggcgtctgtggccgacaagaaacagatacaaggtgcaacgaacaaaaacgcattggatcgatcaggcagagaggaaacatgaattactgcaaaacagtagtaccaggttggttggcacatggtagtagcatgcgtagcagataaggcaggattaacagggcacagacagtgaaaaaaatattgagccatcatccaatataccagccataaatattcagttgaatgcagagcgacagattccagggattatttactgcaggagggggcagtttgcagggaccagttcttttacctttttttttaatcaaatttgtaggtcaatggcaaaaaaaatttctaatcaaaaaacggcacggtaatatgaatcactaaacgatcttgcgatcgaacaagcacacagtgtttactgccctgtgctttttctaagacttcagagcagtatttttgcatatgggacaggtgttcttcacaaccagccattgcctgacgcatccaacatggaagtcatgtccacagtccagtgtcccgagatcatccccatcaacatactcttcctggataaacagcgagaacgaacatagttagaagacatcaatatgaattattagtttgcagaattgccaaaacttttcattgatttaagaagacaatgaagaaaaaggaagatattgagcaaagacaattcctcaagtgtatcccaggtaagatatttgcttgggtaggtcagtatatgcagcactaggaatcttgaacaaaatcatattcaactttcagctacaagttttaaaagttgagcattgttgtccaactggtagtggttcacaggcctgaccgacttaattgataattacagctacattattgatagatgagtgtttttcaagttaaaatggacatactcacaggcttatgtcacctattaggtatggcgtacaattaacaaagctaaatgcacaaagcactgaacctgctagatttcaagttaactaaacaaaggaaactatgtcacaagcttctgataggcctgagttatacctggcagatacagcatggctcttcttccacagatgcttccaacctccatgatgagaatttcctttgctttaggagctttgtcacttcttcctcactgaggccagtgctaacattgcctattctttcttccagtgccaatagctcctggaagacaacagcaattatcagagttttgctggagaaagatccagataatattgtgctaaggaaaaccaacctcataagacatgttgtctatgtcaaggcgcatatccctgtgtctgtcatgaatgtcgactccaccatagaaaatggactgtagcaagaacagatatacgtggaagcaagagtaaatacctcaagaaataagcaaagattttagaaaacaaaaaagggttcagtgcaagttgttgcctatttgtttctctctgttgaaatgatgactatatttttctgaattatagatatactatggtctttcatgcattcactatatactatttccatattacaagaaacttctgttttcagaaacaaaacaacaccttatgcgatctctcttttataaaatggattagaatccagcctctacatccaaactgaatggacagagcaaaccttatgtaatcctagcatcaactagtattagtcagccagtcttgctgtgagtttttaggacataatatagtttcatcaatctctacaagtccgtgcagataaaaataggcaactgtaggtaactccgaaaccacagttgttactgacctcaaatcttacattttcccctctgtgaatcatttcaagcgcgttccggatctggtgacaagcaaaaaggtaagaaacatattgtcttgcatagacttcatggttacacaagtaaataaatgaacgacgcatccaacatggatggctcactagttattgcctgtccaagccacatagttctagagaataacatgcggctagaaacaaaacgtagcatgcataaggtaaacggtccattgaattttataactattaatccactgtgtcatttaaaaccaaaacaagatatgtgctctctctctctctctctctctctctctctgttgagttaataaaattaagtgtcactactaggtacaagatgatggtgcgtaagggggggggggaatttagcaactgccgtaacattttcagattggtgagaaactaaagtttatctttccaccgcagaattaggtggatggctgcagacatgcgaagaagcatgtgagatcaaaggggaaatgagatttagaagatcgtcagaatattattcctaatgatgcttctgtatgtccactaaacggatgtaaacataacattattctgatttctgacctagttcagaaacaaggcaggcaagagaagggaaaaaaagagagcagaattgatacctcaattaatcttcttccttccctgctcctagttgacaacggaacaccccaaacaccatcaccttgtcgttctaacagaaaaccggaccttaggcgtgggtgctgatggccacgaagagctccagataaacgacttatctcctataaaagaaaaaaacgcaagaagattactaaaagataaatcgatttgaaaatggaacatattgaactgagcaggcgaaaagctacctctgacaaattacgaggattacgtctatgcaagttttgatgggcaataaatggagagcctgctggtggattaaccatcgaattggtattagctctcgatgaagaaggaacatttcctggaatggtagtagctctgccatctacattccaactagatggttctggtatcaaatgcctcatgtctagtgcggccggaggaactgcatcagggaagctggtagccactacattcctcgcgctaaattcctcactaccaataattctgttctccaaattgcctgttcttgatgatgaggcccctggaccagtgaaccggtgtgacatctgtggaatgccaggaacgacattcattggatgctggtattgaaagttcaggctactgaccactggaattacctccggtggttcatcaaatgaactctgaaagggaggtggctgatgattccatgaattggaatgtctgatagtacttgaagatggccacacaccataggggccaatatgttgagccaggctagttcttggccgaaaacttctttgtgagcctcctgaattgttattgcctccactaggatcatagctactagatgacaatccagctgtagtagctccataacgcgggagttgttcatcaagagtgcttggaaccaacagacaattaggagagggtaaatttgttctaggagagggattatgactcgaagaagcaatgttatggaaaatactatcgttcctgtgggaaaaactagtgctagcacctgccgagcactgcccattaactccttctatatttttcctcttgcatgccagccggcggcc

SEQ ID NO: 46943 - DNA, 12947 bp, Oryza sativa
aaaaccacatattatacagatccataggtttccagaggtttgacaaacagaacatgtaggattcttagactgcttctgacaaaactggcaaacctgaaacagaaatattatgaataaaaacaagtcatgatcaagaaagcttggtaatgtgaaaaggcagtggaggatcttaatacaaggaaatcaatggcatatggttatagtggtgagtggtggcaataatatatttgtattatagccataggcagacattggcacatctacaactctacgctccataaatctggttagcgcaatatgtcttaagattcaccgacacgggtaaacaggtgccataaacattcagtgatcttcaagaaaaatacagaaggtgaacattctgcaaatgaccctgacctctgtccctggttagttcctactgagtagcaaatgtacaatatcatacttgataaatgaccacatattttattggatattgttatggaattcgatcacacttgataaatggccacatattgggtattggtatggaattcgaactactacgttaatcagtgccatagaagattactcaaaaattcaaaattggaagaatataaatttagagataatccattctatatttctatgccattgacaaagcacagattctgcaatatgtcacaaagctcagttctattatataccatcgagcaattagttttcttccttatatgccatagccgctagtcaaccattagtcaaactatgttaagagcaagtttaatagtatagccaactactagctccaaatcatctatagccaatgtaatagctaattcatacaatagttgcttactacactattaatacctgatccccacctgtcatacacacattacgtcttagagtccgcactgctattgtttatagctggcttatagtctgctattgtacctgctctaagggcgagaatatatccattttacccctagggtatcatgtgtgctcatggatttcgttggtcatgatccactattttttctcattgatgaaaaataggaatccattgtgtttttatcttccaagattatttaatgcaacatggcattggtcatttttcctcccttagctgcatctgactaatggttgactaatggcagataaggaagaaaacaagttgttcaatggtatattgtagaactgagccttgtcggtggcatattgtagaacccacgctttgtcaatggcatagaatggattgactcataaatttatataaaattgaggcaaattcagtatcatgtaaaaatgtaagcaggaaaagaatcacagccataacaaatggttgtttgttgccctaattgagaaatggtgattgtcaaaatgatcattaccggacaagatgaattgacccacattgaaacacatgaacactggaacgaatgatcacaagtcgttgccataattccgctgatgtcttgatccaatctttctgtttcataacatgcataagaagatggtgaaaagatgagaaaaaaaatgatacattaaaatgttcagaaaaactcttcccaataaacagaggaagtgtgtacctatgcatacttgcacaaagatagttaaacaacataagttaatagatagacctgaaaacaaaggtcttaactataattatgtaatccatattgcccaaggagaaataacatggtccctagatttgacagagcttactggtatagtagtagcttggaaaaatagcaccccaaagtcagcttttagaaagaaagaaaaaaaacagtaccgaaatcgataggcaatgtatacctccaaaaataaggttaacatatatatggtgaaatatttggcaaagtgtggatgacttccatagtttaccacaaaatatttggcaaagtgtggcatgccacacattgtatggctaagaatttgttggccacaattgtggcaagttatggcaaaaaaataactcagtgacaagtgagccaacttgctaaaaaattgtggcataactcacttgtggcatgaaccaaacactaggcttaattggtcaaacttgggtgccacaactttggcaaatgttggcactcaaccaaacagcccctaagacaccacaaacatgtggtgagtatgtagcttctcaagtctcaacttcacaggtgtagtttctcagaagagaagtggctaatcttttgatcagagggggcattgcaaattgatatcttcccagcctatggggaggtgatacgaagcaaaattgtagtggacaaaattcatatctgacattgttgaatgaccacaaaacaaggagaaaaatataaataagctcaccaatacagacaggacatgttgggagctcagtggatccaactggtggagtcaccgcaggcttggttgatggtgtatattggacagcaactataaacagaacatggcaaacctctacctacaccatggaacaagaagcgagcgagcttcccaatttaggagcaatgttacacatgatcagcaaactagacatacatccaatcgacaatgttagtaacctcggatgacgagaacctccaaccgttgaggtccaagtagaacccatcggcactcttctgatcctcaaactccacgagcacgctataccggtcctccaccccatcatccctaccgacacaacacatatgtaaaaccatagcttcccgggcaaagtcggacacaaattgcttcaacgagaaggataattcacctgacgacatggatatcggaggcgtgctcgatgtaagggccgcagaagcggacgaagtcgtctggtgagacgtgggttgggacggcgagcaccaggagccgtgtgccgcgccatggctgagatacgcaggcgatgaggcatgagaacacgcggaaatgaacaaattagtaaataagatggtaccaagaagagaggttaccgggagtaggcagtcggaggcgagctgcggggcggcgggtccggaggaggaggaggatggagtggcggcgacggcggaagcgtaggaggcggtctacgaggaggaggaggaggagcggtaaaggtgtaggatgccgcgggtgtagttgatcttagggtttcgggcgggcgaggcggaggtcgcgccgggcagctcgagaggcgccgttacggaggcggaggtggtggtggggagagggtcgccggagcgcggggagagggggtgagaggtgccgctggtttcgccggcggcgacggcggtggccgcggccgcggccgcgtcgtcggtgaagtcgacggactggatcagaaggctgaacatgtttgcttcctgggctttttgggccgttgctcttctttttgtagttttagtctgtagactgtatactgtagtaacgctgcttgattttttttcctctttttttctttggtaattaattatttttctcttttttttcttttggtgaattaatgattgatttttttttcgtcttccggtgcaatttcagccatttttaagacctagttcaaaatgtgaatgatcaaatgtctaacagtgtgctacctatcattttttattttctgtactatttttaaaagaaaacatctgcactgcgtccatgcaacaggtaacccgcctcacataaaaacacctaaaaacaactcactaaggataaaaagacatcctgtaaaaagccaacctttctcccacatgaaaaccatcactacttgcaacgacgacctatcaccgtataaaaaacgctccatgaaacatcaaattgtagatgactaaaaaagtgaaaacggaccatcacaatcttacttaaccaacctggttagagtgacttgcttgcaacataagcaaaaacgatttctatgtactccctccgtttcacaatataaatcattctagcattttccacatttatattaatgttaatgaatctagatatatatatacatcaatataaatgtgggaaatgctagaatgacttacattatgaaacggaagaagtataagttaactggacatgccctactcatagctatgtgtaaattttggatttccattgcaacatgtgtggtccttaactagttacatgaaaatgttgaacaacatatgaatgttggaataaatattgaggctatttggttgatgaccaaatattaccacactaaatcttggacacgttataatttcttaagctagtgtttgattgagagccacatttaaactgaatcccactttattaggaattgattacatgttatacttttattttctagccaaaatttttcatagtcgttgtcttttcatactcatcgcaaattaagttcatggcaaagttagccttagatccaaatgccaatcatgaagcccgataccgttcccgtgaaagtggagctacgacttcgccaaacgccaatcatgccgtagggtcatcggagataagtgctctactacactgcacggaggagattcgtcaaactactcaaacatcatcgcctgactctgactgatcacctcaaaatgatgaacaagcaaccggtcgtgcggttagatcagaaacccccgaatctttggattcgcactcgtaagcagatcgtcgacttcccgccaaaaaacacacatcgtctcctccatagtcctttccctgcctccaatgatcagcaacagagcaatgcttttgctcccttttgctacacagttacacttgacatcatccccctaatcaccactgacaaccctgccccacatggctgggacccactcgacagtgaaaatggttggccaaagcgtgagtacgcttgggtttaagcagacaacagtcacggctccaccataatctgcccccggctaattgcactagcccactagcttttggaagtactaacctgcctcggaaaacgtgacgagacaaacggtggattagattagataagaaaatgattagagcgagtataatactatgctataagtaaactgtaaacacatatagacaagagaaaagaagagagaagggaagcgggctataaatttgtgcgtacgagagataaagccatatattaatggtgtaatatatgtttataggtaactattatatgtataagctacttccaagcaagatgaattgaagcttagggttggttcaatttgttaccattttcaaccttaccaagttttgacattaccaaattttagtaaagttaccaaaattttgacaaggttaacaaaatttatcaagattttatatgtaattactaaaatttgacaacaactaaatgtagccaaaattttgacagctttgttaaaaaattggtatggctgaaatgcgttagaggttagttgagttaaccttgctctggtccaagcgagtcgtagtagttgcccttttgacgcgacacgaaccgcgcgccacctgttgctttgttagctcgcgcacgcgctcgccacggcgcggctctccactccagtcctctcactctcgttgagctcggcgaggcgcggcgcgcggggcgaggcggcaatgttcaccgacggcatgtcgaggttggcggtgggggtgagcctcatgctggcgctcagcctcgcgctgttcctcaccatcgcggtgctcctcctcgccgaccttttctgctcccacctccgcaggcgctggatgcgcgcggaggagggggaggcgttgtcccggcggcgcgcgaagctcgggctggcggggacgtcgcgcgccgccgcgggcgacgacgacgcggcgtcggtggcgacgacggcgaccaccaccaccgcgcgcgaggcgctgtcgagcaccccgccgttctactacgcgcacggcgtcatgcaggcggcggcggacaccaaggacctcctcctcgccatccccaagctggagtccgccgtgtggaggtggtcgccggcccggcgctcgtcgccgtcctccagctcctccgccaacagcgaccgcttcgtgtgcatctccaacccggtgtacgagcggggcgccgcgcccccggccgacgttcgtggggacacggacacgccattcgagacgcccgacgcctcgccgtcgccatttgggatcacggaggaggtggaagaagagggtggcgagttctcgccgccattgtccgtgatgaggaagctgccgccattgggcgtcgtggcgtgtcccccgccatcgatgggtttcatcgacggccggccgtctctgggcttcaccgatggccggccgtcgctgacggcgtggtcggggacggtcaccgacaccaaccgggcctcctcgtcgtcgtccaatctcaccgctcacttcttctcttcctggtcacccaagtgacagattggaggattacttgtagtatccatatggagtattgatttagcagtagtgcagtgcttgttagctagagctcgattgaattcattgattttctctctttgatatgtccggtccttcgatttgctgggttttgttggtttaatctagcaggttttctctaacaataactaactttgtttgcctcatttgctcatttggtttgtcatgttgatggatagaatcatcgaaagtgttactcaaaaaatatttttgtggtgcaaacagaaatgatcgagcgtaaatcatttgtcttagccacgcacttacgccatgaataatataagcatttgcagtttttcatcgttcaaacttagtactacctttttcagaagaccgatacaggagaggggtcaagtcaagtgatcagattgaggctgtttcagtttcagagattgtcctcagacctcagacaagtctgcattaactttgcaaaacaaggttctattgcctgaagaattgtactacatataaaccacaaaaagcacgctgtcaatcggttcctaattaacacaattttttgatcgcaacagaaaaagagggatcttgaggaagaagagtgccaatgcatatctcgggttctccaaaaggaggggggcgaagaagaccattgccgcatcgttgggaggctctgaaaagccgtggcgtgtaattattttacccgtatgaaaaaagcctggccgaacgagtgaacgtgcaatgcctttggggctttggcagcttgagttttggtcgctagcttagcttccccccgcggcgcctgctcccatgctgttcctcctcctgcgtccttgcgctgtgcctgtgcgcgcctgcgcctgcatggcttggcgctttctctcctctgcttggtttgctcgttcgctcgctcgccctgtcagtgcagtgcaggcactgtgctcgcgcaaagttgagaaacggtgcgacgcgtgctggttctcgatgccgtggagtacctgcctctgctcgttggtgggtaacgacagcgtcgcgtactcctctcctctcctctcacatgtgtccggcaatggcggggttgactcatggccatggcgtcacgcgccaatttcccggacgcgcgagagagggagatagagagagggcaagttgtcctggacaacccacccaggcgcacggcacgatgagctgtgaattgttgtgattcccagttggaacaggtgcgcgcggccagttttctgtctcccgtggacggacggaggaggccggcggtccggcgagaggcggccggcgccgccgacaggggaaaagaggggccccttccggccgcggtgcacccgttggatacttgttaaccgttagattagaaatacacggtccagattgagatggacggcccaaccctttttcgttactgccttgtacgaagaaagacacggctaagaaaatacataaatgctatataccggtataccgtcgggacgggatacccctcgtccacctttcccatccaaagaggaacaaggttgagcgcctgagccgtgaggaggaggtggccgtcggcgattccggcgcgggctggggaagaagacccgctcggcaagaggagggcgcggccgccggcgacgtggtcaccggattgccgcctggtgctccagcaccgccacgcgccatccacggcaccgctgttaacgcccacctacggctccatccgcatggccggctggtgcgtcctccgctggcgccccaactccgtcgccggcgacatggtcgccgaattgccgcctggagctccaacaccgccgctcgccatcgacggcgccgccgttaatgcccaccccctgctccacccgcgtggtcagctggtgcgccctccaccaacgccccctccgtcacgggccctctacagtcgccgccttcatcgccggccgtcgatcccgagtccggaccttcattctatccatatgctgcttcggaggagcaaagagacaaagatgggtgcaaagagcttgttaacttggtcatgtctggctgtagagtgtggtagaatcatcttctacgtggtaagaatcggatgatacctgataggtatcatcttctatgttgtaagaatcgcataatacctaatagttattatctaatacctcacaagtatcacctgatacgtggtagaatcgtatgatacctggtaggtatcaccgatactggctaggtatcaggacctgatacatcgcaagcatcacccaccatgtggtaagaatcgcatgatactggttagatattaggacctgataccaacccagtatcatcccatttttgaacgagatactggtatataaaaaccctcaaaaaatagtacaatttgagttcctcaactatttttaggttggatgtgatacgtgtccttcaattgtaaaacttaggtatttaattactctattaaaatcatgcaaaatgactcactcgactggttttgagggtgttttggctaacatgacgtctatatggcagccaaatcaccaagggaaataaaaatagagagtgggatccaaatgtaaccgaatgggaaaaatttaaaattgtagggcctctatgtcagcacccactctttttttcccctatgttccttttctgtttgccgcctagtggtgtaaggttgctagtgagctctctcgactctgcaacgactcgtgagtcttaggatggaagctacaaaagaggggagctgttgcttgttccgtctctcttcctcccactcagaaggagccttcgagtcccgcaccttgccataacgaggatgggaggtgcgacgtgaggacgaggagatgttcgtgctaacggagccaatgacactagcactacggagtacttgaggaaggaggaatctagatgtgtgtataagcagcgaggagtactcgaggaaggaggaacaaggaggaactctacacgtcatggtgcagttcgaggacggcgcaagggtgatccactggtgtcatcttacatcatcgaggtttgctcaagattgtttgtgtagcgatgagataaagagagagagaggggggaaaatcatcgtcagtactatcaagggagttattttacaccagttttaatagttagaggcattagttacctggttttgcgattgagtatatgaatcagatccaacctatatttgagggactcatattgaactttttttctcgctatcaatggtagctatccaaattaggcccatacaaaatgttactaccacgcagatggccgggagaatttactatttgccactctctctgaatgccagtgctcaaatgccactcttccaaatttttattcccaaataccaccggacccacatgtcagcctcactcagcatcgggtcccgcatcactttcgtaagaatggagagtgagactgacatgtgggcccggatggcatttgggaatgaaaatttgggagagtggtatttgagcactggcatttgagagagtggcaaatagtaaattcccccgcagatggcccgagcaccacatcgatatctgtgaagcggaccatgaggctgaccagccgagccgaccaccattcgccggaaccctaacccgccaaaacccaaaatcaaaatcgccatctcggcgaagaaatccccaaatccaccggcgaagccccaccaaaccgatggcgtcccacgccgccgtcgtcgagatcatcgacgacgacgacgacgacgacgacgacgtcgccgccgcctccacccctcccgccctccacaagcgctcccatgcggtcgccgccgccgcccccgattcccccgacgccttctccccttcccctccagacccgaagcggcggcagctcgcggcgtcaaccatcgtgctcgacgacacccccacccctccgaagcggcggccgccgccggtagctgccgaccggtccgcctccgtggtggcagatacgccccggtcgttcgtgccgtgctcgctccgcaaccgcgccattgctggtgatacgcccgattctgttctcccgagcccgtcgttccacctcgacgctcccgattccgcgacccctggctcggatgtcccgtgctccgtcgggcttgacgacattgttcctgagaccccgggcttcaactccccacgcttggctcgtcccccggccgtgcctggcttgacgtctcctatgaccgcgaggaaattttctggtgaagtttcttaactattagatgcattcctttcgagttttcatgaattctaccggcctaggttaagctcatttggcttcatccattgaatttgccgtgtggcaaaatagacaaggattaggtccagttctagtcatggagcgttggagcttgtagctcatttctgtgttctttttcttggcctttatcatttatcaatatagctattcttggtgatttatggcaggggtttctatacagttttgagaaaacttgtttgcaacattctgaatcgatttgttgggtcattttggttttaacatcaggtggaatcagacctaaatcctaatgattgcaaacatttcgatgattaatctgtccttaatagtagtttggaattaccaataaacaaagtgtatctgactattctttcgagcatcatttgtttctttactctacttgatatatgaagggtccttaaaccttaagttacatgttggacccaaatgacacctgtcaaagtttagaaagtgcacagatttttatcaagaggaggaggcagagattttttttcttaaaaaaaaactccactaactattgctttgttgacgacacagcatgtccacttgtaactttttttttgggttaagatttatctccaccctgctttcttatgtgggaggcaactgagcgatcacattgattagtagatgacagcatgtttaatatttattatggttcttatgtggagtaactctctttctttctattttacaggagtatcttgtccaatatctctggatagtgatgacgaattggatgacactgtatacagggagtctttaaccaggacgccaagcaatatggcgaagccagaacacgcaattcagccttgtactacttcctgtactgataaagttgagaatacaaaaagtacagataagaaggattattcaaaatcaaatgttggatatcaaacaaacaattctgcatgcaaaaataatggtaagaaaaacctaaagtgaggacagtaaaaataaaatatttgacactcatatgtgttgtaaaatccttttagtatatatctggttgtaaacaatgtagataacacattattgtttagtgtattgactatgtatgcttttgttaggaacaaccagctacaatcaaccccctcgtgctaattctccttgtgaagattctaccttgaaggaggctgatccttttatcaataaccattgtccgcaggtatgttaacctaagtggtttgtaatttgatctgttataaacgttgaagcatatttttatattttctaggcagaaatgtcatggaaatgatatttgactgaatcagaagaatgtatgacctagtatgccgttaggcatgttaaattacgattacgctgttggagatcatattgtagttttaggtgtaattaattgttatgtgagtggaaatagctgagacttaagattatacaacaaagatattgatcaatccaaaagacaaaagttacaccttaatagctgtatatgtatactaacaaaaaaggagatgtcttgtttttgaaggaagaaaatgccctaccgattgaagaaaggaagaagaaacaacaggtgtggcataaagaaaatcttcttgtttcaagtttcacaaattataggtttagctttgaaattcttgttcttgcatgatataggaagagaagagactaaagaaggaaaagaaagccagagaaatcgaagaaaaaaaacaaaaacgactggtttgaaatctaacagaagtgtatttatttattcatgccatgatctagagattaacagagcatattgtttatttctaggaaaccaaaaagcaaaaggaagctatgaaagctgaactagcagaattgaagaagctggagaaagaaaaaaagaagtgggaatcagggaagttagctacaaaatgtattgttgctgagattgactcaagtgttattgaaagtggctcagttggaggtgtgttaaacaaaagtaagttaattaatactagtaatgtttgttcattgtctcacctttctccactgctcggatttccaaacaggtcatcttgtgcaaggatttcatgagaagggcctttgttttcgagtaacatctaattcaatcaaggggtcaattttatggaagatgcaaattcctaatgagtttacccaggtaccgcttacaggataacttgtttcctttgtttacctttttccattagaaattgcatccctttattggttcttcaaatgttttgttggcctcaaccttattctggcatgcgtacgttggtaaaacttgcgcctccaaagtaaaagaaaaaaaaatgatatatttctacttaaacggttggtttcatccttataaccaacgcacaaatgcgttccgggtgtttttaaagagagctgcctgtgtaattgaacagccaatgctgcttcctcaggcccaa

SEQ ID NO: 46944 - DNA, 708 bp, Oryza sativa
cttgatactttgtccattttgctaaattggctgagtatgtgcaaagaatattaccattataccatacagaggcgatctgccactctcagaatgaacaattacacatcatagtaaatttataattctgttagcttatgggaaaattgaaagggttaaatttcagaagtatcaacaccaaaatcgttttactgtagatgagcatgaatggttgcaaaacatgaatggttgcaaaatgcattcacagtgatgtggtatcaaccataaattctagacagaaagttagagttgatcaaagaatgggtagtcaggtagaaggttctcttatagaattcatcaccctttgctgctttcatgttttgctttgaagaaattaaaccatttttatggggtgccagccgataaatctagataaaaaaaatctcctatttgatgtatatatacagttccacaaaaagtcacggaagactgcgcatttgactggtatcttcttgttttctctgtgtaaatactggcgacacaggaaaaatatcctaagtgccatacatttgtgcaggaccaagcttcaacatcacaagtgccatatattctctttgtgcttcaagctgaggaattctgcgatcttgtaagtggtggtacattactggatcatgttcagaaagttcgaagacagtatccagaattcacaattcgctacggggccgcaggaat

SEQ ID NO: 46945 - DNA, 900 bp, Oryza sativa
tacaacatcattcaactcaggcaatctagtgcagaactcctatgatgcatcacatgaaagttcttcattgcttgcaaggctgcatgcgatggaagacgaaaataagactatgaaggaatctctttctagtaaggatggtgagctccagtattcgcggaccatgcttgctcgcacaacctctaaactttcccaagttgaagctcagcttgaggagttatcaagaggtcgggttgcaacagatttagtaaaatgcagtcctacagtggtcgagaaccctctatcatcaatctccgaggacggttgcaatgaacataatgtcagctgttcaagctcatgggcgtctgccttgatttctgaactggaacacttcaagaaggggaagctgactacaccctcttgtaagagtaccggagtatcagacttgagtttcatggacgactttgaagagatagaaaagttagcattggcatgtgatgcgaaacctacagaatcgtatgattcaaggagggagtctagagaatcatcagggaaagagctagtaacagttgatggtcctattgaaacatctgaccaactccgtcagcacaagattgagaaggcagtcctgaagttgatagaacttattgagggtgttgtccagagatcatcaaaagattatagtagcactgttgtgctctctggtggcagtgagggcgaccgctctaacacattgactggctacgttgcacgtgcattcctgtggaaaacgtctgaacttacttctgtactacaaaatttcgtccttgggtgtaacgagcttttgtatgggagtacagatgttgaaagatttgtgcttgaaatcaatatcacactagactggataatcagccactgcttttcactccaagatgtatcagacat

SEQ ID NO: 46946 - DNA, 1283 bp, Oryza sativa
cccctccccccgaaattttttatttttgttttatttgtttgatatttttttcacgcttaaggacacacaagaaccaaccatagaaaaattgaactcaaatggacgtaatatgtgacctgtaaaatttttcctctcctctcctctctctccgaactagtgcagaggagagagatgtgcaacttttttatttttattttatttttttgatatttttttcacacttaggaactcacaggaaccaaccatataaaaaataaactcaaacagacgaaatatgtggcatgtggaattttccaaagctctaccgaaaaacttctctcgaaaacacaatcttgcaagcggaatttggaggttttaatatcgccgaacccgacaaagcggggaagaatcggatgtaactttttctgtagatgtccgtgtatatattatttgcctgattccgagtccgtatgagaaagttacgcctattttaatagatgacatattttgtccgtttcggtagagttttggaaaattctacatgtcacatattttgtccgtttgagtttattttttatatggttggttcctatgttctcctaagtgtgaaaaaaaatatcaaaaaaatgaaataaaaataaaaaaaatgcatctctatggactgtttaacttatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtgatatgctcgctattttcaaacttagctaagtggtagttcgagtttaattttttttcgcggtggcctgcatcgcgatcctgagtgtgaaaagccccccgaaaaaatcaaataacaatgacaccgctctgactccacacaaaccaacaagaatccaggcgccggcgccagcatagctggcgccctcctcctgccacgtcggttcgcgtgcgccacggtggcagaaggacggcgccagccaccctggcgccccaaaaaggaccatttctgggataagttttttcagagatctatttgcgaaataagttttttaaaaggagcaaaatatgaaaaatccagtaatgaaggatgcacagtgacacaacacaagtggcctccctcaattatttgttggaacgctcttagctggctggtcaatttagatgtgaatgctttccttatttggcagtgcacatcgaatcatgttgctttcgcagcacacaaaagg

SEQ ID NO: 46947 - DNA, 1593 bp, Oryza sativa
tctccagaaatgctgttattcgataggtctaaataccgcagctgacgtatctgacacaattctatcggtatatgcccgtaaatttcgttatttgaaaaatcaagaacaagcaagtttggaaatatcgaattgatattgtctggaagttgacctgcaacacggttcattgatacgttgatatatttgagaaaattttgagtataccatgttgactccaatgatccagttaacgagttatttccaagatctagcttataatgtcttgctccctcggtgaacaaccaatcgtgcatgctccctggcaagttattattggacaaatcaagtacctccagatgatgttgtgtgcgtagaaaatgtggttctgtaataatgctcttgtcaaggtcacagccagagagcgctagttctttcagttggaactgaggtacccatccaggaatatttacatcaacagctaaattagcattatctgacaggactaccgcctcaagtttcgtgaggttcttcagccaagagaaagaaaatttgccgctcaaattattatgagaaaatcgtaggctcttgataaacgcaggaaggtttgaagatgaacttataggaataggcccttctaagagatttcctgataggtccaatagttcaatatgtggaagtgagaataatgaccttggaatattcccagcgaatcgattgaggctcaaatgcaattctcgtaggttcccaagattttctattgctgcaaaaaaacatatgcatcaataagcagctccatggacaatcttacctaacattatttgcacttaagataatcagcaagtgctcatttttctgtaccttgttcagttggaagagttccattcatgttgttgttattgagatttaacacttcaagtgagactgggaatgaagatgaattaatgggaatgccaccctcaaaaaaattcccactgagatctaagaccttaaggtgaggaagtgaaaataatgacgctgggaggcctccatggaatttattgaaactccaatccattttactcaaattcagtgctctcaagtttctaagattctcgaaagctgtaaagcatgaactttcaaataccagcacatacaaggaatgttaattctttacttagcactaagagaggtaaaaaagaaattatgtacctgaagccgggagagtcccattcatggcggtgttgcagagattaacaacttctagcaaaactggttccggaggaacaggaaaccctcccttgatgaagtcatttccacagagatctaatactttaaggtgaggaagtgaaaacaatgactttgggatgctaccttcaaacttattcgagctcagattcagttcttgcaagtttgtaagattttcgaaagctgcaaagtataacagttgtttttttcaacgatcaattttatcatcgaggaggtacttagtgaaatctttagcttaacataaggaggtacaaaatacactaaaaacgtggtgcttctcggtacattctcaagaatggtaaaaaaatctctactatgagaagcaaaagatcatttatatacctgcaaccggaagaagtccgttcatgt

SEQ ID NO: 46948 - DNA, 1908 bp, Oryza sativa
gttgtcaaatatgtgcatcaatttagtttcttgtcaaactttgataaatacataagaaatcctattaaaattttagcaatattaccaaattgctaaaaatttggtaaggtttatttttgctacaatttaagcaacccctactggatcaggcttggatgcatgcttcctcgctatacatttgaaggaaagcttgaccacctgcccgctgattcggtcgactgctgagcccattcgtcaagtccgcaagtcctgcacattgatgggtttaccgtgtgtctcaagtcatgacgtcctgaactggtaaacaggccgacagattcatcgtctccgctaggaataagtccacttgtcatctctcaactttacatcgaatttgatagctgtccgtaaaccacaataccaaaaatcttctcccccatctttacaaaaccatatacatcgggtctggtagtataggctcatatttctgcttacataacaagttgaccgggcccacctggccacctcgctaagtcaccaatgaccggacccattgttaacgccaaaatttagtaagcttcaaagttgtcatcggtctagagacaatatcagcttcagagtcccggaatggaccaatagaaattgtcagtcgacaacagttagattcttgatggattgggcaaggaaattcatatttaaatgaagtctatccagaagagatcgacttcaagtaggatatgacaatgtcaatttatttattaattatatagaattagttagtttctttttttatttttaggaaaatgtttttagtgtacgatcaagacttgcatatatttttttctctttaggaaagtttgagtagtgtccaattagaactctgatcggcctatgggtataaatatgtacactcgggatccctataatctatcttcacagaacaatatacatatattttcggcgcatctcatgaggttttatttcgacgagttcttgttttcgcgcatgggctgcatcgattgagttcgaccttcggcaagaagtgagttccatcatcttcgcttgcgctggcgtagctaggactttctcggttgggtccgatatactaattgggtcgacgcaagggttgcctatccggtatatcatttctatctttatttccattactgtttataatcacatcggcttagttaggacttcctcggtcatgtttgattatcataatactatctcgtgctgcatcggttacggttaggtccgacctactagattgttattaataatctaaatcttgttaagccgataggttcatactaatattttatcggagggttagccgatcttatctgttgtgttaattttctctttgatggttttattgtcttggttaatttaatgcatgaccagtttgatcggtgtcatatcagtttgcttaaggaaaaagtacgaattaccccccgaactatcgcggtcgtccgaattacccccctaaaccacaaaactggacattcttcaccctcaactatgcaaaccggacgaattaccccctcgacccaatccagggctgttttggtctacgtggcgtacgcgtggcagtccagtcagcactctatcaaaaaaatatttgtgggacccacatgtcatacacttcttcccctttttccccctctctctctgctccactctctctctctctctcttggcatgacatgacagcagcggacggcacagtaaggcgaccgaggggagccgacgactctagcggctggggcggaggagcgtggcagcagcggaggagcgcggaggagttcgggctcgccggagtgtggaggtacccgaagccggcgtcgcaggagatgtgccccgggtggacgcgccgcggtggtgcgcgtgcctcgggtacctacacccgaaacctgcgacgcggca

SEQ ID NO: 46949 - DNA, 3476 bp, Oryza sativa
aaaaaaaaaggtggaaaagtatcacaggcgggtccccccattttttaaaattaaaaaacgctgataagaatgccacgtgtaccccccgtagaccaaaccccccccggattgggccaaggggggtaattcgtccagtttgcatagttgggggtgaagaatgtccaattttgtggttcatgggggttaattcggacgaccgcgatagttcgggggggggggggggtaattcgtacgttttcctttgcttaaatctatcagacaattatcaaccttatgctgcatcggttgggttcgacctatgggtttatggttgtaaattagatttatttaagtaagtaggcatcaattattcttgcattgaggtttcagctgttgtgttgtctggatattgtttaagtgttgcattagcttataaggattatatataagttggttttagcttatgtagcaaatattttattgattaccagtcatttagatttaatgacatcagattttcagccgatatatactttaaccattagatcaatatttattctatcatactgttaatggtcgattggtttatattgttatgttattataatttttttatagggtcaaagtcctttgaaattcctcttgtttttcttttgttcgaaaaacccttaaacaggccgaattattcatcagctttgctgctaaaacagtaagtttaagggtttaagcttactgctaaaacctggacgctgttcttaagattaggccttctccatctgaccttgccgcgccgcgcccgagttggccgtcgattcagattaacctgggcttggcccagtttgcaaggcgatctgatgtgatacgtcttctcccctctccgcggctctccgctctctccttgctccgttgctctcgccaccacaaccaccatgggtccatggctacagccaaagctagaatttttttgagaattaatattatttttatggaaaatcgcaaaagtagtggtcaaccggggaaaatcgtgaaaataggtccctgtcgaacgggtgcagttcgatagggcgcctatcgaacggccagagcgcgactggcgacgacatcggaaggctgccgttcgacaggacctgtcgaacagcccccgttcgacaggcagggctgtcgaacagcccccgttcgacaggctgggccgcagttcgacaggatgtccgtcgaactgccgcagttcgacagggtcgcgttctccatttatttgtaataagttatttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgattaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagggggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtccccgttggcatgtaagggaagtgtgccgacccagatgctccctgcgaggggtgaacataaggcggagtttggaatacctgcggacgtggtggtgccgtactcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgccacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagttccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcgactgtaacaagtagtagttttcattagtcatataaggaaagtttgtgaactagtatt

SEQ ID NO: 46950 - DNA, 2934 bp, Oryza sativa
ccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgaggtggaaagtgtgggtctcaggcctccatctatcgacaagagcactcataagcgccgcgtcaatgtggattcgttcggaccttgcacgtgaaggctcgactaaccgtgcaaacgtcaacaacccagctgctctcagcctacaacatgacagagcgtaagttattaatacatgaaaatataaacaccttgtattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcattttgatcagccatacctgcagatcgaaaaccacattagtacaatgcacgtatggtaacagtacaataaatgtatgcaacataattcaattaacaaatttgcatgccatttcaatttaaaattacagtaccagcacacatagatacagataagaatagttcagtacatttcaatttaaattacaattccaatacaaatacatgacgatattaaaagtgcagtgcagttcaaaatgaaaattacaaggccattacaaatagattcgggtaataaaagtgcaagaaagttcaaattaaaattacagacgcactaaacataaattgaacgataacgatcttcaaagtagggagtccaccaatgataatagcgaattaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgtgactggcgacgacccttagtatcaactaataaatttgagtcaggaacccaattggcttgccctggaggaggacgagtgaaatcacacacggcacgccaaccacgcaattcaccacgccaagttgcctcccacgattcctttctaaagtagggagaaacaaaaatgtttccatcaatacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccaattatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccgtctcctcctgtctggcaactatgggttttttcctaacctcttccatgtgtgtagtggtcaaacgatccagttgctcccatatggcatcaaactttctttgttgattctgcttgcataacttcttgaacaggtccatcaatctcttactcttgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaacaggaacgacatggctatccgcgtcgactccgatcgcagttagaattgttcctctatacttgcctgtcatgaaagtgccatcaacacagagcaaaggaatgcaatttttaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtgtcttgtaaccatgcactctccaaggacatccaccctgtatgcacttcacgtcatacgtcgtcctatttgaaaccttcaccctgaactcacgcttctggacaaatgcccacctcttcaccgcatcttgta

SEQ ID NO: 46951 - DNA, 8533 bp, Oryza sativa
cctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatagagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctattccctcccctcgctccctccggcgctcacggcgacgatgtggcgactctcgacggcggctggcgatgtggtcctcaaataaatcgaacaagcatcgcgggctggggagacggggctttaaaccggcttgtcgaacgcccattgttcgacagggtcggtggagggacctgtcgaacgcccccggttcgacaggcctggcggcgcggggtggtgggccctgtcgaactctctccgttcgacaggcgagcgtgtcgaacgccagccgttcgacagggctctgtcgactgcccgtcgttcgataggtgccctatcgaattgcacccgttcgacagggacctactctcgcgattttccccggttggccactacttttgcgattttccataaaaataatattaatcctcaaaaaaatccgccaaagctaggtcgtcgtcactcttgcctggccccgcctccggcatcgccgctcctccacttgctcccggcaactaccaatagccgcgcagacagcagcgaaccaaccctagggtagccacttcaaggaccggaggaagttggatggtatgtgatgtgcttcttctctgtgttatttctgctcttgtcttggattatttcggttggatatcatccgatatatgcacacacggctaatacagttttggaatcattccccattttaacaacctaacatgtatttagtattgagtacggagtacactttagtatttaatcctagattttatttccatgtacatccatatagatacatttgaatttgaattatatttagacaattcagaatcttcgggggatgtgaattggattttgtgggatccaaatggggccaacaagtttagggccctttgaatcgcaggattgagaaaacagaggaataggaaaaacttaggaattgaatgccacatttattggattcctatgggattttgaaacacaggaaagttttcaaactgttgtttgattagcacacggaaaaaacgcaggaaccttagacacatgaagaggaaacatgaggtgagacctcatgcttattttcctccaaaattgctcaggtaaggttcatttcataggaatttcaaaggaattgataggaaacaatcatttgtttcaaaggactctataggattatttaccatagaataaaatcctctagaattcatatggtttttccttagattcaaaggggcccttatttttatcatgtcatggtgataaatcattttatgatgataatcagatggtagggtaaacccaggtttgtcatttgtaagccaacagacccggtgagagtactagttccggttcaaccgtcgggctggtatgttttttttactatggctacagtaaacattggttaatgacttttactatggcaacagtaaacatttgataatgactttatttgctaataacgtattaattaggcttaataaattcatctcgcggtttactgatggattctgtaattatttttttattagtgcccgaacaccccatgcatcactctactccctctgtcccataatatgcggtttactgacggattctgtaattatttatttattagtgcccgaacaccctatgcaacaccctactccctccgtcgcataatatagcaacctagaaccggatgagacacttcatggtacaacgaatctgggcaggaagtatgtccggattcgttgtactatgaagtgtctcgttcggtactaggttgctatattataggatggagggagtatataatatctgatgtgatacgtcaaaactttacacccttgaatctaaacaccccccaaagtcagaaagtgcctttttcttctccaacgtgcgcacggcacacaaaatctctaaacctatcaatagaagctcccgctccttccaaaaaggactctcaccggaagcatttgttgaccgcttttgttgagagtactttttggaagggttaaaccacagcttctgttgatagctaattaagagtttataaacggtaaggccatattgcatacgtgtctctactgtcgacaaggaaaaaaaagttacttcagtagcacatatgcaagattacattttctttaggaaataatatacgtttgagtgaacagtacgagtagaatgttggatggtactagtagctgttccctccgtcctatttaaagcgcaactataagtttctgtgtctaattttgattgattttttctgaaaaaattaaaaagcataagtaagtattattcatgttttatcatctaataacaataaaatattaatcatgatttttttttaaataagaccgacaattaaagttagacacggaaactcatggctgcgcttaaaataggacaaagtaagtattaaaaaatctgaagctctacattcggaagcttgtgaatgcgaaagtaatccaaaatgtcactacgaacgaggcagcagtgaccgcgtaaaggattggatcatttccctttccatctccatcatccggtagcgaatgacctgaactgggagcacactcgctcccttctgacgctgggtgtaggaggttgtttccttggtagctatccatatcaaatgagccgaactgaccagagtttggtatacatcctgataagttgttgtacatcactgagaacacggacagtgatgacaaacgagttaactgccatggtattgctccactcagcttgttgtgggataggtctaagctttcaactgaactcatgcttgcaaaggttgctgggattggtccggcaaagaaattgtaggacagattgagggccttgatatgtcccagatttcccaactccctgggaatttgtccagacaacatgtttgcagataagtcgatgccagacatccaattgatgaaattgtgtttgtatatgtaaatgttgcctttagtacggaagctgaagcctctttcttcatagcatccgatgtaatcgaaaattgggtacctaaagtgattctcacagattagcgaccataaagggataccaactggattttgtccaaatgagaggtttccaatacatgatggcaatggccctgatagactgttgtgtgagaaatcaagtatccttaaagactggagctgacaaaggctgggagatatctgcccttcaaacttgttgctgcccagtgaaaggtacttactttcacctagatattgtacccattcaatgtttccgttgaattggttgtgactgagatccaaagccatgacagtagagctattgaagaaagaaaaaggtactatatgtccggacaaagaattatgagagacgataaaaaaatcaagctctaatgcggtcatacagtttggtatagcccctgaaaggttgttatgagatagatccaaaagcataattcttgtcaaattgcaaatgcttggatggatttcaccgattagactattgcccgcaagactcaaggtgcataaagtggaaaggttccattgtgaaaaatcgagtttacctgataaattattgtcatgcaaatccaatgttccatgagcatcgaaatctgctgttagatatcgcggcagtgttccttcaaatttgttgccatcaaggtataatgcatgtttgatcgacaaatgattcgtaccaccaaatatggggccaccaagtttgttgtttgagaccttcaaggttgtcagtataggatattcagtgagcaagcaattaggcaattctcctgaaagactgttatttgataggtccaggtattccattctagtaatgttgcacaatgatgatggtatttctccagaaatcgtattgctagaaacatcaagaaaactcatatttggaaatactgagctgatgttagccggtagatgtccggagatacggttcataggaagactgatagcttgtagattcatttggggataccatattggacctaatgaccctgttagtgagttatttccaagattaaggtaaactaatgtggcttgctctgtaaataaccaattgggcatgctcccagacaggctgttattcgacaaatcaagcacttctagttgatgctgtgtgcgtaaaaaaattggttctctaacaatgttcttatcaaggttgcagccagagaggactagcactttcagttggaatgaaggtgaccagctaggaaagttgaccgcaacaaccaaattagcatttcctgagacatctatcttttggagcttggtgaggtttctcagccagaagaaggaaaattcaccactcaaattattcattgaaaaattgaatgtctttaacgctgacgtaatatttgaagacagtgtcacaggaatactcccctcaaagagattttgtgagagactcaagtgctcaagacgaggaagtgagaacaatgatgaaggaatgcttccatttagtcgattggaacttaaatccaattcccgcaggttccgaagactttcaaaaactgcaaaaacatgcatatggatgattattataaattgcaaaacaataataaacatcaatatattttcttctgctccaggaatactaggaagtgttcattttggacctgaagacggaagtactccaccaacgccagtaaactgaagatgcaagacttccagggaaaccaatttcccaatagatgccgggatagtaccattcaagcagttgttattgagcttgagataccgaagcttggtcaatcctagtaaacctggccagaacgtttccatttacaaaagtaagttctgtcaaccgtggatcatacatgcgtgcgagacatggaaggctatggagccatgcgactcgtacttaccatcccagctctggaaagtagcattgttcatggacaaatccaggaactgaagctccgggaatgaagagaagaccgttgtgtcgaaacgccaaaacgagtgaccgagtgcatctagcacttcattagaatcatacaggtttgagaaatagagatgtgatactcgcccagtgatgttgctgcagttgacgcgctcccacaagcagcagtcgtcgccgcggccccatgaacgcggcgccgtgccatttgagcgcgtcagagaggagccgatgtccatcagcgccgtcctctcctccacgaagcagccatgggaggacgtggagatattggaatctggcaagcatagcacaaccaagaagaagcagaaggatccccacggaaagctgcagctcatcttggaacaagaagctccaccttctcctacgcttggctcactgagacacctgagaatgatcaatggtggattgctagattgtgtggttttatcatgctgctggggaagcaactttgctttttaccactcttgggctctgtaaaaacacgggtatttagctataagttttaatcatgttaatgacttagtcacacttgctgagagcagtgttgattgtgtcacgatgttaactaggacctattaacgtattgaattgttgattctaatttgaatttcctgagttatttattaactgttcatcgcttgatattaagtcatatgcatatgcatatgcattatcgatatatttattagttagaataaattctgtgagagtgcattatttcaagaatatcaagtatggttcatgccacgttgttggccattatctgtagcgcggattagttgtcactggagaggtagtgaggtacacgaatgcacaatagaaattagaaatcccattctttataatttaccagtacaagtctgcaacatacacgcagatacttgtacactaaaattcttacactgtatgcatcttatatatatagtacatatgcatggttatacaatatcaactgaactcatacactgcatacaagtctaaagaagaaaaatatgatttatcaagaaatgttgtgctatattagagtatacaatttgattctaggaggttaaggtcataaaagtaaaacccagaaaataaaagtgaaactagcgtgttttatttttgaatgcatataatctaatggtcacacaaccaaaccatatataagtgcaaatagtaattggacaatatagtatcatcttaaatttaatggattcttaaaaggataattcaagtatagatcagccatctcactacatagttaacaacaagaattatctctgatgatctacaagtgcatttgagttaaggattatatctttatatagttctataaatcaatgctcagtaaatccatcataggatgaattttgaatgcatgcatagttagaaataatcatcgttctatttaacctcaagagcttaagataagatcaatattgtgctaccatttcaagttaaataggcagagcataaatggttagacattgatctattctcagtgtagaaactaaatagagcatctaggatccattagcagaatcataggtaagttggctcttactaagaaatgagccgtagaccggtattttaccttggaagtggaatacgagggttgctacaggctctcggtatgggcatggtacgtacccctattttgtgacttgtgagtttgacatggacccgtagcttaagttaatgagagtgtcggagaggaggggaatggataaattgaaaagatacgtaaaacgagatgagctattagcatatgattaattgagtattaattattttaaacttgaaaaatgaattactataattttttaaaacaactttcatatataaaacttttacagacatcgcatcataaaacttttaccaacatcacatcgtttagtatttcagaaaacatgcgtgtgaaaaacgagataaatcttttctcaatgttccgcgggcgaagttgaaagaaaaagattgagaagatatgtaaaatgagatgagtaattaagatataattaattacttcatccgtttcatattataagactttctagcattgaccacattcatatatatgttaataaatctagacatatatgtgtgcatagattcattaacatctatatgaatatgagcaatactagaaagtaagtttaattattttaaattttaaaaaatagatttttaaagtaacttttctataaaaaaaatctttaaaaatacgcaccgtttaataactcaaaaaacgtgcgagccaaaaacaactcaatttcagctagcaagactcgtttgcacctgggttctggaaggccaagtgggacaatagtaacgcggttacgcggagatctcatgacgagaatatttgctttcggcgatagctgaaattgaggcaagttggggagtcacttgaagattatgacgaattttgtccgtcctcatacgtatccttgcccattttctaaatttcttgtgtgagcaattgtttttcttgatgctgtttcttgactaattaaacaagctactgcaatctaccgagtgcttcaatcagtttggaccggctcagcatctcaactagagccaactctgcacctcgaaatattagaagagaatcaagctcaatttatgaggttacccgtcaagaaccagccagaattaatgtcggttaatttgttatccagtaactatgagctcctctgaacttgcaaaaaacaggagaaagtctgcaactgaaaggagatctcccaagtttcggatcgtctctctctcacacacaaaaaaaaaaaaagtttcggatcgtgaacggagaagcagtgccgcatgctgacccttgactttgtctaacagtgaccactaattaggcaaattccctgtcaagtaagctacttcatgattatctcctatctcgtgtttatgagacactgaccaatttgactgtaacatgtgaacaggggaaaaa

SEQ ID NO: 46952 - DNA, 1733 bp, Oryza sativa
cgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgatggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgagaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgctgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgc

SEQ ID NO: 46953 - DNA, 2665 bp, Oryza sativa
  unsure (1)..(2665): unsure at all n locations
aattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgcttttaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaaataccattttttcttttttttaacattagcaaatcattacttttttaaaaaacttttatttccattttttaaataccattttttcattttttaacattagtaaatcattactttttttaaacattttatttccatttttaatttttttttccttatacatttcctttgcttttttttttaaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccagcggctcggcacgtgggccggcacggcacgcccgtttcatcagccgtgcctaacgggccgtgccgaaacgggccgtgccggaaccgtgcccgtgccgggccgggccgtgccgcccgtttggacacctataatcggctcggttggcatcttcttcccccattgctgccctggttgccggcttcacctccgccgcgtctcctcccctctccgcctctccgctctctccttgctccgttgctctcgccaccacaaccaccatgggtccatggctacagccaaacctaggtcgtcgtcactcttgcctggccccgcctccggcatcgccgctcctccatcctgctcccggcaactaccaatagccgcgcagacagcagcgaaccaaccctagggtagtcacttcaaggaccggaggaagttggatggtatgtgatctgcttcttctctgtgttattgctgcttttgtcttggattatttcggttggatatcatccgatatatgcacacagagttttggaatcattccccaatttaacaaccaaacaggtatatttagtatttaatcctagattttatttccatatacatccatataggtacatttgaatttgaattatatttagaaaatcagaatcttcggggatgcgaattggattttgtgggaaatggggccaacaagtttatttttaccatgtcatggtgagaaatcattttatgatgataatcagaggttagggcaaacctgcacttaagcgcgccctgtgtaaattgcagcctaatatattcattcatcttatagcaagctacatttctcaacagccatttacacaacatcgacatttagatgacaggcccaaaacaaaatatggacattagattaaaaattatagactcaagaattttgaagcagttggtaagtggagacttcacaatcagaaatggatgacagaaaaataaacttcaaatcgttaatgaccacaccaaaacaccaaattccttgtcgcgagaattgcacgccgtccgagtggatggaaaaacaagaaagcaacggtgccccaaaacgccaggacgaatgaggcagcactgactgcatagagcactggatcatctgccatactgtctcttccttccgatggcaagtcacctgctcctgaatctggagagcatatgtttccctttgacatactccgaagattactgttgccttggtagctatccataccgtacgtgccgaactgaccagagtttggaatacatcctgataagttgttatatgccacagagaacaccgctaatgacgataatttggtcagctgccatggaatcaatccactcagttcattgtgggaaaggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46954 - DNA, 9858 bp, Oryza sativa
  unsure (1)..(9858): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaggtaaagaaaagaaaataatgtaaaggaagacaacaaaaatcaaagtatgtaatgagctttagtttcagtacctcttctgcagacaagggcttgtcacgttgacaagatccaccttcattccagtcaccaccttcaaaatgcctaggagattgagtgcggaagagtttcaccccattgggtctcattgctttgttcacaaatattatctgatggacattgtatatccatagaatgaggaagataggttgagtggcataacgacagaaaacaggaagttagtaatgttcaccttggatacatacgaaggctactaaggcccaacaatcaaataaaattcacaaggtggaaatatatatattcaagtaaaacaaaggtggaaaaatattttctatatctatactcctttaaagaaggtagtgatggtggtactgaatctgccaccctatctacttcttaatattttaaaaaataacaaatctaaatggatagccatgcataaaatcaaattaaggtgaatattccctatagtaaaaggatgaatgacacatttatggaaaatatatttgtagttgttgtgggcaatattataaatatgttttcttttatccgtgggaaagtatgagcattcagctagtttaaggaaaaggcaacaagaacaaattgaatttactgcttgatgaagtacaatctctctctctctctctctctctctctctctctctctcatggagacatggctaatatttaagcttatagcccattggtaatataatatttcacaaaaaaaaacacctcattctgtaatcagcaaataatttcgggacaaaattacacaaaaagttcaaaaatacttaatagttatgcattatcaagaaaataaaatgtttttttctcaaaagacaaccgcagatatccataccatgtgtttaagagccaaatccagtcctgcaggtggcaataaaggaggtataactggaatccccttctcaaagaatagcattggtgactgtactggattaaattttgaaggggcccaccacctgtacaaaatacatgagtttgaatcccagcaaagataatatttatgcattttaacaaaataaacgagagtcaggaagtcaggagatagcttagcaaattagcccttatcgtgtagcaagctgcatacatctatagatatatctagcattctagctaagaataaaaacagtttaccaaaacagtttgaatgatattatgcatgctaatgagaagtctggtgctacacctgctaatcaaactcgtattgacatttttcaacatcatatcagaaatattgatcttatatacctgaagtataatggcccagcctacacctagtcaaacaaaagagatggtaaggatctggtccttgaacatcttgtttgttgtttaggaaatgttgaatggtgtgcattttcctaatactactgcctaccatttacctaagctttatagtgatcatactcaaactatttctattttaaatcctaaaaacagaaaacctaaaagaactttcaaatttgacaagtggtggaatttatttttttggggggtggggggtggggggtaagattttcaacaggaagctcaggcagcttggaaaaattcggagcatcttaattaccaaaagagaactactttgcttggagcaaaaggaagaaaccccttcagcaggaagccagaaactatgccaagtagaggaaaaaatcctgaaaaatccagagctctccgaatagagattaactagcccttcaagagagaaacttggctcagcaacaaggattttcacaggcaaagagctaagaaatattgggtccaaataggtggttgaaacacagctttctttcagcaagcagctcaaaaaaggggaaggaaaaacaggataccaattgtcatgcataataatcatctaacaactgatcctgacgaaattgctcaacatttatctcttatttagatcttttccagacttcaaacacagattaaggagtcacatcctctcaagatcagcaagggcaacacacttttgagccaccggaagttccaacagaggagcaaaattttcagatcctcaaacaaatgcgaagagatgcatctccaggactagatgggctaaatgtggcgttttatagagcagcttggcaatggattgagaatgatgtcaccaaaatggtacaggagttctacaatgcagttaaatttgcaaaaaggtatggacgctaccaacattgttttaattccaaaaaatatccagtcctgccactcctgctgattatagacctacaagtcttcgtaacatttcttacaaaaattattgcaaaaacattggccaatcatatccaagagaagcttccagacttaatttctcatacttggaaagtgtttgttaaaggtaggcgtatttccaaattactatatgtcctggcaaaaattagttaataagctagatcaatagcaacacaaatcttgattggtggataatatctagttagatatccgaggtttgagggagaaggcaaatattggaactacagtacaaggaagattaacgtaataaatttctgctgttaactggttactcaaagttttcaaacatgaaataacattcatggatcaggatctacttaattgggcatctaagtgaaaaaaatgttatctggcttatgattgatgttcacataccaatgccctgtgttgaaaataagaacatcatggaagcttggtgcctctgcccatgtttggtcaggaatatcaacgtctactctgtagccttgcttgtatccaagagattctaggggacccccatttggactggctgaccacctacaacatcagcattatacggctttgagtaataacctcagcaatatatgagcaacaacatcatgaaagaaaaactatgacgcagtgaaaaacattaagaaagcggcagagtctactatatttaaaaattaatgaaaatataaagacaaacagtagtcaacagacaagagaaaagtttactactgcctactggtaagcattccaatactactagtaagtaacagctacagtccaaaactgaaagcaaaatagcaaatgcccaaagctgcagaacaaaaatatgtactactgtgcacagaattgtacttatataattaaatcagttgtaacacagaagggaattgcatgatgtggagtacaccatacttccaaagaactataatttggtattactcaaatgacacttcttacctaccatagcgtaccaaaagattagtcctgtggtatgcgagggtgaggttatagcgcaggaatgtgaaaccccggtctgctcctgcaggacgccacttgcgaacctccccactcgcccccctaagcatgcagaccaacgagacaaacatattccggttcaatgaatcacccacaaatcctgcaacaaaccattaaacataaatcatgaacagcaagtcgagacttcttgtccaactaagattctttacatgtatgagagcctcaacaactgaacatgctccgccacataatcaaactacaagattgcaggtaaaaatttacacgtcttctatatatttgacatacaattcacgcatggcaaaatatactaccttgaattgcaaattaatcaggtggaaaccacgttccttccatgctgatctttccaagctaaaagcggcacgcacaatgcacgttgctacactccacaaagatgccttcattggcaatgtcaaatgatcctcgctacagaatgaactgcatctagcttgtaaattgcagcgccacatttaccttgcacataactccctcctcaagttctactattctagtcaccatagaacaagctgcagtggtaaaaaacacacgaaatgggaacgagcacggaccaatgctggtgttcctgtggcactccaggaaacggagcgggtcgagcctggggagctcgcacccgcgtggcctccaccgccatcggagcagctcccggccgttgcgcttcccgttggcgaggcagttccaccccttgaagatctccctgcacgtctggtcgtacctcaggccgccggacaccgcgggatcgtcgtcgtcgggaacccactcgccggacgcgtagtcgcagggcccgcgctgccggggctccccgtcgccggagccgcggagcagcggggagttgggggagcgggcaggcgaggaggtcaggtgcagcagcaggaggaggaggaggaggaggaaagcgagggggaggagcgcgcctcgcctccgcacgccggcggccgggctcctcgccggcggcggcatacgcggtgggggaagcgaggcgtgggggatccggtgacgtggcggcggagtgaggcgaagacgcgagtcgatcgccgtgtgggcctaaaaaggctactgctgggccatcataagtacttttgttggtgggctgggcccaagatcgctaaaattggtaagtactggtatgaacatatcactggtatgaaggaaatgggaagggtgacaaaccgaataatgcaggctttttggttattagaagatgaaggtggagcgaaaacgaacgtttcgtgtccggcgaatcagtcagaagggacacgccaaacatgaggacacatcattttcttccgttttcattttttcccttcttttacgtgattctcttatgtaatccgttgcatcttttacgtgattcttctgtaataggtatttctatttctttccttcacttctgtttatttctcatatttcttttttcgttatacatagtattttttatatattcttaacggaaattttctatacaaacaatttctggggaaacttttctatataaagtgagacttcatatatgtaaactttatatatatggactttgaatatataaactttgtatatgtagactttgtatatgcaaactttatatacaaattaaatctataattaaaaagtttagtgcataaattttactagaaatataaaactaatgccgtttttagttccaaaataattctttaaacttccaacttttctatgatatcaaaactttcctacatacacaaactttcaactttttcgttacatcgtttcaatttcaaccaaacttttaattttggtgtgaactaaacacagcctaaaaatactaatatatttttcaaaaaaaaagtataatccaatctgatcaaacctcctaacagaaaaacgataaaaaggaaaagattatcttttaccatcgcgtgaaaggaaaacgagaaacaggaaaacaattttttttgcgcggctctatttttctttttgtcgttttctgttcgctaggttcgatgctagcgcgcgttcgcgcattagacccaccaaggtggaccatgtctggacaattaaaaattctaatattttagtggtgatttacttaaaagtaatggactaaaagctataattttctctagctacatcctattcctttccttacctccaactaattgtattagtctcttacggtaacgaatgccaaggttaaccttcgcattaatattattcatcatcatcggttaaacaaccaattttcctgatacaacttctccctttacgtgagatcgatatgatataattatgtgtgtaatttttacctagaaatattaatgtaataactcagcatggcttttcttttgccttctgcataatcactcgttatgtggcttcacataggataaccaaccgctccataggtctcataagtcataagattagctcactgaacacaatgggaagttttctaaaaaataaaaggtttctcaaattatagcaaaactttctcatgctcaatatttcgtattggaagtttttccgttgaagttttatttatagttaaagtttgtatccatgttcaaaaatttcttatatgaagtttttctatttccaaatgaaattttttaatcataaaaatactaacgaatatttcaatagaaaaaactagatactatgcatagcgataaaaattgtgtgtgcttacctttttcgtttccattgatatctagagggaggacatgcacatgtaacttgcttgctaggagacatatgactagttacgtatacccatgtaaatattcatgcactagcatcttttgatgatcatttataatatgtctcgtagatctgagtgcttatttgattcatatggtttctaaatcataggaacacgaaaagtaagaattaggattagggtgttacgtactctaatccttaggaattttttcaagagctctcatctcatgtcaaaaatcaaatggtactagattgtaagaatataatctttaagaattagatgtgatctatttctataaaacaaatgatgcatgtaaaaaaatttgaaaggccttatcttttcgcttatgctaatacttatcaaccaaaatataaattcgtaactttaaatttggagctaattttaaggtttttttcattaaacaaaaaacaaagtaattataatcagcctttgagccttctcccgtgagtggcatttggctgctcctattggatcgagtgataagcaaggcaaagcatccccaagaacgaaaccgccgtggaactttccggaacagcccggacatgtgccccactgccccctccctcctcacctcctccccctcttcttcttcttcttcttcttctttcactgcggcgccctcctcttctcagttctcacttctcacacaactcgcaaccctaataaagcgcaaaaaaggaaaaagaaaaatcgccacggaaaaatcctcgctgccccccatcgggcaggagcaaccgccgcatcggcccccgatccggtcgccgccgcctctcgcccggttcatccgccgcttgccaacccctccgctcccagcaaccctagtcccccaccccaacgccgccgccagctcagctcgcctcgcgcggggcgcagccgactctctacttgtggcctcggcggctcgggccctctccggattccacgtatggctcgatcttctgcttttctttttcttctttttttttttttaattattcgggaattgaagcctcatcctattgggggcatacgcgacttggcggagaggacaatggcgacgcatttcagagctaaggggggaagggatatgattttgaggctgtaattgcttgcgaagttctccttttggaagggatcggtcctagccattctgagctgctaaaaattttatttgcggtacggagcgtcttctgataagaggacagaacgattagggtctcccgtaatctgcttttaaatgcttgatggagtcctagaacctaaaattatggaattttctctaatgttaagctaggaatgagggtactggtttcttcgtagatggaaggcgctctacttgttgctgccggaactctgttgagatcttgtgcttaaatgcaggggtttaactggctgtgtaatcttaggcgtggagtgagttgactatgaagaattctgaacatgtctaggaatcataatttcgaattttgtagcttgtggtttatgcagcatctgatactattcagttcctcgttctgtaggatgtctgaagatgcgtctgtcggggccagcagttcaacagtaaaagctggcgatgatccagaggctaccattgagatcaacatcaaaaccctggattcacaagttcataagctccgtgttaagaagaatgtatgcttcgccccaccttgacagtttgctattatgtctctgtgtgtctgttgagtgttgcttgcttgaagagatactagaaatgctatagaatgtcagttccttatagttagaacgacaagatgaattctcccatgtacttgttttgagacaatctaatcactgaaaaatttttaggtacctgttctggtccttaaagagaagatagtagaggcaaccggggttcctgtggaccaacagcggttgatttttagaggaagagtcttaaaggacgatcacctgctatcagaatatcgtatcctttttgttcatgcttcttcttttgaatgcttgaagacaatcaaaccatctagagactcacctcgcttgttgctgttgagaacttgagctatatacactatttacctgcattttgtttcccatctttagttgcttagttataaataggccgggaagatacacaactcttttgggccagtaagggtgatttcgttactgctagaagagtagagtgcctgatgcttttgttgggattagggctgcttgctttggtagtgatttcataatggccttccaatgagacaaaataaagtagtaaaatgtcaaattgaagtatctaagcattaattctttgcaaatatgggcaagaacctcaatcattgtagaccttgatgatatttgttaagttgaggtggttgaacaccagtatttaactgcatcgttggtggtaatgaggggttccttggatcaacgattttcatcaccacatgatgtaatttatcattttcggttttcttgtgatatttcgtttgtaaacacgacagttgtgatagttatatctttgacaacctcaagatttggaagatgggtacacattgcatttggttgctcggcgtgcagctgctgaaggccaacattcttctggtacttctgatgaaaacacccatgctaatggtaagttaagttgggggttgctttgaagagtatactatcaatatagaacgcacctgatatgcctatgacctattagtcctcagagccatgtgctgcacaagttttcgtagtatcgtaaacaatttatgtgcgttttcactcttcaataccatgtttccatgtgtctgttctatatattaattgtgtcaagctcatactggataaaatattattgccctttgaagggcagaaaaatagttattgctagttattgtaaaaaatagctaggtaagcatttcaggctaagtagatgaaggcttgaacagtccttcgctttatttttcatttaatttgtgaactaaaaacaccattatttaactgtatttatgtaagcattactgtgtttctagttattacaatatatagatagagcataacaaatcaacttgggttatattgactggcactaccttttgtggtaccagagtgtatttcctctgtacctgattttaggtatattacagcaatatgctgggtatgggtctgataatctttttacgtgcagttaatgttgctggaaatggactgttaggagatatctccagggtatgcttctaacatcgctttgtctcgtatacttaaaatttccaatctgcttaactcttagcaacaactacaggttaactttaattttctttgaattctttttcattaactctcttctaggaaattatagaggctatgcattctgaggggatgatagatgacctggctagggtatatgctttgttctagtgttatatgtacctgtctaaatggggaccagaacctttatatgtttattgatgtgatttcctcccacctgttatctgcagagtgttcgggatatccttggctccctaggtcttgcgacgcctggtggcatgacaaacactacattttcggtaataaggtgttacttctttaggtctagtaacctg

SEQ ID NO: 46955 - DNA, 5194 bp, Oryza sativa
acaaccagggttttcaattctgaatcatcaaatccaagtatcacaactacaaccagcaggctctattcctcgcaacatggttagtaaactgtacttttttcattggtgttttcccatgtataatcatcattataacttttagcaccattgacaggttattcctgattctctcacaactcttttggagtatatcaaccgcatggatcaagtactacagaataacggtatcgtttgttgcaatttgttagtttgatgtgtgtcataaaatactgtcatgttcatctttatgttgcaaattcaggcacaccatctgttgatacaaatacccagcagccaccaagatcggatgatgcttatctaaatcaaagatttccaagtcctgaggttctggtgtcagtcattgaaagagcccaacaacttcttggtggcagtgctgcttctgctctttcagtatgttatcctctctggtacttatattaagttctttttagcttcagtggttcagcctttatagtgatatcttgtcgacgtatagtttatccttctttgtaagtactatattttgtaatgattttgccttctttctaatcagcaaaataattctctttgaacatcaatatgttgccaatgtactacttttcagttctcttatttgagacaaaactatggagatttaaaccaaaataaatccattgtcccattccgtgaccataatcctgctcacagttatctctaatggaccatatacatttaatggctgatactacttgttacaatatagatgattaggctttataacaactactaggaggaacttttagccacttcgtggtacaaaaataacactctagtgttgtgttttgaatataatttttgttttgccttgggtactaggtctgccttagtgccgtgtaacactgctctatattatccctgaatattatatgaggattcaaatggtatttgtaaacgttttgtaccaccactctgcattatccctgaatattatatgagaattcaaatggtatttataaacaccagatgttatttgtttgagagactgatgatctgtttttcattcttttctgcactatccctgctaacattttcctttgggtgccgtacacttgatctgtttttcattcttctctagcattgattgacatgtgaaaggtctaagtggacctctcaaaggtatcaatgggacattagtcttcctagttcggttcttttctctttttttattatgatacccacatttcatacttctcaacgcttattgattcaaaggggtcatatgtacgcagcttcaagactgagtacagtgaaatagcttacctttgaattcacagacgcatgcttctatttggaattttgatgaccttctgtttacctgatatttgtttcagcatctcgcacaacgaatccagagagattctggcaccagtgatgcatctatacgtagccagatccagaatgaatcagctcagctgggagtagcaatgcagcatttgggtgcaatgtttttggagcttggtcgaacaatgatgatgcttcggatggggccatcccctgtatgcttaatttaaattctctattatagtatttaactgatttctgcatgtgttaatttcataacgcttcttattttggtaggctgatgcttttgtcaatgctggatcttctgtttatataaactctgcaggaccgaatccaatcatggttcaggtgacatacattgagatgctttctcatgttgactttaattgttgtgccactttaatgacaacacacattctattgctctgcagccatcttttcaaaatactcctccttttggagtttcgagcataccagtcctcggtggaatttctggtgcctttggtattgttgatccttctcgtacatctgctgtcaatacccatggtaagatcacatttcaagttctcttcagtggctctgttgagtgtactcagctgagtcatgaagctaccatttcaaatccttaatctctactgagaagttcaaatggttatggttatggcctatgattacaaactattacactaataggttagtaggtaaattatctgttagttatttcccttttttttttcttgaacacgagggagttcttccctatattacctgcttcgtcctgatttacctctaaccagaactgaaagatcataacagttttcatatatttatgggatttttcacagggtttatttacacctggatacaatattggtggcctttaattacgattcttttttcaccatctttgtgttagttttcccacatattaccccctcctcctgatttacccctaaccagaccggaagatcataatagctgtaatatatttatgggattttccacagggtttatttacacctggatactgtcatcttggtggcctttgattacaattcttttgtcacactcttgtctgtcctgagcttccactcagacttgatatgatcctttactaggtacttctacaacaagtgggtcatctgctggtatgaccactgcttctgcaggcgctgtcaatgaaggtcgtcaaaatgtggaaagaactcaaggaggtaacccatctgctacctcaatgcatggattgccagcaaggacagttattgcggctattcctgcacggtccacggctgaggctccaaaccatgtcctgagtgttatcctgcctgttcaagtgaggagtcaagtagcaatgcctaatcaatcaacagtttctcaaggttctcagactgcagtgggcggtggatctcaaccacaagcctctgtaggtggtgttgctagcattccttctatagtggcacaggtaactgcacaagtagccaatgcattgagtgcaaatcaacaaggccaggtttcatcatctgcgcagaacacagtagatcagggatctcgctcggtcacaactaatggagttgacaatgtggattctctggtatcagcaagtacgcaactgcaaaatgagctgtcagattctaacaatggacgcacttcactaaatgcacaatctcttgtagctggagcaggtgcctttacattctttttaatgtatcgaacattttctctaatggaaaatgtactgaattgttcaccattcctgtttgttttaatttctctaatcaggtatttctccttcaaacacatctgatcccaatttagcatcggaagacagcagcactgaaaatgctcccaacatcggcagtattcaacaacatccagagatggaagggatccatgcagataatgtcagaaaaccttctgaggaatcaacaacagccaacttagtggggcagatcacaaccacctgtacagatgatatttctgtgaacagatcagcagaaaattcttcacagaagaacattccattggatggagtatctgcacagtccattaagccatctgcaagtagtaggtctgaaccagtaggtcttggtggaggtttgcagcctaaggtattagttaattattttagtgtttactttttagtaataatgtttcctgtaatttgattgtttagcctgcattttgttatccatatcttagcggggttagaatttgccatggttggcagcagtttagttgattggtttaatcacttcaccatttggtctgaatgaaaatggcagacattttactgttgagaaaacgtagtatgccattcatacatgattatttgtcccaaatatgatatgatccccccttctgaaactgctttgatgcagaggcggagcagaacagcaaagccacctgggagtagcagtgatactggcgaagtcgtcaattcctctcgcatcagcaatagccaaaatgctgtttcaatgggccagcaggttctgcaagcccttgcttctcaaaatactaatgtaaacagaagccatgttacggattctccacttccatccactacttctcagttttctggtggaatgcctccgagaagacagggtggtgaaggacaagttgattttggcagtatgatatccagtgtgctaaacaacccagcttttggcaatctgttgtccaatgtagcagagcaaacaggcatgggttccgcaggtgatttgagaaacatggtggaagagtgtgcacagagccctgcaataatggatactatgagtaatttagtccaaaatgtggatgggtcaggaagaggtcaaggtggcattgacttgtctagaatgatgcagcaaatgatgcctgttgtatcccaagttcttggtggagctggggctcgtcctgctggtacaaatagtggacaatccagattgcagcctcggcgcagtgacatgagagtggatgatgcttcagattatggaaattctcaggtaagtcatccagctgaataggttggaactgcctgtatttgcatttgttcttcttagtattatggcttgtgcttatatggtttatttgtgaagaaaaaaattgtgatgattactaatacaccatatctggacaaatgttcattctaaagggttgagaatgtcatatgcaagactgacaaatggaaaacaatatcttttttttttaactttttgataattcataaactaccatcctgctttttcatgcacagattgatctacaccaagctcgtgaacacattgagcaacatgactcccccagggatatcttcggtgcggtcctcgaaactgctgcacaggcttatggtgaagatgagagtattgaggacatgcttgaagagcttgtcagtgacccagaacttacagatgtatgtttccaaaatccccccatccaaatttagaataagctctaatgattttcataggatgccatatagttgataccgtagggtgagattgtttagaaacatacattaggagattatgttatactaatatgtatacatatataaaaaggcaagagatcattttgtggtaaaataagtggtatatgcttcttatatgatcttttgtcaaaataaataaaaaatctgataggattttgcagtaccttgtttgcctttttttttcttttaaaaaaactttgtttgccttctgattaaccctaaactgctgcaaatatatgctaggactacctgaaacttctgctccaacaagttcgccagaggatacagtcggcatctcaatccgggaaccagtcttgagcaatcatggcaaagaaggtgatccagata

SEQ ID NO: 46956 - DNA, 931 bp, Oryza sativa
acagcgagcaaaaggcctggttacgggagtatagtgagtttcgtgatgggcaaagagtacgatcgccaacaaacagcccagctctgtaacgatcgtagcccgtaacgtttacaccgcgtgtcaacaaacccatgttgcctcatgggccaacgcggatgcttagctactttagaactgtaaactgttggggatgcattggagtgggcaccaggtgttgtagagcaagtttaagggcatatgttcaggggagcttttagctgctgcagtttcttccagaattagaagctcctccaaacagttcagcttttggtccagattctgagaagttgtagaatccagaaaatgaactagaagccaaaagctaggaaaccaagcttttccaaattctcagaagctggctactaatcaactgcttcttataattttaagcttgagaatacgactaaggcaaagagccaggatcacttggttaaagcatggagacgttaactctaaattcttccaaatcaaagcaaatggtagaaagagaaaaaatcacatacagatccttcaaactccagatggctttgctgtaactaaagatcaaaaggaggaagaattgaagcgttacttcacacaaaaattaggagcctttgctctcagaaatcagagattaaacttggctgctctcaatctccctacgcttgatctctcagatctcgatgataacttcactgaagaagaactcaaaaatacaatctctgacttgcctttggaaaaatctcctggaccagatggatttattggagcctttttcaaacaagcatgggacataataaaaacagatctcattcaagctatttccttctttggagatatgggatgtgcaagactgcaagaactcaattcggcacatatctgcctcatccctaaaaaggcggatgcaacaaaa

SEQ ID NO: 46957 - DNA, 9278 bp, Oryza sativa
ctttggctttggacataaatggtgcaactggatttccaacctactgggtactttctcttctgcggttcttcttaatggtatcccaggtcaggaaatagaccatgctagaggtcttcagcagggcgatcccctttcccccatgcttttcatccttgcaatggaaccccggcacaaattattcaagaaagcagaggatcttggccttctctctagtctgcaaagacagcggcgcttcagatgttctctctacgcagatgatgttggtctttttataaagcccattcgagaagaaatgctagtccttcgtggaattctttctgtctttgcagatgccagtggacttcacacaaacatggaaaaaacagagatcttcccgataagctgtaacggagtcaacctagatgactgcctttccatcttcccaggtagaatttcaaacttcccatgtaaatacttgggcctgcctttgcacacaagaaaattggggaaattagagcttcaacctctggtggacaaagtgggatcgagaattcctggttggaaaggtcgcttcttcacttcggcaggtagagaaacactctttcctctaccccaatttatcacctaacaattctccagcaaaataaatggctttacaaaaggatcgatcgccttaggcgagctttcctttggaaaggcggcgatcctgaaaacgttagcgggggcagttgtcttttgaattggacagccgtctgcaagcccaaacctttgggcgggcttggaattctcaatttagagaaattcgctcgggctttaagacttcgatggctctggtacgaatggaaagaggaaaataaaccctggatcaatatggaaattccatgtgatgagatggacagaaatctcttcagagcaagtacacaaatttccctaggaaacggaaagaaatgcaagttttggtcagacaattggctgcaaggatacgctcctaaagacatagcgccgacattattcaaattagcaaagaggaaaacaaactgcgtagcctttgagctgcacaacaatcactggatcacttccttaagaacaatcacttcaataaatgagatcaatgagctggtgcacctaggcagtaagctgcatgagatcagattacaccccaattctttggatagtatcacgtggaagtggactaatcatggtgaatactctgcaaaaagcgcttatgaaatgcagtttgtaggatcagttgccaacacaaattttatgccactttggaaagctgaagcggaacctaagcatcggttctttggctggttaattttacatcaaagaactctcacagctgaaaacctccttttaagacattggccatgcgattggatttgcagcttatgtacagatgcttttgaggacgcaaaccatttggcaaaggagtgcagtttcactaacacggtttggtcccaagtttgtagctggctggacatcatgcagaccccaaatcaactacaggatgcaaacattttagaatggtggacctcaatcatacattcaacttatggaaggagaagaagaaaactgataggggcactttttataacttggtggcaggtgtggcttgagcgcaatcgaagaattttccatcaaaagcaactaagtgccacccaagtagctttcttagtaaaggaaaatatagatgccattcagattttgcgccatacataaaggcttgtgcttagctctagttgatagcatcatgtatgtaaatctctgaaaatgtcacctagtggtctgctctttcttgacctctctaactgcttctccttctaatatatccggcagagctcctgccgtcttttgcttcaaaaaaaaataattttaaactcccccaacgggccctaaggctgtgttcttacctcaggtttcctagctcatctccctctttttcgcacgcacgctttttaaactgctaaacggtgcgtatttttttacaaagtttctatacgaaagttgcttaaaaaatcatattgatccatttttgaaaaaaaaaaattagctaatacttaattaatcacgcgctaatggactgttacgttttccgtgtgcactgttctagttgggaactccctccagcgaacacagcctaatggtatagccaactattatctccaaatcatctatagtcaatttaatagccaattcatataatagttacctataaacatatattacactattaatatttagttcatctgtcatacacaaattgtatcttggagtccgtgttgtccgctactcttctctttcctctgtatccccgctactcttctctctcatccgttatacctgctcttatatccatttgcaaacctttgtggacagcagcaagagcacctaatttggaatcctgtgttcgcacaaaacaccggattccgatgtactccacagttgtatactccctccttcccaaattgatcatcatgtaataaaatccaaaatttctcaaattgatcatcatataactgcatgatatggatttcatcagaatacaattaatgcagtatgggagaatgtgtgcatgctatggtgtaattggcatggggttttaatggatgcatacattgtgggagaatatgtgcatggtgtcttgtttgatgtgatttaaattatccttagtcttggtgcataaacttagggcaagtgctatgctagaggtgcctaccacctctaattttatatattttattcactcataaactaagagtcaacccatacaatgtatcacctctagtacacaaataccaatatctctaatactctcacatcctttttaaaatttgtgtggaggttgtatcttgatttaggggtggctcattatctctcttctcacttctctcctccacctcatcactcaattaatatggcactcttagggacaacatatggggtattatagtacttgcccttatatgatgatcaatttgagaagaagggagtaacctagaattggacaagatacattctaatactacaaatataaacattactgttagatttgtaatagtataatgtgtcttcttcggtactaaattattatattttaggatggagattattatattttagagccgagaaagtatcagtcaataaatcaccgtcagagcacaggctgataggtccccgtttccccaataataacacgaagctagccgtacagtactagtgtcaagtgtgattgtgtgtgaagggttagcgagggaagaagagaagaggcgccgccgcaggaccggtgctgcatttgcatcgatcgcataggcatgaagtcatgcaagcgtacacctacgcggtcaagtgaccagctgctgctgctgtgcacacgcagccgcagtggttcgccatgaatgtgtctgcagcatcatcactcatcagcgagcaggaatcgagcaaccgaatgtgccgtctcctttgcgcgtggaaccaatcccggaagatatgccatgccaggccgttttcatcccatctcattcatcggaccctgacctactgacctcatcccaaattattatcaaactgtttctgttcgcgtacgtaggcccctggttcatatggtatacctgtctttaattttttttaaagaattacgcagtatactcacaacacacgcatactcacccctatgaacgcacgtgcgcaaaccctcataatgcacgcacactcaccactgtgagcatcttcgaagatcgggccaacaaatcataaagattgacgaagtcaccgtaggcgcctcgctgtcgacggatacgtcgcctaccactgaaagcacgagaccgttaaatcctagaaaatttgctcccatgaggagtcaccctccgtcacaaaataagtttatctttcaccacacatatcactacaacataaaaaaaagatcacaatatagtcactttcttaaatcctgatttaattatttctctctttatctattcctgatgtatttattttctactttcataagctccaataaaattattatttagaaataaacttgttttaaaacaatctaacggagtaaaaaagtcattttgaaacgaatggagtacatgcttgccaacactaaagcctagctactctgtgagacactgacggtgatgcactattgggtactgtacactgccgcgtgccatgctgcagcgtgcaaaacagctactgtagccggcatgctaatgtcgtagtaccacgctacaaacggaattgctgctcatgtctctagtcacaccatgacaccacgtagggtacttgacacttgctctagtactagtagtactgtagtaggaagtaactgaggcctgtttagttcacacacaaaaattatatcgaacgtttaaacacctgcatgaagtattaaatataggttaataaaataattaattacacagattgcgactaatttacgagacgaatcttttaagcctaattgctacatgatttaacaatgcggtgatacagtaaacattagctaatgatggattaattaggcttaataaattcatctcgcggtttactgacgaattctgtaattagttttcttttattagtatccgaacaccatatacgataccctatatgacacgtcaaaactttacagccccttaaactgaacacccctgagtcgtcactgttgagcctgtgatctgcacgtacccctagcagccaggctgccaagcccaagaccagcattagcgcagctagccactgtagctggtttggccagcatgtccccttcccctccgagtcaaaaaggtcgtcgccgatcgagacgcgacgcgacggccgatcgacccacgtgaccgatcgaccgcgactccgccgtatgatgtcccgtcctggcgagcccggcgcccacccgcacgcgcatttgccaatttgcttgctgccgccaccgcgcgtcgctactcgctgcagcctcgcctcgcagtcgcagcgagcgccgaggggtcgtggcgcggtggccgcgccgcgccgcgtgtggcaacggggccgtggcttgtccggggaaaagaggcaaagagcggccggccgacgccgaaaaggaggtgggaaaaagcgtgtgcgtgcgtgactagctgctatagtgtgcggtgcccggtgacgcgaacagtaaccgaaaccacggccggcagcgcgggccgatccaacaaacaatgaggctgctgctgttacgctgacccaccgccggtttgactcacctgcacccagcaactgcaccgagttactactcctactgaccactgagttcctgacacgcatggatgaatgccagcccgtgactctacaggaccaccccaagccaagccaagccgttgacatatttcacttatgtttacgcgacagacggcgttcgcattggttcctgaccaaaccaaacgagcagctgccagctgacattgaccgctactgaatgcaacgttacgttgcagtttctcagcatcccaggctaacctgaccacctcgctatacatgcatcacccaatcctgcccctcacaaaactggcatattagtattagtaaaacaaaatcaaacactattcatcgatcgtctactaattgatggcagttcctgtgacctgcttgtcctccaaacaaacagtgctcacttaagtactcactttgtcacaaataagttcatttttaagccatcctacatataccaatacaaaatgagaaagaatagaataatctcactttatcaaattgtaatacaactattccctgcattatctactccgatattctctactttgacaaactttgatacaatgattacttaaaattttggacaaacgggagcagaaaaaaataaactcacactgactttctcgagctcacactgaatgtcacagactcacagtcccatctgtcctctgatgtccttgtctcttgcggtgtttcagtcagttgaaccccatggctgcacctgcatttctttcagtggtgtcgtcctacctgcctggactgacttgaatgcctcgcccaacaacatctaatgattctaatctcaacaatatctaatgattctaatctaatcccatgactttgctgcctctctgattgtcaggacaggagcagtgtgtacaaatgtggagtttataaacatcttggtttgaattctccgcagttctgcatgagacgacgctggaacagacaaattccagctgaaaaagcgcattgccatcgccgtgcgccgtgtttttatccgtggtttttttgctcccacttctcaaatctgactttgccttttgtaaaagtagtacttatatatgagtctagtcagagttctgaagatgtgttcttggaaaagaattctgacgatggccacatcaaaaggatttctgaagatgctcttgcaaatatggatttctaaagaagctcttgcatatatcttcagtggtcaaggctaaaatgttatcatactggtcaactcagtgttttgctcgctggcaattctgtttaaactaaagcattcaaatgtgagcatatttttttgtataaacaacattcagacacctgattaatgtgatttacttccgaagaatggaacttgtgagagttgtaaaacacgttatcaaggtgagaaacgaaatgtttgttcagttcttttactactccaggtttccttgtctgacttcgcagcattttattatattctgtacgaatttcaggtggtagcatctgcagttttcgcaattctgtagtccaacattcataccaaaacttgtaatttttgcagtaattcagtgaagtcctcgtctgaaaacattcagcatcaatcatgtgaaaacgcatttgttgtacgcggcgtcggtaatccgagtgcaaaattcttatatctttgtgcatgaagttaatacaaacgacaaagccaacaaggaaaactcgactacatgttacgcttaatctcttcatcagtgagatcttaaaatataatgacatgacctaattttaactctgaatcgagcagttcatacagcaaaagtcgcaattaagcttacaaaggagcagcgattggcattgttttatcgatccaaatcacgcaacaggctgatctgatgttgctacttctgtcctcttttgctacttacgctgcatcttctttgttcggtgtacacttgattctatgtttccatctgaccaagaacaatggatatgaatgaaggtttcaacctattttactttgatcaagagttgtcattgtctggtttggccctggaagaatatttctgatgaagtttgttcaaggatcagatgacgatacgcgtcacaacgtcggcattacctgcttgtttcgatcatagtttacagcgttttttgcttgtgaactctgaattttcagatattgccagcctaatgtcattgttcagcatcctcttgttgatcggcaagacctccttgtcggatcttgaatctaggcaagtgtcaattcggcaaacatgtaaacttcagaatgaggtgacagatcaatcatcaagaccagctatggcaataattccgactactttctaaatgactgtcaatgtgcgtgattattcagagaaaagcacaaactaattcctccggtaattttctccttttttgtcacctcaatacaacaaaccttgtccccaaaagatagaaaagagtaaatcttgttgatttgttatagtcaattttctgttactagctacttaaagcatgatattcctgagggccttttttttggttcaaactggcatattgttctaagaatctttacatgtaccaaactaagtatgctgttaattctttacccagcaaagtgccagtgtgcagtcactgtttgtgtcgccaaagtgtgggcacttgcccatgcttttttgctctcatggccgaacagtaaccatttgatagagacataaacacatctcaatttcccatgtatatatatacatagcccacacactgcttgctggcttatcacaaaagcaagatttcagagaaaaaggggaagccgggcacatcccacatgccacataatgccatgttgaaacaattgctggcttgttattttgctagatatcaaacattccctgttttaataaatattaagatatttattacagattatttacaaagattgaatttcgttgcattccagcatgtcagctcatccaatgttgggcccctttctttttggttgatggggccaggattatttgcgaattattcgtaccatgcttttaatagtatgatttctctagaaactttctgcatcaaagttacttaaatcacttgttttaagttatttgttatgttcataatgtataatgtatagcgtttaattcttctctataaacagatcgatgtgcatcaacctttctccgcattacatatatgttctacatatatagtaaaatttgatgatttaatactctattcattgtcactttgattgtattgaattgtgacaatgctatgtgggacatctgagtacatgacactgggtcaggatgtcaaataatcgaagcggaatttatgaagtgtaaaaaaaaaatcaaatctctccattacatataccatgaaatttaatctcaccatttttcacaccaaccatcattaattactactacaaatttatcctagtatctgaattttaacggcccaatcttttgcagttaacccatcgctgtcaatgccgctgttgaatccatgcaagaacagcaggaatgatccaagctgggtagctcccacgcaaagtacggactagctaagctaaggtaagttagctagctaccttaccagctagcatcaaatcaaccaggaaaacaaaagaaattcagagctaaccagctgctaaaactctcggcaaccatgttccatgcaggaccagatatataaagatcaatcgcatcgaggcaacagtggataaatctccctgaaatcttcagctgaaaaggtttgggtaaagtttgtggcgtggtgttttggttgctgttgacgcatcacatcgaggtatctatagctctgatcagcagcagtgtagtagtacagtgaatgaaaaccacctgaacggatgaaccgtgagtggctaatcatgtcaagctggctagctagcctgggctgcctttctgcctgataggtagccgtagtagttaggatcaattagccggttggtgacacaggctcaagctagcgcagcaaaggatgcggccgtgcacatgatggatggaccggttggataacacaaatttttgacaatttgaccctttgcaaaactaattttacaaatg

SEQ ID NO: 46958 - DNA, 14250 bp, Oryza sativa
attgaaattggaacgatgtgatggaaaagttggaaatttatatgtgtaggaaagttttgatgtaatagaaaaattaaaagtttgaagaaaaagttagaaactgaaccaggcttaaaagtgcatatgtacgcaccaaaaccgagccagccgtccaagccttattacagtcgtaacaggtcaaattgtttttaaagtcgtaccccctctcctaaaaacccaaaggaaaaacgtttgaattatacccttagtctactgagtaagtacgaattataccctatacctaaaaatcagacatatttcattcttaattattacttaacaccagacaaattaccttctaatttaaataggagtggttttaattctacgtgacagtgtagtaaaaaaatataaaaacttagtactcgatcttgtctagattctaacatctaaacaaagaaatatttttgtgtacactgttaatgaaatatctgacatttggaatgtaatccctccgttcaaaaataagtgcagtcatctcgttcaaatttaaactagaggactatatttattttgggacgaagagagtataaacttttgcatgaaaatcaaataaaactccttgctcggtagcttattttcaccttattcatgggatccttaccgctgataatttgctcaaagcttttaacaatatgtttccttaaaaaatcattcttttactgaatagttagattacttgttctaaactagtagcatttgttttgttttcttctaaaaaattaatttatccctcataaacaccttttttttacctactagtattttattttgccaatactcctgtagcctaataaccatatacagctttcccggccagacaaccagtcaaccactacccatctggtctgcttatttgctgctgtacgtgtcaaatttccattttgatcaattgcacaaaaagggttagacatgaaaatgattagtagaaaataggtgcacccaagatgattaattgctgctgtctgtgtgccttcaaacccaattttgttctcacattaactcaaattccttgttcccgcattaactccaattgatgtctgaaaggcagacgtagacaaccaaacacgccgagctccctctcacgcgagccaccacaaatataagatccgctagatcctatagagatagaaaaaatcaaaaagaaaacaaaatcatgtgccatattcttatagtttataaaaatgtgtcattttatgttggtctacaaaatgtaattctgactataatttttattgcagaaatatagggaaaacctgataattatgaaattatttttggaggaaaagctatgtatattatcatacaactaatcaaaatattgaaaaataaatcagttttttaaagtttagcttgaaactaaccaagtctataagtatatatttttcatgactggtgggagtagtacttctattgctcgagtgtagggtggcaacggggcgaggcggggccaggttgggttggaacgcccctgcccccgcccccgtccccggccctagaaaggaagttgggtgacaaacatcacccgtccctacccccacatgggacccgacgggtgaccggggccccacatcacccgatggagttaatactccataaatatattgaaatacactgaataatagtatgctaaaatttcaatagcctcgggcggtgtgggttgattgaagaaaggaaaaggattacggttgaggggaactagggtgttgagcttttatatgccaattttgaatgggattgttggatctatattattgcaatgggcaacttttagagaagtaactcacatctggggctcctcagggtcacccacaggttaatttcgatccccgcccccatctctggaattttgcggggccctgtccccactcacccgcgggtgagaactctctccgcccccaccctcgtagacgggggcggatccagaaccagattgaaggggggactcatctccttctcctttcttcagtccctcattttctttattttctccctcttcttcccctttcatctctcattctatcaatggtgatccagcggggtggggggactcaagtccccctagcacccatgttggatccgcccctacccatagcggcgggtcccggcgctaatggggaaattgctacccctacacgagtgagcaatggaaacttgtttggacttgtaatataaatctgtactacaattaaaagacactagtattggtggctcaccaccatcatatataatcactgccatgtaggccatgaaacaagtactttcttttactctatacgctgtagttctttaacttttctaaggatggcatttttctttttctatttttaaggtgaaaaatcctgcttcaatcaatattttttcaacaaggactattttttctttcaagttttaataattcgttgtaacgcgtggatatttggctagtaatataaacttatttaggtaatgataacaatgatatcgacattaggggatttgcttaccacagctctagagacaactactgaagattccctaagtgcacgcatgcatatatatatatatatatatatatatatatatatataaaagttgcttcatcaggcatatagattgtgtaagacaagatctatcctcgatcacgttgagtcattttcctcacatatatcaaacttattttaaacggttgtttcgcgttcgcgaaaatatttttaaacagctgtttcaccatgcgtatgtgcatacattactattacatctttcttcaattcttctcattgtcataaccatttttcttccatccggcttgtcgatattccaccctgctgtactttcaatgactcccccttttagtatcacctttaacttattggtgagataaaatgaaagttgcatctatcttgagaaagagattgtctagctttaaggttgatgaattaatctttaaaaatttcaaacactccactcatcccttaaataaaaacacaactactttttccctaaaaaaactactgtcgagtttagttccaaactttttcttcaaacttataacttttccatcacagcaaaactttcccacacacacaaacttttaacttttccgtcacatcgttacaatttcaaccaaactttcaattttagcatgaacacaccctacttccgtcgcacccttactctatttaaacgcaatccattttttcttatatggaaagttgaataagaataaatttaatgcacaactgaaagttgaaatataaagtatacaacttacattaaaaaaataagtaaaactacataaattaacaaaaggcagtaaaataaactaaatttccgcacataacaacgtaatcttaagacttaataatggtgtaatttcaggtgattgaagaaaacaaaaaaagggcagttgaaatgtagcaaataccctccagagatatacaaaagctgcgaaatccatgtgaaaatcattttaagtccactcttacattgtgggacagagtacactattccctcatcacaaccttccggatgctcatcttgaatttaaattaaatctacccaaagtaacgaacctggacaaagatcacatcttgtcgaattcactacagtgaacttactacatcgtggggcatagagagtacagcatcttgacaatcacatatgtagctgcatcaggcggccagatgatgagcccccacatcctttttgctgctaagtagggtgatcagtacaaaaccaccatggcccccatctagcgtccaaatcattccagccagtttataccaacaaagttaagcctctgtttggtacagctttggattcaatatttcttaaagctatgtatgcctagcttcacaaatctataaatctgaatatacgattgcattgataacatttggatgaatcatttttttcctattttaaataaaatataaaactttaaaccactaaaatttaaaatacaaacttcaaatccatggttaataagtttctcccaaaatccaaagctccccaaacagttcatttttttatttagattatgtgaagatatagctaacaaatacaaaagatgaacggaaaatcagaagtttgatttattttttttcatttttttctatatttttaaaaactggctaagtggttatcaaccagatgcttcttaaaatctcaaaatatctccaaacatgcccataagatagccatagcagattcgtttcgttctaaaaaactgtgaagatgtagctaccaaatacaaaagatgaacgaaaagttagaagttgtatttattttaatcttttctagatttttaaaaaattggctatcaacaggcttgttagaatcttaaaaatcttcaaacatgcccataagatagccatggcggattcgtttcgttctcaacctatcacccataaaagggacaccaaccactctctttcccacgaactcctctctccctccctcagtccttcctcctctcgtctactcactcccctcaactgccaattcccctctctctcctctgcttcttcttcttcttgagctgatccattccatttcccgagctgctcaccaactccttctagaggccgacgcggccggcgccattgattgcccatgcactgacacgaccacagatgcctccttaactcctccactcccccacgtactgcgcgggaaccgatgcgcccatgcactccacgtagctagctaagacgcgccggagtggtggcgccggcgatgatggcgcggcggcgattcttcccggcgtgggtggtggtagtaatggtggtggtggtggttcttggttcttgctcggcggcggcggcggcgggggatggtgatgcgctgatggatgtgaagaatgcgttcgtggaggatcccggcggcgttctggcgggatggggcggcggtggcggaaactcgtcggcgttctgttcttgggcgggggtggagtgcgacgcggcgggggcgagggtgaccgggctgaacctgtccggcgccgggctggccggggaggtccccggcgcggcgctggcgcggctggaccggctggaggtggtcgacctgtcttcgaacaggctcgccggcccggtgccggcggcgctcggggcgctcgggaggctcacggcgctgctgctctactccaaccgcctcgccggcgagctcccgccgtcgctgggcgcgctcgccgcgctccgggtgctccgcgtcggcgacaacccggcgctgtcgggccccatccccgccgcgctcggcgtgctcgccaacctcaccgtgctcgccgccgcgtcgtgcaacctcaccggcgccatcccgaggagcctcgggaggctcgcggcgctcacggcgctgaacctgcaggagaactccctgtccgggccgataccgccggagctcggcggcatcgccgggctcgaggtgctctcgctcgccgacaaccagctcaccggcgtgatcccgccggagctcgggaggctcgccgcgctccagaagctgaacctggcgaacaacacgctggagggcgccgtgccgccggagctcgggaagctcggcgagctcgcgtacctcaacctcatgaacaaccgcctctccgggcgagtcccgcgcgagctcgccgcgctctcccgcgcgcgcaccatcgacctgtccggcaacctgctcaccggcgaactccccgccgaggtcggccagctgccggagctcagcttcctcgcgctctccggcaaccaccttaccggccgcatccctggcgacctgtgcggcggcggcggcggtggagcagagtccacgagcctcgagcacctaatgctctcgacgaacaacttctccggcgagataccgggggggctctcgcggtgccgggcgctgacgcagctcgacctggcgaacaacagcctcaccggcgtgatcccggcggcgctcggcgagctcggcaacctgacggacctgctgctcaacaacaacaccctctccggcgagctcccgccggagctcttcaacctcaccgagctcaaggtcctcgcattgtatcacaatgggctcaccggccggctgccggacgccgtcggccgcctcgtgaacctcgaggtgctcttcctgtacgagaacgacttctccggcgagataccggagacgatcggggagtgctcgagcttgcagatggttgatttcttcgggaaccggttcaacggcagcttgccggcgtccatcgggaagctctccgagctggcgttcctccatctccggcagaacgagctgtccggccggatcccgccggagctcggcgactgcgtgaacctcgccgtcctcgacctagccgacaacgcgctctccggcgagatcccggcgacgttcgggaggctccggtcgctggagcagctcatgctgtacaacaactcgctcgccggcgacgtccccgacggcatgttcgagtgccggaacatcacccgcgtcaacatcgcgcacaaccggctcgccggcggcctcctgccgctctgcggctcggcgaggctcctgtcgttcgacgccaccaacaactccttctccggcggcatcccggcgcagctcggccggtcgcggtcgctccagcgcgtccgcttcgggagcaacgcgctgtccggcccgatcccggcggcgctcggcaacgccgccgcgctgacgatgctcgacgcgtcggggaacgcgctcaccggcggcatcccggacgcgctcgcgcggtgcgcgcggctcagccacatcgccctcagcggcaaccggctgtccggccccgtgccggcgtgggtcggcgcgctgccggagctcggcgagctggcgctctccggcaacgagctcaccgggccggtgcccgtccagctcagcaactgctccaagctcatcaagctctcgctcgacggcaaccagatcaatggaacagtgccatcggagatcggcagcttggtctcgctcaacgtgctcaacctggccggcaaccagctctccggcgagattccggctaccctcgcgaagctgatcaacctgtacgagctgaacctgtcgcggaatctcttgtccggcccgatccctcccgacattggccagctgcaagagctgcagagcttgctggatttgagcagcaacgatctcagcggcagcatcccggcgtcgctcgggtcgctctccaagctggagagcttgaatctctcccacaacgcgctcgccggagctgtgccgccgcagctcgccgggatgagcagcttggtgcagctggatttgtccagcaaccagctgcaggggaggctggggagcgagttctcgcggtggccgcgtggcgcgttcgccggcaacgcgcggctctgcggccacccgctggtgagctgcggcgtcggcggcggcggccggtcggcgctgcggtcggcgacgatcgcgctggtgtcggcggcggtgacgctgtcggtggtgctgctggtgatcgtgctcgtgctgatcgcggtgcggcggcggcggtccggggaggtgaactgcacggcgttctcgtcgagcctcggcggtggcggcaacaacacgaacgggcggcagctggtggtgaaggggtcggcgcggcgggagttccggtgggaggcgatcatggaggcgacggcgaacctgagcgaccagttcgccatcggctccggcgggtccgggacggtgtaccgggccgagctccccaccggcgagacggtggccgtgaagcggatcgcgcacatggacagcgacatgctcctccacgacaagagcttcgcgagggaggtcaagatcctcggccgcgtccgccaccgccacctcgtcaagctcctcggcttcgtcgccagccacgacgtcggcggcggcggcggcggcggcggcagcatgctcgtctacgagtacatggagaacggcagcctgtacgactggctacacggcatcgccgccggtggcggcggcggcggcgacggcgagcgcaagaagcgcgtgctgagctgggacgcgcggctgaaggtcgccgccgggctggcgcagggcgtcgagtacctccaccacgactgcgtcccccgcgtcgtccaccgcgacattaagtccagcaacgtcctcctcgacggcgacatggaggcgcacctcggcgacttcggcctcgccaagtccgtcgccgacaaccgcaaggacttcaccgactccgcctcctgcttcgccggctcctacggctacatggccccaggtaaaaaccaaacttccgttgtgtcaattgctcgccaccatgtccatgtcgcggacgccattgatgggcatcttggatcttgcgcgcagagtgcggatacagcttgaagacgacggagaagagcgacgtgtacagcatggggatcgtgatgatggagctggtgaccgggctgacgccgacggacaaggcgttcggcggcgacgtggacatggtgcggtgggtgcagtcgagggtggaggcgccgtcgccggggcgggagcaggtgttcgacccggcgctgaagccgctggcgccgcgggaggagtcgtcgatgacggaggtgctggaggtggcgctccggtgcacgaggacggcgccgggggagaggcccacggcgaggcaggtgtccgacctgctgctccacgtctcgctcgattactatcgagccggcgagcacaagcgctaggctacgaggacgatttccaaacgctggaaacttgtcctcctgagcattttcttttcttttttctttctctgattcttgtttctggtggctaattagatcatctttgttgggtgaaagaggtaacaaaaaattgtgcatttttagggggggtgtgtggttgagaaaatcaaatcaagcaaagaatcctcttcaattggattgtttttaactgttccaagtgtaaactgtgtatggagattgatttcagaagcatctgatgaattctgaacattgtttcatctcagcattgcccagtcctgtttcaagtgatgctctgaaaaatagttgaaacagaaatcgcaacatgaaagagacatcagctaaagtctcatgatagggtaaaagaagttacttcaactcacaacattaaggcatggcaaacacaagtataaggataatcataacaacaaacagaaaaagagcagtggacataaggatggaggagcagtgaagaaaaggaatgaacgagcaaggtgacatatcacatcactagaacctcacaacatatgggtaagcagaaattctaactttgtaaaagcgctaccgttggtactaaacaatgactttgcatcagggaaggtataccatcagagccgagttcgataattggtttctcatacaagcaaaatatcacatcctttgtgaaaacaacagtttattacagcaccgcagttgaaattgcgagccgggtgttgatacggcgactacagatggatggtccaaaccatgtgtacagaccatacaaactgaaaaaaaagagtctggtggctgacaaaccaatatgaaaatagctaatcatcatcatcatctgcagaaacagaaataagagattgataagccaataaatattaaacagagaaaaggtattgtatttataactattcataaaaatgagcacatggttcaacagaaatagcatagaacccatctacaaacaagagctctactggcttcagtaatatttggacgactgagctagcaaaggtacacaaatatgttgcctgaagctgttagacaccaaaagcaacacgaatcactactgccatttacacaggttgtgttcatactgatcagccagcccaagtcttaaaaaccagatatcttgttctagcctaagctttgtttctagctccatttcatttctactacaacaattatcaagcaaacaagatagccaaacaaatggaaatatactacatgtctacatctaaaagtgtgtagttcattcatgctacaactaaagattggcatatcatgccatacactaatcatgctcctacagtttttgccactttctttcttctatttgcattctcactaaaatggtcaattgaaaattttcagtcgcaaaatctatttactcacaacttttgagtattgatatggtttattgatactgaaatgaatttatattttacattatatggtaatgaacttttcaagatatccttttgtttacatgtaacctccatatattgatggggaaaaaaaatcattttactgctgccttgcttattagctgtttatgtgtgatattccaaacaaaaattagtgataaaattgaacttggctatcacaccaattcctcattatttacccaaccttatgtgaccttcagctttagtatgaatgtgtcatagagacggactgtactgaatttcccaaacgcaatgaatactagttctttgatcttttggcacattgtgcgcttgagactgctctcaggtaatattgtcctgatgtcctctgccacaatttaacttgaccatagctgccatgctgttgcacttaagccactatatgaaggtctctagagaatttcctgaacaggggagtagtatgagaatggtacatcgtcctagctttactttttttattagtgtaatggagagtggagactacaaagtacaaactatagaactcttcagctgaaatccaaatttgaccccaggtgttctatgcttttgtacctaagtcgatgccagtgaaccactagagtgaacatgtccagataatttcctacatgggaatggtttaaaaacggtgtatttactccaaggtttgatgtttttgctatggacgtaccaacagtgccctcttttcttttgcagtattgtgtttgtcattcatactagcgaggaacattttgcagaaacatagaataaactgttactccctccatctacttttgatagtcatatttccaaatctgaaaaatttatttttgataggcatatttcaatccaacaacctatcctcttaatgactttctcggatttaatgcgtgaccctccattcctccacacaagattggctatatgggcattgagaaatgtagatattaatgaatcgcttgtttacaaggaatgactagtagcatgtttaaatggatgataagtagaattacttatccttggtctatgtgccaagatgaaatatgactatcaaaagtagatggagggagtatcttgtatgttccttatagatctaatctatttagctactttatgttgttagttttaaacacgattcctttaaaatgcaatcttcgttgtttgttctcaagtacgtgataaatggttacccaagaattataactgtctgcggagatggagactatctgctggttatcaataaatccgggtatttctgcttggccaggaggaggttccagttcttccatacctccgttgctatctatcatggaatatgcattattatacatcacttgtgtatgccactcaaaatgctatcccaactgttcccaaggttgattgaatgaaccatgctaaacttaacacttaacaatctgaatggaaaacagattattgatgtgccatatttaagttccatggagtctaaaaatattattgtatatactagtaattattctaactactgctttgattaggaggcactactgattctttcaacagagtagcataaccattacggagtaccagagattgcaaagtcaaaattacagtagtaatttggagaatacaacttgttattactatcacttattctttaagtggcaatgctaaaacgataggtcgcatgtgggcaatagtaataacagaaagcagaatcgaagaaagagtaatctgaattcaaaaaaaatgttagaggaattaggcacgaaccaaagtaacgccgctcgttggcttgctttgcacgctcaagcatcttgtcgagatcctccttgagcttctcatcccacttcaccagctggttgacgaacaccgcacccaggcccattcccaccacatgctcccagggatctaaaaatacataaatcgtagcatcaagaaccctcttcaataaaaagaggctgccattttgatggtatctccctcaaatcaagtgaaatgggcaaatccatagcatcataaaactgtactaaagctaaaagataaccaacattgtagagctcacaaaacctaaaaaagtcaagaaccgcatcacatctagaacacctaagaacacgcggagagacggagccccccaacccgaccaagatacacgcgtctccggcagaaacaagtacagatcggacggaatcagcaaccagcaacacgtacagaatggcaggacgcgacgcgaggacagatcgagagagagagagagagggggggggaagagaggaggagggggggggggttacgtatcgaccgtacggcgcatgtaggggagcttgcggagggcgttggagtacatctgggtgccgaggcccaggagggcgccgatgatcgtcggcgtcgccggcatcttcggccgccgcgctctcgatttctcctctttctcgaggcggcgtggggggaaggagaggggagacgaagacgagatgggtgggaggagtggacggcgaggtctcggagaggctcttgggagtggtggtttgctgccactgtggtgtggggcccacgagtcagcggagattgagaaagaaaagcccatgggccgaaatactccatggactggtaccggatctcaggccatggggcatttgccatggctgaagcccatgggtttcttcctcttttttttttccaccttgtgtaaattgaaaaaaaaagtcacaagaaaaaatggaccaaaataatggtgaaaccttttttttatttgtttcctcattttgtggttgattattttattagatatattattaatcctttgtaaaaacatttgtatgtgcttgattttttttcattaccttattttaatcaaatgggcagatctcctgtgttcgagttttcatatttagttgatatcgtacatatatttgtatgatccatggctccatgctaagatttttagatatttgagcatagtataccggccagcattttttcatgtttataggctctgcaacactgtcatcctagcttgctgccaacctcactcatggctccaacagtccaagggcacatgcataccgtggtctggttgcggcttcattgctattcccaggttttacaattagcaaaatttcgtgatttctaggcgccccggaatcatgtttcgaatggtttttgagaaattcaaatttaaaacagtaattcaactgagattggtcaaaatttctcagttttcgacatcttgctgggtcgaaattcaacaccccagcggtattgtgaaccaaacctagtctattgcatcttcagtctcctaataatcccaaaggttgtcagtgaactatagctcagccagcgcataaaacagtcttcaagtcatacttttaaactctagcaattagtacactgcatatagtacattttttatattgcagatttggcttgaagctcttcttcctgctcctcatcactgcagttgctgaaaactatcttctttcctgcaagacaatgacgaatactgttattgtccttatgaaactacgcatcaaatcgatgtttgttcttcagttcattctaaatggtttgtcctcttcatgaaattagtggcatgtgcttgtgttttacttttgggacaattgcttatttgaccccgttttgaaccctaactaccaatttgaccctacttttcagagtttgcttatttgaccctccttttcaaaaacgaagcccccgtatgaccctgttctgttaagggcatctaacggtgttaactgaagcatagaatatctcttttgcccttactcatttgaccctattacatgtaggacccacccgtcagttctctcttctcctctcctcgtctcctctcttctctcttttcttctcttctcttctccacggatcggcgagagggagagcaggcgccgatggggcggcgacttgcggcggcggcattgttagggcggcggcggcggcgctctgaggaggcggagggaggaggcggcagcggcggctgacgaaggggcgagttacggtggcagcgcacggagggggcgagcagccgcgccggctcgtggagggaggaaggaagcggcggcagctaggggcgcggaatgaaggaggtggaggcggcggcgccggcgcctgcgcaggcgggtggaaggagggagaatgcggcg

SEQ ID NO: 46959 - DNA, 11936 bp, Oryza sativa
cccggatccgctgaccgcagctcgagctccaccgctcggactcgccgctgccactccttgtcgtcgtcgtcgtcagcagggccggtgccagctcgccgtctcgccattcactgcctctcctgtggtggatccgtggaggagaggagaagaactcgccgccgccactcctcgtcgtcgtcgtgaccaaggccggcgccggctcgccgtctccgccgccccatcagcgcagccgccgccccattagagcaccagcaccgccgcaaggagagagagaaagtgtgtagagagagaaatgtggatagggttgagggtggatggatagggtttcctaagggtattatgggtattatgaataatagttgcatttctttttttattttaaatcaaaacttaacggactagcggaaacagggtcaaacgggagcttcgtttttgaaaaggagggtcaaataagcaaactctgaaaagtagggtcaaattggtagttaggatctaaaacggggtcaaataagcaatagcccctttacttttacctgtaccaggcccatcaggagagatatggcctgaccagaatttcctgcccctaaaacattcagacacacacaacttgtggcctccaagttcagatccattcagcctaagtgcttctgaatagtgataccagctttcgcactttaggtatgctttcctgccaaaaaaacacagataattggggagacactgatgacataggtcaaagattagaatatttattagagactatcaaagtagcaacaatgaaagtgcaggaacttaaacaagagctattggaatcaaactaattaacaaccattactttgcaggttgcatgccataaaaatagtattcactatgttctttttttttatttgttgacagagtagaacaggtttcatcaatattttttttagaaaagtctatactgactaactttttcttactaaattcttactaccattgagatgactgttagtacaaatttagtacgtgtagcagtgctctatttttttctgattatatattgataaagaatagtaaaagtatagctacatggaagcatttgtcacggcgaatctgcaaatgtaaaatcttgatatttttgcacatattacgttgagatttcaaggtcttaatgcatgagaatagagggaatgtgaattaaaacaacacgtatcactattcactaccggagaccggaaggctcccgtgtgctcaaaacctacggtaacaggccaaaaacacacggtaacaacgttaccgggtaccggaaggttcccgtgtgctcaaaacctatggtaacaggccaaaaacacacggtaacgacgttaccgggtgctagtgcacgggaacagatactcggcggcttcatcagtttaccatgcgcacttcccgggtgttttacgattatgcgcacgggaaggccaaaacacatactgtgtgtgctgaatcacacggtaaggctgccgtcgtagctggactcttgtgtgtaacggagctcctaacggaatggtggcttaccgagtgtccttcacacacggtaacatttggtgtgttaccgtgattcattcacacccggtaacatgtggtgcgttaccgtgtttgaagcacccggtaagagaacatgtgttaataaaaaaaaatatatgctatttgcaatttgtttactatatccatcagagcttatttccatcacaatataaaccaccaacaagcacacaagagcacaacacattccaacataaatatatatttcagtaaagaggttacaattaataattagcatacaagcaattcaattcatggttcatgtcagttaaagcaatagccaaagttacaatagctaggaacatattatttggttgatgcaaggggggtggcggcggttcggtggagaaccagagtgggtcagaggtggcttgctagggttgaagtgttctatatatagccatatctgttgatgaatataagccgtccgatttaaatccattcgaccatagtttacaagcagttttgcttggaaaaataatactattcacacgatttctgtactaatccctttaatgagaacttaaatattcaaattatatataattgttattaaaaacttagtttgtttgcaattgttccaaacaatatcatgtgtttgtatattaacagagtggggaataacactacttgtttatgtgcaccgcttgaagtcacaccgagaacaacacacaggtgggaaatcctaattataacctactcaattaatctcatccaaaacgatatgtggttttgtgttcgtatttatactcatctatgtccctatccaagtagaacatgggaatcaagccaggatatggttcatctagttctgttggtcttgactagctagtgcgatcacaactgacgttgcctttctatttaaaagataataatacctttcttgcacttttaaccatcctgctctcttctcaatcatttgagccatattgggtactgtgacatcctagcccaattaggatttggcctgtgtggctcctgtgagttgtgtgcgcatgtttagtaccaccttactagtttagcatgagttgaaccaatttataagacatcttccctctaaccatgccactcccgggttaacccttttacacgaagcgatgacgaaagtataagtgaagtggtgtgtgtaagtgggtccgcccgtcggatgggctaggctacgcagttctgaagggacggctgttataggtacattatctcctacttgtctatgaactcttgatggcgacaatgacaagcggtgatggaccgcaacgatgacctagctagggttttcgagtttttttttgaatttttatttttgcgtccatccacacacaaaaatctgattttggcatgctggtgcgccacccatgtggaaagcgattttcacatacacttttgggcaaatggacggctcaaccacacgaaaaaaaggttttggaatatatggaaaatgccttttagtagtgcgtaagattaaccaatccaaaataaaaatattggttaaaaggatgatccaaagagaaaacatcggtaataaaagttagcgtaaagtgaaattcaatctaataataataaatcaaaattagttgtattatgtgaattttatcgtctactatattgggagtgtctagattgtagcacacgtcatgccaaatttattttcactattttcctcattttctatacttttacaacttttatgtgttttttagattttataatattttcctgcaattttcagttatccgtaaaaatattgtgtacagtgagttgtgaattatagataccctattattgcgagttgtattgtctactactctactatctttgagagtgtcgatataaataattttcccttacattttacaattttcatgcattttttatactttttaaacttttcttttaatttgaaattgttagacattcccgtatgtcaaaacgaaaaaataggcgggaggattccgctccgttgccgccaacaaaatcatagtgcgcgccaacaaaattcaaagttcgtgccaacggagtgaaaaccgaagtatggaattcagtcatgttaccgtgctccaggtggtcccacacggtaactttcctgttaccgagtgtttcgtggtagcgcacggtattgttgggacgttaccgtgttcctagtcctacacccggtaagttactgggtgttttgttaaacccacggtagcatctggttgcacacgggagctttcccagctccagtagtgattcataactcacaagctacagatgcatgcatgacagcagatgtttaatttacaaacaactacaattgaaatttgcctacaatttgagaggaggaattcagctaaactgaccctatgcttgatcccatagaattcgttagaatgataacccgttcttcatcagaggtaaagtgatctgcgagtatggttctgatctgggaaaaacaaaattaagctaaatgtaaataaaaatgtcaagggctagtaataaattatgtacaagataaaagtgcacctccaacaggaggagatgaatcaaaaccttcaaccaaaagggcacaatttaaatctccaggtatctccaagatatatgatgtatctctaagcaaattgcagataggggacgaattcacagagagaaaaaacacatcagatacctgcaaggttgacaaagcacaagtatttgcacgcgcatgcacagtgcttatatagagaaagggaggggggtgggacttgggggatgtcctctgccattactacacatgcagttgttccattgacatgtagagccatagtaaaacaggatccacgtgtcaatgactcaactgtatctgtagtaatagcagaggattttcttctcgggaatggttcctaaggagtcaatccccttttaagaacatatgtgtcattgtcgaagaatgaaaccttgagttggccacatgcatgacagcttacgtttagcaagtttataaagagcctacaagattgatgtaaagtcttatatagaaatcaattaatatatgggtaaatttgctagaaatcggggtctaaagatttcatgaaaccacaccatcagaattcatgtggccataatacttatggttatgtgcaacttgaatcaaaatatatgaagttttgtggaatttattcattaattatccattgccatcgtgcgaaacaatgatcaacaacttgatattgccaactttatgtgttgaaaaatcacaaataacaacaatcagatatcataagctagtttacctcagtggcagctctgtgtgacttgaaatcgacaatcaaaagacatcggaatatattgtgaaatataccaacaatagcagcaccaccatcttgaaagatgcagtccctacggaagcagccaacccatgaaaaatcgagagtaaaatgtgcgagattttcatgtgcacttttgagagaaaaaaattacctcaactgtatgctgatactgctaccaaagttccaaattataattgtggccacttgtggtacctcccaatgagttgtggctacaagatgaggggcctttgattctccgtcgaaaatggagagattagcaattccataagattaatagaacccttcaattgggaattaattgaaaccgaacagttattagtgtgtggtaggcttcatcatcgtacgtcgtcgatgatctgctcaccttctttggcggcggcggcggcggctcgtggtggccatggagccgtagccagcgacgagtaaaaggtacgcgagaccagctggaggcaggccccagtcgggcatggccggaggaggcggaggatgtggtggcgtagaaagcagcggagggacgcacgagcctcccgttcctgacgcacgtccccaccggcgtctccacgaaccggaaggtgcgacggaccgcatgcttccaacggcgacggctcgatcgatcgccgctgccaacgagacgaagcggtcgatgtggagtggagatattaaaccctagtccaaacgggctgatacgtagtacgggttgtgttagctagacgactgaatttagtttctctcgttttaagtggtgtactacatgtttcaattttttctataaagttctataaggtataactatatttctaccatcgcccacgaagaattcaaatcccacacatgtatgcgcagtgtcgccgtgttgggagcttaactataatcaagcaaggtgttaatttttttttattttttttaaattatacggtacaacgcagagactcacaacgcacgcacactcacccctataaacacacgcacgcaaaccctacccctatgagcatctatatgcactggataatgaatagccagttgcaaattacgtgtgtatacatatatatattacaatttttgatgatatttataacttaagtttgagtttacgtgcacaggatatgttctctagttagatagacaaaaatataaggtaaaaaatagataaataaagatatatgatgggattttagtataacaaaatggcacttgaagaatcgacaaagatatatgaatgaaggatttagtataacaaaatagcacttgatatatttcattgtgacttatttcacacgtgcggtgtgcatgggatcgaggaactagttatcaattcataattaacgagataacgactttgaaattaaataacttgtattattcgtagacacatgtccgggagatagcgaaattaatcatgttactgatcagcaaaagaaaccctaatattttgagtaaagcctgtggcttaggcttaggtaggaatactccatgaaatttccaccttggtgtcggtaaaagtgaatcaagaataatttttgaccgaacattgaatatattttgatagtatgtttattttgtgttgaaaatgttgctataattttcatataaactttgtccaagctttaaaaaagtttgacttgaaaaattcaaaatatcttataatataaaacatagagagtagctattgtagaggactatagtgaatagaattaggcagtggcgtagccaggaatttttcgctgggtagtcctactcacaaatacatatcacatagctaaattttcaaacgtcgtaaatcccatatacgagtacaaatttaatgaaaaagtaatataaatgtaacaatattgtcttatatcgtcaatatttgactaacttaacaagcaagctcacacgtgcaaatattacaacataaatattgcaaatataaaagatcttgggcacaaatagaaaatcacaatgccaatatgttagccataaaagtttttagtattatgtcttctttactaacttaattcataaaagatatctcacttgatatatgtgacaaatcaatgattcaataaatcatatattgtttctcctcttggtcatcactagattaaggctaacatacaaaagagcaattccatatcaaccacatgtttacaaatcctacatactacaatagtaccaaatagcaacacattcacattcgttgattcacaaatcaaaaatcacattcacgtattcactgattcacaaatcacaatacaatgatttactcacctaagcatgggattccaaggggtagacggagggaaagcgtcgaggcaaggatcaattagggctaggcagccagggtcctaggctcccagctcctggcaccggcggccggtggcggcgccatgtgaggagccccggcgaccggcgtaggcagcccgcacccaggcagcgtggcgtggggactggtgcctctagcgcttcgccattcggccgctgtagatcgagctagggaagtggcggcggcggcggcggtggcggcggcggcgaggaagcaacggcgcaagcgcgtagcagaggcgacgaggacgagtagagacggcatcgtggtcgtcagatgcctcgactcccagaaggccaaacctagcgcttttttccttctctcttgtgggcttgtttttctgggcttgaatgagaaccaaggtttgtgggcttgtttttctaggcttgaatgagaaccaaggtttgtgggcttttaggggggtgggggtatcctgggccaaaatcggggtagtcccgagcccaccagtaccaccccctgtctacgcccctggaattaggatcaatcttcgcaagttgttcaacaacaaacattttcacatggttttcatatgtaatagagcacataatttgtagcctcgcggcattttgcttggttactcccaagatgcgttttcacacggtttttccctctgtaatagagcacaagctaatcaaaatctatagcctcgcttgaggcattttcgcttggtactccggaaaaatatgtagtacaaaccacatatctagtgaaaacctagaaactatcgttgaatctaaaagtagacgtatgagatttgtccacgttatcaagagtaaagttttactttcatattcaatcacgagttaaattttactctaagtgacatggaccaatatcaggcgtcaattttttatccaacggtagtttccatgtttctactatacatgtggttcgcactacatattttctccggtactcccctactcagtagtgtactcccttagtttcaaagtatttgtccatagttcaccgtgagatcgaagaggcttccccgttcaatctccataactagagaaaaaattttatggcacacaaaatgagaaaccttcttagcacatgattaattaagtattaactattataaatttgaaagtagatttatttgcttttctaaaacacttctatatagaaacttttttaaaataatgcaacatttaacagtttgaaaagcgtgctaacgaaaaatgagaaagttgaaatttggatttgaagttgaacacacatggttaaggagtagaaagttttgcaataactatgtcttaatctacacagttgtacaacgaaagggcttagttgagaacaagaagaaaagccagacatgtatataaaaaagcatattattggcagaaaagctatatttttacttctttccccaacaatcgatacatcaaattggtcttgatgtacatacaaatgctatcaacatacaagaaaaccatatatacaacacgttaaaaatgtaacccttctgctaacaacgtatgatgatctgtcctgcaaatgacccttcacaccaaacctgattctttataagttgtgactggatcacagaaacagtatctgcaaagatacatagagcaaaacagcagaatgagctaggagtgtacttaaatatatacatccaagcttttggacatcgcattgaaatttcaccaaagatcaagaaaccgcagcgcaatcaacaaagcagacaaaacaggtgattcaacgcagagatttcagatcagtagaccgaagagagcgcatggatcttagagagcccgggtcgcgatggggcgctggattcgcgagatcgtcgcagtgaactcggagaggaagggaagggagagaagttcctcatggggtttattgggagatccatgaaaatatttatatggaactgaaagggggaagtacgatctcggtggccccaacggctagcagcgttgcccttgaaaaaaaatattatccgtctatccgtaaccatgttattacaatatgtaaaacgttggttccattcaacgtcatacatcacaagcccattttaactcgttttctttctattgtattttcgtatagtcaaaattatccctacccgtcaaaaatactgacatcggcgaccccctcctacggtgagtcagcgacctcatgcgtctcgatcggttgaggagtgcccaagctgctccaatctccccaagtcctccaccacctcccccccccccccgccccaaaaattttttttttaattttttaagacctttttatgttttagttttattaatagaccattccaaaaaatatgtccaaatctgaaccttttggccacgctagccctagcgtggcagtgctggccagccactcggctggcgtggccaaaaggttcagttcatgaaaatattggaatggtctattaataaaattaaaacataaaaaggtctaaaaataaaaaaaattcccccttcccctaaactagtgagcccaagctgctccttgccaaccttatgagcatcgccgagctccttgtcggtagccttgtaggtgtcacagatgcggatgaacctaatctggcaaaagagcttttagacgaggagggcagagatgccatgtccaccttgtccccttgttgctgcctcgccccctcgcttcccacgcacagccatgtcccgtcacccgccatcgcctcgccctctcaccgcccgtgcatagccatggtctatcgccactgcctcgccctctcactattcgcgccacacacaactgatggcctagagtggaggagggtagaagagaggtggagaaagatggagatgagagaagagatgaggagggtggatgaagaagatagaactaccgggttggttttcatgtgtagattggtattttgatccatccaatatatgtataagaacatatataaaatggcattgatacaatttgagagttattgtaatggcaaagttttaaacaggtgaatagtaattgtttttccaatacaacaaatttgtaatagcatgaatcaaatttcaaaaaaaaaaagtaacagccgctgggtggtgacttgtgcaacttatgatccaatgtagcactagttcacactagtgatatacaaggtgtcaaacaaaagaaccttggagaaatgatagaggattctaattcctcgaggatgtccccttgtctatttttctctcaaatcaatgtaaatggttgtaaaagttctaaaaataatttagcaatgtagagtattgcaacatcaatgcaaatggttgtaaaaattctaaaaataattcagcctcaagttgttgattctatcatcgacatgtgtaaagagtttgatctagccctaagttcttagatgagtcttcagcgcactcttctgcttgttgttgttcatttcctaaagctcttgtgccctccctttctttgattggctaggggtctctttgggacaccttagctccgtgggctcctgttgtaagaagaactatgtatttctcttctcctcaattgcaattggcagagcttctgcctttctcctcgaaaaaaaaaagtatagtaacatctaccactacaccaaaaatcatattcaaatttgctctacatattttttttgaggaaaccggcagcgggagctctgctggaatttgattagagatagaaaaacaagtgcaatatagaccagagcaaacgaaaataaaacacaaatcaaggtggcctaaaagccgatctacgaaggtctatttcctgcttgacaatgtatgccacgtccctctccgatctaacagaactattgaaaatcctattattcctttccaaccaaatattccaccatgttttgaggagagctcctcttgttttcagcttttgttcttcggagccttgacgatcgatttcagtccaccaattggatgttccaactgggggttgggcatttcctcctgccaagtttagccatgagcaaacaaagctccacacttgcctgacgaatgggcatccattgaacaagtgatttgtatccttaaaagcacatgtgcaaagacaacatatccagttgcatggccaatgcctcctgagtaagttctgcgtagtgggagttttctgatggagaactagccatccaaaaaacctagattttggttcagccggcgccttccagagcgaggagaaatttatggaagcaaaagatccttcgaattggaaaagatatgcactcttacttgtgtaaatcccagattcattccacttccatgagatatcatcaggaatagtggagagattaacatcctgtatcaagcttcccaatcggactaactcgtgtatttcctccaccgtgatgatttgccggaaagaggcaatccatttattaccaagcagctcaatttggacctttcatattgagaaacgaaaaaggaaaattcacacataatagtaccaacgctattcatatgttagatttgtttttttttatttctcaatgtgttagatttgtttttttttattttttagctagtgtatgtgtaagttgagttttgactttattttctggagtagagtataaaacactttccctggagaaacaactcaaaacatagctcattgtgtgggttgtacatgtcaaatctgttgtcttttgctgacatgaacaacgccaaaggcaataatattcttatccttcctaaatgacctaataatgacaaacaaatctttagccgcctcatgcttttgatccaatttaagctagaaatcagtcagactccaacgtctaaaac

SEQ ID NO: 46960 - DNA, 14575 bp, Oryza sativa
acaaaactgcagatgtgtagggccagggatttgcatgcttgcaacaagaaaggacatttttaatgacggtgggagaggaagaaaggccgtttaggcagcttaagccacaagactaattttggtttaactagctaattaagctagctgctagctatagatagcagaaagattgggctgctggtacatgcaggggggtgtttcgtgtgttgagacacagtactgttaattggaggacgatcttgggtaagaagagaacaaatggaaaggtgtgggaaaaggtgaagagaaatagaccagctggtttaatcaaggacaagagctacttgccaaggacagataatggaattggaagatgtcaagctaatatatcatttgaaaattgggaaaaaaaattctcggtctgtcgtataatcaactgtttcatatatatataatgaccagcagagggaacatctcagaacactgaaatttaaggccactttcggttaaaaaaataatttgaggcccgatgtaaaacatataatgagaccttatatcctatcttactataaagttatcccccactaactccttaaacttaacatgcaaagatgtcacatcatcatccactaacaagatgccacatcattatccactaattaacaagataccacatcatcatctactaacaatcatcacatttaaacatcatgcaaacatgctatatctttatagtttttataatttaagagcttttcaaatacaaatatgttaaattatcatccaacataattcacataatgtttcaatgtatatctttcttatattttatgatatcatatatacttatatagttcatcctcacttagttagtgcttaaatgattaatctatggtccaaattatctttcttctttttttctctaattaaatcatatcacatcaattgtttttagcctttagattattaatctacggtccaaactatctccctacttttcttcttccataaagtcatatcaccttactttttacgtttgaatcaccattctacatactatttaaatttaaattatcataaaccacattaatttacttaatctaatgttatctagctatcttacacgttattttttttattgttatcatagtaaattcccgcagcaatgtgcgggtttcacctagtttataaaataccaagagcaaaagaataaatcagcggtggctggtggtgctctacctaagttgaaagaagatatttttaaatgaaatttggaaaaagcattatgttatcctgtaatgatttgtttttttattaaacaaaaaaatagaatctttaataccaggaatgcaagttcatatcatcgtcgctctttgaagttgtcatcgttactatcgaacacctatcagaaccaaagaaaacatacccgttatagacaaatcaataaaggagtaagagtaagtcttttaaaaaatagagcaaaaggcctataaacatattggaatgcattggtatggattaaaataaaaaggtttgaggtcatgttcggtcgtccatttcgcactctttgttgacggcccagcaagcagggtctctagttattttagatttaaaacgactcctaatcgatccaatgttaatgtaccattagattattaattatactgctcttaacaaggacactcgtatgatgaatggtaagttctcattgctcttaacaaatccttgatgatttcaacaaaatctgataatgctttcggattttgattatcatatgattttaaaatatatagcacttagttcaaaaaatataaaaaatgcatatgtgttgaaagtactgccgttttctcataaacttattctgatataaaattatgatcaaaatcacagcttaaaaccacgaaaaaaaaatcaaacgtcaagtgtttcttttttttttaccaggtggagaccgtggagtaccttgttagaatcagctcgtggtgcaaggagaagatggcggtgtgctaatgcatgattaatatacatatataatggcaatatgatgagtattgataactctaggtttggtgaaaacttgacacacatgatccggcttccaatcaatatgatccaaaccctgcaatcgtagcaccacatctcctctggttatcaactgtgcactgtccggttgacctcaccgagaaggctaatctctgcatgtgaattgaagaacacaagcaagaacaaaatagattgcaactcaattgcatatgaatgattaagcactcaacttcagagttccacaaaccaaactagcggcgaaactgcaatggcagaaataatctaagcaaaacccaattctaaactatgacggctacttaataaatatggttagggacatcctaatgccctaggatgcacacccccttggacttgcacaattacaaggcacaaggcccgaatcagattcggaccagatgaagtatgtggctcgtttcgtagattcccgatagctcggtagtaatttttacgtgggaccaaaacgatccaaaagaactatatgacttgttttatagattcccaacagctcggtaggaatttttatatgggaccaaaactatcagaaataactgcgtggcttgttttgcagattcccgacagctcggtaggaatttttacatggaaccaaaattatctgaaagaactacgtggcttgttttgaaaattcccgatagcttgataggaatttttacatgggaccaaaaccatctgaaagtagactccataagctttccaacaagtactcataggcccctaaattccttttaaatcaacgactagatccgtttgaagttaatgctattaggaggtctgaatttgaatccaaaacatgcagaacttcatcttgccttgtatgaaccaaaagtgatgtgataacatgggagtatacttggagaaggtcttgtattggtccccaatcaacttcattgatcatccaagcacttcgtgagtccgttcgcttttatttcacccatgcaagtatttttgcaaacgagaaaatacaaaactcatagtgcaataatgtttgttgaaacatataacctgtaaatctcacatagaaaacatgcgccttgggttggtggatatataaagtaaccatggtcatatccgagctagtgatatcctcatcaggatatatactcacataaacaacgtctgcaatgatctctacttagagatatttcatcttttcttatatctatttatacttatcaagtcaattctatgtatttgaattaattaaaagagaatatataattatatatctgcacataaataaatggttataacgtctctacttgttatagattctattgagtagaatgctcccaacaaactaaaccatatcaaaaacagtcccacgggatgcaggaaattaatgttacttaattactatattacgtacacgctaaattgttaagccacatcattggataattaattgttcgtcttatcctgccattagcgtttgatcacatacacgacaaaacaaaatcatgtgcgaatataaaatggtgtgactgcactttatagttaacttgtctttcatcgcctgatcaccaattaggaaaaatcatatactccatatgatatccaattgtgctcgatctgatccaatgacggcagtaaattaacctcaaattgagccataacgtcggtaattactggccttccggaaacatgattagtttggaacgagtcgcaataatccagctagctccggtgactaatatgtagccatcaaagttgaccccggtcaatcataacgtaaatgtttatttcaactattaatgaatataagcaattaatgtagtcttaattatcgtatcaattctgcttcatcatacataggtgatatctcactccttaattatttcagttaaatatctatatatcgccttcaattcatagcattgactcgcacgtcttagacccgtacatatgtatatttagggtaaattccacacaatatatactagtttaatctcttatgtatactacaacaaaaacatgatgtagaggcacttcaacaattcatataagtaacacaaggtacaaacacacataagtaatgacaaaaattttaaattggttccttagtaaattgaaaataaaaatgaatgactacaagaaaaatgctttagacattttttctaattatatagaggtacttttaaagtgcgtttacaatactatagtgatattttcaaaaattaagtgccttatgatgaattatgtctacaaacgaagatgcattttatgaaatgtctctttgtcttgtggtattttaatagaggcaatttttatgtctataaaatggtagaggtattgtttagaaacattaaatcgtatcgcagccatatcaaaccaatgtgaaaaaaataataaaatatgttcccttactattgactatccttaaactgaagatctctcagcaaatcatttatttttaatgcactagacaactcaacttcgttttattacttataggtttgtgcatgtgttacttatatttggtctgttagtatgcattatcaatttatcattataagaagtgtttatatagtttaaaatgacttaagaaaatacctttacatatcagacacattttcaaatgccgaaaaaatacctctacttgataaaatttaacaaaatattctgaaaatgtctctaaagtatctctagaaagttttctaggtaacttttaaagcgcctctaaaaagtgtctctacgctataaaatttataatttagaggtaattaacaaaacatctctataaaaatgtctctgtatgatgtttttttgtagccatgatttcaaggcttcaagcattggcaatagaaaggaaaaatatttgtttttatcttttttcacattggttttatatggttgtggtacaatttaatgcctctagaaaatatctctaatcttttctaaccataaaaaatccctctaataaaatgccaaagacattttataaaatgactctttatttatagagacaattcaccataaggtaattatgaggcatttctaaaaatgcctctacactattgtaaaggcatttgaaaagtgtctctatagcattaagtgactagtgtctctacaaggcatttttgctatactgatagtttattacatcaggaaaaagttcaacacagttaagtcttaacttgattcaaactccaaattaagttgttcatataagagattgatttacaaatatgttctacaacagttgagtccttagtgggttgtacccattatatttctcaatatcaaatttttggattctcccttctaatttactcgagttaatgtgtgcctattaaagaaagagttgacccttctctttcatttattgtctttcacatgggtcatcaaataaaatacgtcatacaattaactctagtaaattaaccaattcctcactttttctcatataaccccctttcccctcccctccttcccgcgttcaccccctctctcacattaatatcagcatcggccctctttattataggccaatttacttattattgttgtacacatccttcgaagatatgaactcatatttcaactcatgcttttctatcagttacttagacgggaactaaattaaccacgctcaaacaatatgcatatgctaggtactgatatataatagcacgaaaactctcgtgttgccctaccccagaggcggctcgggaggcgacgacccggtcgagcagccaacggcaaagccacgcggccgcaaggacggtggcggcagggcttctcgctgacctcacactcgggcagccagggagttgcctagggtggcagtagtggagaccgccagatccgtgtcgcttcggccagatctagaggggtggcggctggcagtagggacggcgttagcaacggtggcgggaaaggcgacgacaacgatagagtctcggcggtagggacggcgacggcagagtctcggcggcggcgggagccttgatggcagcggggatggtgatggtgcgacggtggcggtggcggagaccccggatccggtggcggggcgcctggatcttgcacgcgttgttggattcggcgcccccgtgctggatccggcaggagtcggcacaccaaaggcgctggcagggagaccggtggctgggtgagccagtgacgacgcggtgtgcggatgtggtgtcgacaatgacggagggcggcatagtgcgcgtgcggaggcgcgactagcggaagaggagaccggtgaggcacgaggaggcgcagctggtacggaggccggtgaggcgtggctggttcgtggtcgcggcgcaaagaggcacagggatgctcggccaccggcaatggatgccagcgcgacacgaggagatgcggccggcccagtgggaggcgaggccggcggaggcggaggccgacaaggcgcatgccggtgcagcatgatcaggcacagccggtggtgacatgcagaagctggccagcaggggacgccgatgcagtggtacccatgcgctggcagaggtttagatggtgggagcaatggtgcgtcagctatggataggcaggcaatggacggcaggtgaaaacctagcccagccttggtcgggcctgcaacgatggcgttttgagcatcacttcccctcctgagggcgttatcgtgccgtctcatcccctctagctggtcggcccggtgaaagcctagtctcagttctctttgagaccttgatggctccttggagacgttgtctaggtagccccttgccgaaacctcccaaacaactggcgcaagctcactctagactaacgtcctcttatgtcggcactctagcttctgcaagttggccacatcggagggcctaggggggaaagcagatccattcttctctctaaccccctctccctcaatctcaaagatatggataaagcgggatttcgtgtcggttgtaaggattgggttttgggcgatctcgactgtagttcctttgttggtctagcggcggtcggtcacgtttagcggtggccggttcggtgctagactcctccagggtctgtgtgttggagctgtcagtgtgtgggtggtggtatattttttttcattttcttggttatgacctcccaagattgtaatcttgttttttttctactctattaggcctttcacagtgggcggaacttaccgtggctttgtctcacgtggcaaaaaaaagtgggtggggcccatagctatactcggttctccggttcctagcaaagcaacaaggaactttgctcgggcgcggggcccactcgggcacgggcccacttggtgagcacgcgggcgacgacgactccgcgtcggtggcgactccgcgccgctgtgggaggtcctcggccgccgcccatggcgagtcgccagcgcggctctctactccagtcgccggccgcgtcggccacgccgcccccgatctggtcgaccggagctcgccggccaggagcggcccgcacggggtggagagggagatgcgggcggcccccccagctcagctcagcgcgatgacgacgacaccgccgccgtcctcctctctctgccttctcgtcgccgtcggttggagctacttcgcgtcgacgtcggtggtggccgagccgccgctgccggagaggcgagctccggaggaagatgaagaggagagagcaaaatgttcggcttcgggcatcacggccaccacggccaagaccagccgccccagcacgtcggcggcggcggcgcgcaccagcccaccttcaagatcttctgccgccgaccaacccgcgcgacgagcaccatatccgcgcacgggatgtaggcggcgcccttggccacgccggcatgagcggccctgccgctcctccgcttgccacttgcccaagatcagcccgaggacgccgccgccgccgtcctcccgcgtcgccgccgccgtcgtcctcccgcgccaccaccgccgtcctcctcgctccgcctcctcgtcgccgcctccgggaagagggagagtcgggcgcggcggggacggcgcgcgccgccgcgggcggcggcgacgacgccacgtcggtggcgacgacggcgaccaccaccaccgccgtagtgctcgctgacgacgggggcggaggcggcgagggaacgggcggcggaggaggggagagccggcgctgttgggtgacgagggaggaggaggagcagtttgggatttggtgtcggtgaagatatttgtgggccccacaagtggtgcttgcactgtgaagagagtgtccctatgtgtcatcctgtggtaactcatatggggtgcttgcagtgtgaatggccttatgaacttcatatatataacacacattccctcacaagaatgtaccgctccgaggtgtactcgtatacagtacatagcttgacacaagtttaagattattgaaaaggataattaataaacaccattggaaatgagaatgttggagcatgatattataatagtacagcaagaggatgcatcaccgacagcgtagttcaagagagacatatgtatatcgatcgatcgatcaatctcttgtgtttcaagaatccctgcacagctagcttccctgaaacgctactccctcacacaagttttagcaaagctctggctagctagctgatgcgtgattaattagtgtgtgtagattttacaattaacagtgatcgtttggtactatctccagccagctagctagctaaagtatgtcaaagattcaagaaaaactaagatcccctggctgagtgcaaacgacgccatcatcaatatgataacccttttatatagctaattaatgaatatattattctctacctgatctcgctgttaatttgatcatcccgtaattatatattctgcttaactatttgttgtcgaaagtacccctccgtaaaaaaaataatactctctccatcccaaaatataaggcgcctatgcatttcaagatttcaccttcaaagcattttgactaacatttagtacattataaatttaattttacttgctaaaaattatatcattggattgacatttgaatttcctttcatatggttataattttgttattacaaaccttataatatatgagaaattataagatagtagtaaagattagtcttgtagaccgtgtcaagtttgaccatgctttatattataggatagaggaagtatctattatagtatccagaagataaattagtatggaaaaaacttcgatgccgcttattaaatgagtggtcgttgtgagcgacaaggtgatttatggtaagatgaggaaaaattaaatttaatttcagtgacgggtggttggagaaaaaaatagtactataaacttaaatgcaacaactgtattttttaaggtcgagattgtaatcgatttcattatttctccgctcaaagaattactagtcatcagggtctgaaaataaaatagtaaccgcgcaataaccatgttcaccggcatattgagtcttcacgaatcgagaaatcaaaaaaaaaagtgagatccaaaattttcaacaaaaagttgtttgaatttcacccattttcatcagtaatcgagattgaacggtaaatttgacaaatctaaacgatttgtcaaacccctgctgtggtacttaccgtcctagtaaatcaaatcaaattaaccgcgccctttttggcagtagaggacaaggaactttatttggagtatattggtcgtttcttcctttcacacccacacacagacacagtacgtgacgagacgacggggggcatagtcgtcattgtcaatgtcaaatggtgcaacgcagaggcaagcagcgtgtgtgcgcctcttgccctttgtgtgtgggtgagtgactcagccagccgagccaccggaggctttacatacacactcactgttggggttggagaggagaggagaggtggggaaagagagagaggggggggagactactcgtcggctaggtcaggaggcggccggcgaccatggggcaccactgctgcagcaagcagaaggtgaagcgagggctgtggtcgccggaggaggacgagaagctcgtccggtacatctccgagcacggccacagctgctggagctccgtccccaagcacgccggtatgtcgtacgtcgtccccctcgccgtcgccggagctggagttgtgtagtaatactccggcgatctatccatttctctccggccaatctgattgattcttggttcttggattgattggatcacagggttgcagcggtgcggcaagagctgccggctccggtggatcaactacctccggcccgacctcaagcgcggcaccttctccgagcaggaggagcgcaccatcatcgacgtccaccgcatcctcggcaaccggtaggtcctccccgggctccatcgctgccgtctcctctattaattaataggtgtcgatacctacaaaaattagtcgatcgtcggaaaacgttattggttcgttcggcttggcgacaccactggctccgtcactgttcttgggccatgcgtatggcgcatggctctgctttgctttgcttttttggattgaactggttggtgcatggagctcagaacgattcccgtgtgtctcaggtgggcgcagatcgccaagcacctgccagggcgcacggacaacgaggtgaagaatttctggaactcgtgcatcaagaagaagctcatcgcgcaggggctcgaccccaagacgcacaacctcctgccggcgtcgaagacgctcctccatggcggtggcggtggcggcgctgcaaaccctagcggcaacggcctcgcgcagttccagtctaacaacggcgcggcggcggcgggcaccacgccgttcaccatcagctctccggccaaggcggccgcctacgatgtcgcgccgccggcgttgtacgacgtcgtcctccctgctaaccccgccggtggaatgctgatggcgcatgatcaccaccatcatcaccaggtcgccgcggcggcggcgccggtgggatacccctacgccgaccacggcggcaacggcggaggcgtgctgatgagcttcagggatcagaacgccggcgtccacggcgccgcctccatggacttcatgaacggctcctcctcgtcctcttccatggagcagctcggcggcggcggcggcatgtcgtcgaacggcaacggcagcttcagcgcgagcatggcggcgttcatggacgaggaggcggcaatgtgggccaccgccgtcgcgccgccgggcatgggcggcctcgccgggatggatcaggtggcgcagcagcagcagcagcagcaagtgctggtgcaggatgcggccgtgggcgttgcgccgacgacgctgatgatgcacggcggcggcgccgccaccgccggtgcaatggtggtggacaagagcgtggagatggtggacgtctcgtcggcggtgtacggcggcgcgacggcgacggcgttcgatctagacctgatggtggagtcgtgcgggatgttctgcggcggcggcggcgccggcaacgccatggagcagctgcagtgggactgctaagcccatttatcctctcacccctaattagttccttaatttcccatgcttaaattcgatgcgttttttatccccttagtttccattttgatgttcaattccatgtgttcttgattcagaatgtttcagagatcgtcctttcaggcaagaaatgcaatgctaagatgagtgataagacaaacttatctaatttagacatctcaaaaaagttgtgtcaaatttctttttttgcatgtcataaagcatttgtggatatacatacatgacattaatttcttgtagtctagctcccaacatattaatcaagatgatggtcattcatgaatctttttgatatatagatatatgatcaacccttcttgattacatcttaactctgttgcatcattttcatgcatataatccagtcaactcgtttagtcatgagatgagagcaacaagtcagttattgttttcttcctagtgtgtgtgatgtgagagcaacagctcagttattgtttcttgctagctacagcactgacattacatacgttttcaacccttttagtgcaagaaaagtttgtttcagttttgtcaatttatgcataagcatacaagtttctccaacaaacactgcacctatgcatgcatgcttgagtgaacctttaattcatctccaacatgtacatatcttacaaaggataaccattgcactgcataagaaaaataaaaggtcatcaaccattctctccaacaaacacacagtgcatgatcttgcaacgtcttcaatttgtctctgtccatacattttggaaactgaagggaaaacaaattaaagctagctctcatagttccatgtacacgtgtacatatatctactggcaaggtataactcatctgagtcatatatatacttcatgatgattgatggagattgtttccaatttgtcagctactatcgaataataattaatgtgcacataatgtgaaacattggtatatgttagacgtaaataacttattaattagcctacaactcaatgacacaagcatagtaattgcatgctaatgctactctccttttttagtatttttgtttagattttgtcttgaaatacctgcatttaattgtgaaacaatatagatatatcaagacataaatactgtggcatgccgcatgcatttcctatttatatataaactacatgcacacttctgtgtttttaaatacatatatagcacacatcaattaattaattgtgatcttgaataaaaaggtcgatgctacaataactagcaagtgcattttacatatcacactaatttgggcatatatagaaagatatatgattctgtagccaaaagaaagttgtttataaacataaaattatatacttttttaaaaatatatatgtatcatgcatgaatacacattaataatagctactggattgtttccactcacctgggatgagatgtacgtcttgggcaaatttttgtgcaaatagacatgtgttcgattatacatatatagaaaactactatatatagttaattaactagttaacatagtcatgctggaatatattaatatagtaactaagttgcatctgtcttcctaaatatgaatagctagctagatgcttaatcgacctggccgacccagagattggatatatatgatttagtgcatgtcagtatacttatatttgaatggctatatattaattaatggtgtaattctaagtgcaatatggttatgtgtcagctgacccaacatctattttgtcctgaatcgcttggtgaattttaatacatttatggagaccaaacacatggaagttttcttatttaatttgcatgcaagctattattaaattatcaacctagtcaactttgtgaaaacaggatatattttgttgcattgcatacatatatattatagttactgtaaaattttatgtgaatataatatataggtcacttagagagtagctagtatgtttggccacataggcgtgtgcaatgtctggttagttcttgctaatacatgccaagctatttctgttaagaacttcaaaagctatgaggatctttaatccaaagaaaataaggtataaccagacttatatagattctttcacgctactaaaaagaatgtatcatgtcaaaaggattttcctagtgttctcaagtccatgtggttgaacttgatgttcaaaaggaaaaaaagaaatgtgaaagatcttataagcaaaattacaagtagcatatatatagagaggacagcaatttaatgcatgcaaccgttatttttgtcaattcatttatcacaagtcaatgtgctttctagccttttattatcattcattttttgttgtgttatgttaattaattgttgaaattatatactcacattagccacacaaattgtgctatgagtaaaaaacttgccatgtggatgcatttaagtacaacaacttcaaaattgagcatttgcattcgacaacttgagatgtgtatttgaaggtcacaacttgataattgagcatttcggtgttgtgacttggctaggtgggtgcgttcttaaaggagttgacgtatgtggtttttttgccacatcactcatgccttcatgggaaaaatatcatgtgtggcgactcctttgaccaaaaacgcatctacctaggcaagttattgcacttatatgcttaatttttaagttgttgcactcacccacctgctacgttattgtacttaaatgctctactttcatgttgttgtactcacctatctagttctggccggtacgggtttagcaatttaattactttatgttagagtatatgaataggactctagtattcgtttgtgacactggaaaggatttgtttccatctatatctctagttttacttgagattgaagtcatgtacttctctctctctctctctatacacacacacacacacacacaccattaatcttctctttctatactattcaacactctaggaattgat

SEQ ID NO: 46961 - DNA, 1642 bp, Oryza sativa
tccttcatgcgttgagtaatttactgaattaacccttaagataatcccaatgtgcctagcagctgatagctgagaagggaattaaacgaatattgtttggcgatgtgcgaaatgcgctgaaagggatagaagggtgtgggagatttctcatgaccaatataaggtggctcaatttgagagaggagatttttactgaataaaaaaagtaactagcctgtcatttgcctctagttatatattctattagcaacaaaacagctgctggacattttcgcagcgaagggtagctatgtatccaagcaagttactcagcgtcttccagtcaatcaaatcagccattccaatccctaaggcgagatttaaaaagtacagtactacatttagaaattaaggaacctagagaaaacagcagacaaaataacactgctgtaccccgactttatttgtttaaccatggctatatgaggcacaaagaaagagctggaaataagagggataaaaaatatccacagaaagaattaatatactccctccgtttcatattaaaagtcattcgatttttttttgtcaaaattatttaggtttaactaaatttatagaaaagattagcaacatataacaccaaattagtttcattaaatttaacattgaatatattttgctaatatatttattttgtattaaaaatattagtatatttttctataaatttaatcaaacttaaaaaagattgtgtaaaaaaaaagtcgaacgacttataatatgaataggatggagtagccatgaagctctgcaagaaacctcctacaataggcaactagttggatggaggaaactaagcggtacacttcaatcaatcgccagctaaataattctctaatcccctccttttaggtgagaaaattttgtgcagacaagtcgatttgtttactaaaccctaaaccggaattgtctctcgccatgattggggctgagagcgacgcatgcagaggacagaaatagccattcattcgaagaacatatggagtattgtcgaacactgcacagtgccatatgggttgggatatatatctcgatcaatcaattttcaatccagagtgcacgtccatgcatgcaaaggtgaaaacgtgtaggttttttgcgatcaattcatgtctgaaaagtgaaaagttccagtgacttggagaaggcaaccaattaggacatgttaacaaccttgaagtgaattgcagcgagctagctgctcgtcgttaattacttgtaccgagtaccgaccgatcgatggggatgcaaatctatgttgattaggaattaatacatttttatgggaagtgaaaaggagaggaccgatcgatcgaccaaggtgatccaccgacagtttaaattcttactagatctcaactctggtaattaagaatcttcataaaaaagataaattagtcacaaccttaccttactgttgcctgaactttaacctccaacagtattatttctacgtcagagaatccgtttcctcttatccactttgttatcatttttaactctaccaaattttaatattattaaattttggtaggacaataaaacagtttcctcatgttcactttgttactatttttaactgcaccaaactttaaattat

SEQ ID NO: 46962 - DNA, 1918 bp, Oryza sativa
tttcacatttacaatcttccaataaataatgcaactgcgttggttgcaaataatagccatggtcacagccacgtatagtttagcttcgagaaggtttaaaaggctttctattcgaggtaacacactttcaagaaagctcatgtgcttttcccgtagaggtcaattgaacctatctgaaaccttggattgccattagattctctcactcgcagaaaccgaaacctgtcaaacgcatataaaacattgttagccaaaagggagaaaattcagcaatcactaccagcagatagatattgaacataccgaaaagcatttgctttatatctcttgtccacagtaaatgttttcctatagaaacgactgtcgaaaattacagaactccgggcgtctattgtattccaggtggagcctccatcagtgctcccttcaagaaccctgtgacacaattgcttgtggctcatggaatatcatcgctttaaagaagattcaaagaaagcaaagctagtgccatatctatcatcaacttcaattgatgtttgccaaaaacttgtgtctcgtaagttttaacagctttatgccttttaaaatcttagaactaatcataagtcgtagcactttattccttagaacttctcaaaattctgttaacaattaacaccatttttccccacaaaaaaacgattaacaccattttacagtattaaaaacaaaaactatagagtgcaaggaaatatgtcaaaacagaaagatttccaaacttttcctggaggagcataagagaaggccaaacatttgtacaggttctctacagttgctggtataagagctgggtcctgcgataagtatgtctgcttgagtggatcaaaagataatggtctagcctaaaaaagtagcgccatgtcaaaacaccggcattgcaaaagcccaacagctaatctaacattttgtattgcaacaaacaatggtaaccaagacatttgcaggtcccactagagccgactacccaccaaaacaaagttcaattgccaaataacaacaatttagcttgtaatccagatttattttaatattatattttgtcgcccataattctcttaaattgacatatcttgttgcatacttcatgttactaggattttggcactgtaatggttgcttatcaacggtgttatgtgtgtaaaaaggtatgtaaggaaacaaagttgctataccagtccattggatccctctctggaacatcattagctgacatcaaatcatatgaatccaactcgcaagtttggccatcaagcatcttgtaaattatccaacatcctgaaaaatgactatgttagataatataatgggaacagtgaaaatttatgtttataactatttgaaacacatgttcttttaaacagcatgaaaatactgactggacactaatacctttttttttcctttagagaatactcaggagaactctattacttgtattaagacagaaaaaggagaaaagctccactcaacgacagatgtttacaggggagcgctcatgaaagacttcatgacctagagagcacgaaattctaacccacgccaaaaattggtgaacagcttaaatttcaatgtgcatattggcaatcagacaggaccagaagcatatgaactactcatatagaaaatgaaattctgcagcaattatagaacaaaccctgcaattctaactggatcatcataaactcaaaaatttaagttccaatctagcaaatcaaaggtagatagattcatctggagaagaaatgagatgaaagtaatatcaatgacatttattcacaattattacaccaacagccaaataaaaggattcaactatatgataaagcatgggcaccatcattttcatcaaagttgggatatcgacagggcacaaactaat

SEQ ID NO: 46963 - DNA, 2483 bp, Oryza sativa
actagtggatcccccataggcgtgacagaataccaaattagaagcagtgggtatattcactaacctcccatacaagtttgaaaaacactctgtccacacatgatcagtgaaatccagaatctataaattaaattactcaggtaagcaaagttacagtatattgacaatgctagaataaactttagtgcactcgttcttcttccaaatggaactgtttgtgaacattgaaatagaaaaggagtgttatattgcattacacaagagcaaagaccagtcatcagtaattagtggcaacataaatttaggcatactaaggctctgtttgctattagagtggatcatggtaaccttgtttggtataactgttttaagatgttttggtatgaatcatgtgaataacaatctgcatatgaatcaaatttctgcataattcagctgacatcgaacatacagataattgtgcaatagttaaacaatcgcatccacatatttttataggatccaattgtgaattcaagtatcacagaaacaagttttgcatgggaaaaacctaattcatatttgcgcccaatgaaattcgataatcagacaatgcagataatgcataattctttatcagttttgggtttgaccactaaattgggcattaagggtgaaggtaacaggcaaggaaagagacttccaagatgttaagggtgaaagtaacagacggtcagacaggaaaaccaaaagtatactgacaagtggacgaatggagagccgcttacaattataagcaaattgtatatcattgtggataaaacaaatttatgaatattatggaactaaccagacgagcttcatatccaaaacttcgacagtagaatgtaaagcaattggcccattctccacagcgtcctttcctagtttctagaagcttccaaagcaataaatattggaacagacaatttgaccatcaatttcagtttggttgaaaaataacaccttatctcacacaataacaggacttattcataccttatatggatcattatatcttggaaaacgggtggtactagaacaatagttgcacctaaacatagacatactcagtatatgcaaataagaaaatgaaaatgatcataaagcatcaggcataagggctgagccctgacgggtaaaagattaagaagtgcatttggtctctgttccagtgtcatcaacttattggtgagacaacttagaacagagggataccttagaatattatgaccctggtgttgtatttcacctatctctaactggcataacatagatgtaacagctaggaaatgagcatagcccgattcagcagttatacacaatgctgctaggactaacctgtctaaccagtactacaaaataccatgatacgacacaataccatgaatcattcaaattccaatgctcagtgggatctttttcaggtaacaccatagaatttatgactttgtttactttccttacttcatgaaaagtgtgcaaatctttgcacattccctaaaaaaatcttcagagtcatgactttctaactaaaacctatcatcactgtattatcctgatcttgttgacaaacacacaaaaaaaatcctgcctagaccatgatagtgacagcatttgctgctcagacagagatgtcacaaagaagtgcaccttagatttgccttaagctggaggtacagttgcagggtaaagaacagattagaatgatagttgacaactgttgcatttgaagcatatggaaacaaaccttattgacaccttaacatcatgtatgtgggagttcaaaaataaaatagtgctccctccatcactaaatataagccgtattagcttttacacggtctccacattttactttgatcattcataatatattatcaacaactacgaaattaacgatgaaggtactttcaaatacaaatctaatgatatcacatgtgtgacaccaaacatatatatagttagcttaactattagtcaaaaattacaaatgttgatttttcctcaaaatatggacaccttgtattttggatagagggagtacatgcaactaagcttcaggtacaaatgattcttctatttagaattgatgtaaaagatgaagatgtaagaacaattgattgacatctagagactgctacctatagatctcgacgcgattggcaccaaatttaatttctgagggaagtgcggtgcccattccaacattgaatgtttcacggccacagctgtcgcagggtggtgcattgacccatctgcaaacaaaagcatcatcatcacaagatgagcacatatgagttccatcgtaggtctttctatgaaaagtacagtgttctgtaagcatcatgaaagtatatcaacccaaaatgtaaaccaccagtaaatcacaggcaatcccataatttgagctcaaagttatcactagaattgacacctttgttccaaatcaatgaacttgaaaa

SEQ ID NO: 46964 - DNA, 6581 bp, Oryza sativa
gtgctgcctcttgacgcattggatcctcgtactgcattcaaaagtgtcaacaaacaaggattatatattaaatataaatgcaatcatcacaaatatagctttgtatatgaaatacattctaagaccataccatcagaacctggtgcatgtatggctcaactctttctctgaattcctcccctccatcattgcgtatgctgtactgttgtagaagaagtgcctcttcttccgcctaagatttgttaaggaaataagcatagttctgatgagaatgataatttggagtccctactttttccctggatagaatatttaaactaacgattacttcatttcattgtcatgctaggttatgctttgtgggcactgtttagtccatacttataatccatgggtgcgagatgaggcaattctgagcaacacctatgacatttttactaagtaaaatactatacagatatgaattttcagtcagctccagttactccactaaacaataagaagcctattcaaatacccctcatgtatattgcaattgcaaacaaagcatgaacagactgaataaacagttcatgtgtagtctactcacaaaatgcatatagaaaaaaaatagtggaagtagccgtctagccgactcatgcagttgcatgacttgatgatgaccagttccatctaattagataattcatgtactctcacctcagctaacaaggccatcaaaataaatgaatatgatctacaatgagcttgagtcctagattcagacacagaatatgttgcatagtatacatgtctagctgaagaactgaaatcaatctgatcagccaactgagaaaagtcataaagatccaccaaatcagatgagaaccaaactatattgacgggttcttttacacaacatttgcctgcctcccagaacattgaagcaaagactggaaccaagaaaactaaactccattctattgcaagctaaaattcagataacacatagtatccactcaatgacaggtaaaatgagttcaatgtggtattcagctatccaccaactaaaatatctggacaagaaactgcattgtatgctgtattgcagctcagtttacatttgttccaatttgataccaaataaaccaaatcaaacccatgaaacatgagccacctcaaactaaggaaaggcctaaaaatcgaacaaaatgaagttagactgcacctgaactgaactaacccctgctcataaaaagttcccattcaaaccaagacaatgtccaaccagtggtaacagcataagctatccaaactgtaatgtggaatgcttcacgaaattggcatgtagatcattcaactcacttctcaatcaaataacaaagctcaaaggttccattgaagaacctatagaacgcaagttattcaggcaccttaattgaattcagatatttcacacctgcttcaaacctcagctgatgaactaaactggaaccaaagggaactttgatgtataaatcatgtgaagcgactctgaataccattaataactgtgaaacccaagcaacagcgaagccctaattgtgatcaatttcaagctaaataccctactagcccaacaaaagtaagtaaccccaacagtcactagcaaatccaacatcatcacatagtatgtccaacttaaccaagcaaaataaaaggatgtctaagctatctactcgattccaaatgcacaaagctcagctctcagttatttcaattaatcatgtcacacctgaagcatccttgcaaactcctcgtcagacttctcctgcaccctggctgcctctgccgcagcgatgtcctccccatccccctcactgatggccacaacgcggagaccctcacagatggactccatgtcggttccaccgtccacccttgatccatccgcctccaccacgatctgcacacgccacagcattgcatcacaccagatgatgagcaatgcaaagcagtgcactcggtgctcagatcaaagcaaagtggttgaggccgcaatctgaacctcaggcaaaccgaaaccaaatagaatcatgatgtccaaatcacactaagcagttataaataccgacatagccgtatcattccggccacaatgcagccaaacggcaacccgttctgatcaaaatgcagcttgatttaacacccacttcctccaatttccaaccataaacttatcaaaccaaacaaaatcaagtgacagctacagtcacacactacaacatcgtaaatccatccaacttaaaattaatttccacgctgtcccggaccaactaccacacgtctacgcaagttccgattcgcacagacacagagccatcagctagaggggacatcaatttaacttcggcgcacctgaatcatccgcgcgagctcctcatccgacttctcttgcgcccttgccgcctccgccgcagccgcagcctcagcctcctcctcctccccggtgatggccacgaggcggaggccctcggagatggcctccaggtcggtcccgtcgtccaccacggacccgtccgcctccaccacgatctgcacacacacacacacacacacacacagacacgccgaaatcgatcagagcagaggccagccaaccaaccggaacacccgcggggacggtggtcggtggaggctgtcccgtgcagggcgcggcgcggcgggggggaaactaagtcagtcagtcgcgaaccttctggagctcgggcgggacggaggtgagggagaagatctggaggcggaggatgtcgaggccgtgctccgtgtcgtactccacctcgtgctcctccgcctcgccgcctccgccgccgccgcccccctgccgcacgacgaaccggcgggccaccatcgcgcgcgcgcgcgcgggctctctccgtctcctccactccgcggcgcgtactagcggatacttggtcgcgcgaatgagtccaccaccacccctctctgttagttggagacttggaggggaggaatcgcgtgtggggggtgggaaggcacggcagcattggttccgggcgtttcagagttgttgcagtgctcacgccaacgtgtagcagtggttgatgagatgacttgcgatcagggttgacctgacttgtgccctcttctgtgggattgggatcctctctgccttcagcccctaagggcactatcaatgcgccactcaatttgctgcgcctggtctgctaaataggctgataaaccttagaagacatactatacataatgcaatgtggcctaaaattaggttagggtgtgtttagttcctgaaaaaaagttagaagttcgaagaaagttgggagtttagaaaaaaaattgaaaatttatgtgtgtagggaagtttttgatgtgatatgatgttatggaaagttaggaatagggagaaactagacacggccttagtaaagtctgaagacacaaatagaggctacttggtccacagtgggcaagaacacgatcgagtcccaagtgacgagcttcttctggttgacgaacgtgcttctccggcgactccgaggtgtcgctgccaccgcccgagcaggcaaagctcatctaagaactcttcggactcccgttcggcaaagaactgtaccccttccatgcagtagagcacaaacgtcggaagcgcgcgcggcccccgtcgctgtggcgagctccgccgcggcctcgccgccgttggcatgctcggcttggccctgtgcgaagtagtacacgcgggagtgcgccaccaacatccacaccatcccgcccgcgcaggcatgccacacaaaatcaaaccttttccacccaatcaaatgcaatcaccacaaaagacacgaacaaaccagaactaaatcgaatcatcaaaaagcaacagaggaaacgatacctcatggcttcctccttcgactggcacatatcaagaaccggtgcgcgtgggaagaggaaaaggaaactagcgcgcacggaaggagcgggaggggtgagggcaagcgcggaggaacgagaccaaaaccactcgcgctctccttgccccacgtgccttcgtcgtcgccgaagaacggggagccttctttggacgtgcgtgcttggttttggtgggctcgattaacaacgtggcatcaaaattcctctctgcgtcgacgtgggatggtgaggctgaatgccatctcaccgcattgtgaaggacctaaaggtagaggcgcacagtgctgtgcctttgggctatttttaaccgtttgatctgtaatgaacagacgatatcaactgctacaaaacgctatagtacatcatgaacactaccttgctacagtacaaaatttctgttttactgttttctactgtaaataactgtgtttcactgttttgcactgcagcagcagactcaatttattgtttgcctctgcctttggcccctaaaggcagaggagccggatcctcttgtgtggtgctagtctactaggaaaatcggtgacgtaacaaagagtgcgttgtaactcaacgaaacgattagattatggagtagaaaaatataaaataattacttatgtggatgaattaaattaaataatataaagctaacaatataaagggaaaaatgttatccaacaatattggtacagacagtttttaaataaagcatgattccaaaagcgtggcgcataaatccatcataccttcgttaactgtttagaatgttctaatgacagggaagaacaaaaggttctttttttgaattttacggggtataagcattgtctatcattgaaatattgcacataaaagtgtgacattagttttgtatagtgtacacttagaacaaatcatctacataagaaaatcgatttattgtggattatgagagtagcaatcaccatgataaataagaattagtgtaagtccataaaatatatgtaccttcaaacttgtgcctaaggaatagttagacgttatcaccgatagcatgattatagtcatgcttaagtcataaagttgccacggtgaggaaaatcgtaaggagccatatgtatctgtacgcaggtttaaagaggcaaaccctggataactaattatcagatatgtttatgactatattgtaaaacatttagaaatattacaataataagacttgttgatacgaagatgagcagcccatatagaaaacgacaatattatatagtatatctttttttcttcaaacttgtagaaaatcctgttatgtggtccaactaaagtttcggtgctgccaatgttagtgcatcagatagtttggagatagattccctataatatgtaccaactcggacttgattgcttctatttccctttttctcacagagatatattcatatatagcctatgacttattataccaactttgattgacaaaggttaaggctggaaaatacccgcgcatttgaatgagggtgtttttatcctaatccttatctaccgaacgcggccttaagcacttctagcactatttagagtttcagactattactactctcttcaattaggttctattcaaaaaattttctatcctacttttaaccatcatctcacccaaacatcccttacttaacaaggaacattaaagtattttcttctcgatcttaatatatactaatatactactagtaaataacctaatacttgtaaataacctaaaaatacttatactgagtacacccatactaactaatgtctctcctttagctattttgttacatagtgaatggctcacgtagcatccgtaaccttttataatattgcatacaccaaaaagtcatattattcatcatgttgattgattattctcgtaacaagaaaagtttactatctgcttcatccggtcaaaaataattgatgtttagcacaatattattagattttataaatttattttaatattaaataaatggttaaagttttaaagtttgactgaatttcattatggcttaacaaagtataatattccaccgcaaattattaatgtacaaatgagtacaatccagtatactttctttttattcgcaatccactctacttgcgtgcgtttaaaacgggcatgtagccgtgcttttagcccacgtggaagttaaattaaagttaaacaaatgcattagaaaagaaaaggagaaagaaaaagaaaccctatagaacagaaagcatgaacaaaaaggagggggccaagccgacgcatcttctttgccaaaccatcgcggtgtcaacctataaaaacctcccaaaatttttctcactcaaaccttcccacccaaaacgaaaagatcgccgatccattccatcgtcgcctccatcctcccatccatcccccctcccccaccaccgtcctccggccgcggcgcgcgccggcagccgcggccgcgtccaccaccaccaccaccacacagaggaggccagccagaggcacgcccgccgtctgacgccagccagcgcgggaggcggagcccacgtgtccccctctgctgcccccgcggggcccgcctgtcacccacccctctccctcctggtgggcaggcgaaagcgacgcgtgaagggggagcagcgctgcctgcgct

SEQ ID NO: 46965 - DNA, 2739 bp, Oryza sativa
gcgcctcgcgcgcgatccgcggcggaagtcccggcgatccggcactgatttcggggtgccgccgcggcgacctggggaggtgagccgcgattcggggcctgctggggcgggtttgcgggggttttggtaggaatttggccgggggtggagtggggtggggtgggctacgcgagcgtgtgcttagggcggagattcggatttcgggggaggtggctgcggctgtttggagcggaggggtttaatagctacaggtgagcttgtgcgagagaaacggatggttgtgtctacgtgatccgacgacgagctaggtatagcttgtctgtatgcatgctgtagttcaagatgattagctaggttaaatacagtggtttgatatagagagtaaaccgagaagaaatttcagagacccgccgcggcaataggtgtacgagctgaagcttggggggtgtttggactaacagcagcatgtcatagtggaatcatgtgcgcggtgtgctagtttttggactttgaagcaatgaaacatttgaatgatgttagggttggaagtaaagtagcaaggatgtatctagtgcaggctaattgtgttggtggttacaaagggagggtttgttttacttttcataatgtggttgggttgtccatttgcatgcttccttcatatgacaaagtttaatttgagtatgagtgacaaaatgacaacaggatattgtctgttatgttctgtttaccccagttttttgttgtttagcttgtttactggggtttcatgataatagaaatgcttttctgtttgttttgtaccgctctctgaatttcggcctgtaaagttgtatgcgtgcatgttctgttctatgatatatggtgcaagggagtattaaatgcaacattgaaacgggtagcagtcaataatcgaagtgtaacgtgttgcaccacgcatgtctgttttatctgttagagagtgcttatcaccagattgtatgctcatggaaacagatggtaaccttcagttaaagtagaactgttcatcaactaatgcatcattttggtgtaagtacataatacgaataattccgagtatattcatatacctgaagtgcttaattttattgacacatatcacagtacaatctaatccttgattgaactctgtctgatttcttgttagaaacttagaatcgaactctgtatcatatgactataatgatatgaagattaatctattcaattaagggttgcctattttccgattttgaactaccaactaaggaaattctcttctgttgctagcagcatgtgacgttgatactctaatgatgaaggagcggagctctttatgtgaaagtgcggcagatggaagttgggttttgaaatacaaaaggaaacggagcaagctaacagttagtccatcaagtgagcatgatgcttcctcaccaatactggattctcaaatgaacaatggctccatcaaaaagaagatcaaacatgacactaacatttctccatcaaccaagaagataagaggacatgacggggtggatatctgctctgatactttccatttgtagtttagctgtatatctcatctaataatctccatatctggctttgctgttaatctgtcttgtggatattgtttgtgatttactccttgtggtcatgagaacaggtcatttgatacattaaaacagtttcaaatacaattttgaccataattgtaaaacatctgtagaacctaataaaactatcatatcacaaaagttcttgctgaggcaaatctacacatatgattttcatgtatttaatttaactgtttaaagacatcttggtactcaagttttgaaagtttgactggagaagcatttcttatggcactcatgtaaaatccctcatatctacaacaatggatcaatccactacctttggcaatttgacacatgatggggatgtgaccaaactcttgcagtgtttctgcattcaagatgcatgcctacaacaaatattggagtcccatgtagttatcatacatttgtgtgcgaataattataggaaattgcaaaagcaggttttggaaaaaaatgaattgaatttgagctgaacagtgatacatgtagtcataattcttacaagtttaaggcctgatacattattatttgttttctttgcattatgcggtctaaatatttttacatatacatttcttgtctttcttcagtacttctacgagtgtgtagaatgtgatctcggtggcaatttgctgtgctgtgatagctgtccacgaacataccacttggaatgtcttaatcctcctctcaaggtttgaatcttatccgttgtttcttgttttctttgactgttttttttggggattgtactgattgcttcttatctctttgcatgcttccatctacaatgtagcgtgcaccacctggaaattggcaatgcccaagatgtcgtacaaaaaaagttagcttgaagctcttagacaatgctgatgctgacacctctaaacgtgaaagaacaaggagaatgcgcacaagcaccacatcagatagcccatccccatctccacaaaacaaagcctcttttaacacatcacgtggtgctgcatttagggatgatgaaccaggtgcaaaagacaatgaagttgagaaaaggaaaccattgatattacaaaatgaagaagcgttcaaccaaggaactatctacagataccacatcatcaaagtcagggttact

SEQ ID NO: 46966 - DNA, 3729 bp, Oryza sativa
aggtattcaaacaaaactttgttatgctaaaatagcattggctgagctgaatttgttttctttattttttttcactttttcagaaatgctacttagtgattttgccattgttatacattggtgaacacgttattatgttacttgtgaactcaagaagtatgcactatgttttttcttcctgatcctatcaccatttactagatctacactttactacatttgccaccttctatattttctttttaaccttgttgtatcttgcgtgtcatagtttagcaattctaccataagtttattacctatattttaggaataatagcatgcaaccatcatttctttttgcaaagttctaatactaatatttttttatagcttattctatactgctttctcatattacacaatatgtaattgatggcctttgaattggactaccttttatggttgtttttctgtcttcaagttttactctggtgctgttgtatgctgtggagggaaaatatatctttcgacatacaatcaatctacatatcccataaatgagttagactatccttttttatcaccatttatcttcacattacaggcttactgtatgggtattatggtagtggtgcaacctttttctgtcttggtgtgtctgacctatcaccactgccatgaattgctttttaatacttttattttacaaagataaacttacttgatcatttttttgtttcatcatctggtataaagatttttccatgtcagcttcttctgatcacttctctttggttgctacgacaatcagccttcaccacttttttatgtgcatagtgtcttacctccttcaattcctattgcatgatgaacaccttattggtattcacagctaccaaatgtcctaattctcttaaaagaaaaatgccctaattctctgacatacttgtgttcagaatgctgttcatataactgaaaaggagcatggtggtgcaggagacaaaataacaactcagggggatctgcaggtttgctctaacaactaatctgctagtgtttattgtagatggtggtctgtggagtactgtagttgcatcaagccactagcttatctatataaattgctttttcatcccattaatttgcctttgttctgtctcatttctgagttatctgactattgcaaaacattgttctttgcttaggttgatcgcatcctaggctgtcgacttcagacaagccaaatcatttcacctgcccatgcttcatcagagcagattgatatggcccctcctagtgcatccggtgcaccagaacctagtcaagcccttttaaaaggacttcatgaagaaattcagtcttctaatagtgatactaatgtgacagaggatgcatgtgctgatgaattagcaaacgatggtggggaaaataatttggattgttctgatgctcaaaaggagagtaatgttagatcccatggacacaaggaatcacttaacgcaaaagaaatcatgaatacagcatcagcatgttccgctgatcaaatcgtcactgttaaggatgctggagcagtacagacatatgtaacagcttcagtaaatggtgaatatgagacagtaactgatattccagaagaaaagaatgacaccaaacatccagtttccaaagctgacacagaagtccacactaaacaagaacatacacctgatagtaaattgcatgggaaaatacaagaaactgaattgaaggagcacgacggaactacttatgagtttttagttaaatgggttggcaaatcgaatatccataacagctggatttctgaatctgagctgaaagcattagcaaaaaggaaactagaaaactacaaagcaaagtacggaacaggtttgataaacatctgcaaagaacaatggtgccaaccgcaacgagttattgctctgcgcacttctttagatgaaatagaagaggctttgatcaaatggtgtgcccttccatatgacgaatgcacgtgggaaagattagatgaacctacaatggtgaagtatgcacatttggtcactcagttcaaaaaatttgaatcccaggctttggataaggataagggaggtagccatgcaaagccaagggaacaccaagagtttaatatgctggttgagcagccaaaagaactccagggaggcatgctcttccctcatcaactggaagcattgaactggctacgcaaatgctggtacaagtcaaaaaatgttatccttgctgatgagatgggtcttggaaagactgtgtctgcctgtgcttttctatcatccctatgttgtgaatataagattaacttgccatgtcttgtcttggttcctctttctactatgcccaactggatggctgaatttgcatcatgggcacctcatttaaatgttgtggagtatcatggttctgcacgggcaagatctattattcgtcaatatgagtggcatgagggtgatgcaagccagatgggtaaaatcaagaaatctcataagttcaatgtattgctcactacttatgaaatggtgcttgttgatgctgcctatcttcggtctgtgtcatgggaggttcttatagtcgatgagggtcatcgtctgaagaattctagcagcaaacttttcagtttactcaatacattatcatttcagcatagagttttgctgactggaactccgttacagaataacattggtgaaatgtataacttattaacttcttacaacctcttctttcccttctctagcttcatttgaggagaaattcaatgaccttacaacaacagagaaagtggaggagctgaagaaccttgtagctccacatatgcttcgaagactgaaaaaggatgcaatgcaaaatatccctccaaagactgaacgaatggtgcctgttgaattgacatcaatccaggctgaatactaccgtgctatgcttacaaagaactaccaagtattgcgcaatattgggaaaggtggtgctcaccagtcattgttgaacatagtaatgcaacttcggaaagtctgcaatcatccgtatcttattcctggaactgaacctgaatcaggatcaccagagttcttgcatgaaatgcgaataaaggcctcagcaaagttaactttgttgcactctatgcttaaaatcctacacaaggatggtcatcgagttcttattttttctcagatgacaaagcttcttgacatccttgaagattacctgacttgggagtttggtccgaaaacatttgaaagagtggatggttcagtatctgtggcagaacgccaggcagcaattgctcgttttaatcaggacaagagtcgttttgtattcctgctatctacgcggtcatgtgggcttggaattaatttggcaactgcagatactgttatcatatatgattctgatttcaatccacatgctgatatacaggcaatgaacagagcacacagaattggacagtcaaacagacttttagtttacaggcttgtcgtgcgtgctagtgttgaggagcgtatcttgcaccttgcgaagaaaaaattgatgcttgatcaactttttgttaacaaatcagaatcacagaaggaagtggaagatatcattcgctggggaacagaggaactcttcaggaaagcgatgttgcagttaaagataataatgaagcttctggtgctaaaaatgatgtagcagaggtgagtttaagcataaagaaaaatggtggataggcga

SEQ ID NO: 46967 - DNA, 1079 bp, Oryza sativa
ttttttcttgtttacttcgtaactttacatgccagaaaataaacatgatggacgaataaatactccaagcctagaatttaagaaactgaataagttaagacacgccacatctcagcttatgaaatttcatttctcttagtcttttccagtggattcaaatttgtggtagcacaaatccctacttttgggaggcgcatgatgcactacttagagtcatgcgaaacaaatgtggacaagtgccttctgttcaccaaaacctcatctgacctttcaaaaatttccacagccaccatttcttgtttctacttaaacactaccatcattctttttctgatgtttaggtctttaggacatcgatccggctccaacacaaatgtttgatcattgtcttttttaatcatatattcataaaagatattgaaaatataaccacatgaaattattttcatgaaaaatctactcatatgagtcacatatcaaatcttaatatttttggatttattagcgagttaagatttcaaggtttgactgcagcacgccttctaaaacatcatctaatttagaacagatggagtagaaggtgaggccacgaaatgcaatcatagtagctttactggttgcagctaactctctctctctctctctctctctcatctcagatgggagcagtatcaaactgaggaggaagcatctcttggtcgaggtaagcgtttaaggaaggctgtttcttacagggaaacatttgcaaccattcctaatgaagctttaagcgaggtaattctgcattttgaccttgttctgcatttattttctgttgatcagttagcaatgctggttcataagttaatttactgtgttactaccttctgcataaaaaaatatgcttgcctaaatatcctgtaagggatctgttctcctagctaacgagcataaatttatctttgcatttttgtccaccgtggtccacttattgtggcatataattgctgcaaccctatgaacattgagctttgcaacttttgctttctctataagtgcataaactattcaaagtatgccttatgaggctctctgaatat

SEQ ID NO: 46968 - DNA, 1368 bp, Oryza sativa
  unsure (1)..(1368): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcataaagctcttgaggaatttcaggatatctcttggttttcttcgaggattgcttcatttctgcagttgattcaccgagacgtttagccccagatggctgcacaggattgggatcttctacaattctcaagggatttgcactggaatcatatagtttcatgaattcttcaagtctgtcatcagcataattcttaatcacatggcgctgagcaatcctttccttttgtctagctcggagtttttcactgttacaatcagaagtaaatcaatgcctgatgataagggcacatgcgaaagtaagtataggaatccccagccttagcatgagggagagggagggagataaagggatagatagcatactatttttccttcaaagccagtccagctgcagtgtattctcgctttggttcatcctcctcatcagagtcctataccaatgccagcaaatcatgaaaccatgactcaaaactattgtgaatataagagtgcaaggcaaatagcaaattaaaaactgcactgcagtaacatatctgcggaagtctctgaatattacatttatattgaatgcacgcaatattactcatgggagattaaactattcagggaactctggtatatatctgaattatcagggaacacataagctttcaaatataagcaagtttcaactgttcatttgattctccaagacactaaagtaggcattggttttacttttttcaacggaaagcctgattttgagaacgtgaacatgagtggtagactgaacacacacactatctcgattttaaagctatatgatgcccacagctcagactgtcgttcccatttgccataacaattcaacattacagctattaacatgctttgtcaagctctaaagaacaacactaccaaaatcatatcccccttgaatagccctaactagccgattttccaaaatcgtacataaataagaaaagtgagtcctgcagggtcacaggaattcacatgttatcatgtgtctgtagaattacataggataaatcccacaaaatgaaattatttagtagtaattcatcaaagagcccataataaagagtaatttattgcaaaattattttttgaactatgttaacacaa

SEQ ID NO: 46969 - DNA, 1142 bp, Oryza sativa
gtagctatttctagagttcaaatatgctcctacaccatcatggtgggattgcaccatggtgagtgtgtggagtgatcctgaactgttgctttcctttcttttacagtggtaagcctgaatgtaatcaaacaacttctgtcattttgataatgaaatgggggagcaatgcctctctttctcaaaacaagtttctagagttcaaatttgtcccaaaatgttgatattctccacctaccccccatcacaatcatctcccatttattttttcacctactttctcttctcaacaaatcacaaccttccaccattcaatttcacctacttatataattcccatgaaaacctctagaaatgcttacattttgggatggagggagtaatattcaacatggttgtgttgtcttgcatttattgataatgcttcttttgattcttgtcaacatggctctccaaggaaagatgctgtactttatgatttctcttatcattctaccaccatggctgtgtcttttttctaatgatatggattttggggaaaaattgctatattgcattttgcatttgaagagatgcgtgatcaatatgttcttataaaagattctgtagtaggaagggaacttcagtccttcaaaagatgaagaggatcatgcctttctcttgcaattgcttttctggtttaagcaatcattcaggtcattgaaacacttctgtgccttatttctcagtttttattttctgcatgtcatgtgtgtgcgcgcgctaccatctagtacctatatttctgttacatcagtactctacctaaccatttatattataaccaaagtactgttttcagttaagatacttcttttgtgcgtatgttttaattggcatatttttcaccatttatgtaatagtggtatagtgaggttgttcacagactactgatggacatgaaataccaatgatcttgaagatatgtcaaaccgtataaactaagtacaaacacatttgttctattcggactggaaaagaccactttgatatatatatagtcttgaatctagtttctgaaaattagctctatttgaaacattggagtcaaacaaagcagagcatgaatgataaatgacttgtgtgaatgtgtgatatttgcatgt

SEQ ID NO: 46970 - DNA, 2531 bp, Oryza sativa
  unsure (1)..(2531): unsure at all n locations
acagtgttcacaatatatattggggcccatatatcactgtgctagtaataacttgtacagtaatatggctgggcatgcatgcatgggccaagatgaagctgggtgtatatattactatgtcaatgtgggctccatttatgcatgtaacttgatcactgtttaattcatatcttttaataatttctcttatctttttttccctagcatggcaattggccaaaccataggcagtagtactccagctagtgcatgcaaagatgaaagaccgatcttgtctacagttcctagtgttattgctgctgtccttttcctttttgttaattaattactgttattccccgcaaaaaaaattaattactgttatttaattctgttgtcagattaatttcaacatgtgacttttatcctttggatggcaatgcctttcagtttcaggtatactacgtgctcttggaccaactctctagctatttcctcttgtttcccaaaagaaattaattgaaaggtaagctaggatacatgtcctgcctgtgtttctgcatactaagtacaaatactataataataatctatcttggtctcatgttaattgggagtaaaataattcaggtatgggtgtctatgctgctttagatcgactcatttaagttttttttatcaccatttgaatgggaagttgaccaggagcaaagctaatagattagattcctgcctggtcgacaggaaaaacaaaagaaaaaacagtatgctccacagaatctatactgcgtacgtgcatgtgccatattaaaagcttacacctgagcatctgcatgcatgccaaccaaaggagcccacaagaaacaaaaatgaaaaataaaaagaatctgggcttggcccatgtgatgatttgaagcaacaactctcaactcatccatcagcacagacatccgaggaaaaataacttcgtttttatctctgttcaaattcgtagtagttttgaggtagtatgttggaagcagagtctgcaatctcgattggctagtttaatttccagccccaccaagacgttaattttttttttggataattttgaatgaaattagccaaatttcgaacaaaaccatttgaaatgcacatttcacgccggctcgagatgttttaaaatcgttgagactctaaacccttggttcgagttaaaaagtttaaactttcgaaatcaggcagcaaaacgtaagccacattcatctatatgtaagttttcttccattttcaatgtataggggtgagcgtgaaccaaccaatgaaaacaaaatcagaagctgatatgcaaggtaatgactacaatcaagcatagttgacaagtcaacgtcgatatcacacggattattaaactggcattattaaattaccccctgtaacaanatgttgtaatacagttctataccatatccaacccgagaagaattatcaattggaacaaatgaacatgggttttacaagttacaacacaggttttatcttgtacagtcatttgtattcttggaagttgacatgtccagtggcctgagcatgttcaacggcttcctgtattgtgcaccaagagagaaggctttgatcagttctggtcatcacggattggtataaacaaaaacattttgtgtttttaagagcatcacttaccttttgaccaatcacaccaatttggcagacgccacagcgcaaggtgaagtttgcagtgtctgtgtagctcctcttcctgcatatggcatgtccaaccaatggtgaataagacatatgaatgaacaccattcacatgatgcacttgcgattacatatgatcatgttcgatgatgcaatttactaggagctaaagcttcttcttcctcttcttttcatttttggtttctgggatgcatattttgaatcacttctgaacagtggttacatgctaaactaaatgttctgttcaaggcatcactgatttcagcaaattatgtagatactttataggaaaaaaagaactaagcttgaaatgatagatacctcttttcatccttcacgaagttaagagcaaggccctctactgggccaatcgaccatttgtggtcgacagggaagatagtctgatcaaattcttccggtgcaccttcaaatggtgacatctgaattttgttgataaaaaacagccaaaattagttggcatctcattgtgttttgtttatcgtcaaaaatttatcatgaatacttacagctaaagcatcataatgcagcccatcatagatgagcatagttcgctcagtgtagttcttctcctgtatcaagggatgcaaagctaagacaccgccttaacactttaggataaacaaaagtaaaggaatataagatccaccaacctgaccatacagatcacagcgggttgtctggatgtcatatgcagcaatttcacgcccataatattccgataggatagaaagttcaatggcacctgtacagttgaagaaacagaggtgaaaaaaagtcaaatatcagcaggtaaactagtaaatcat

SEQ ID NO: 46971 - DNA, 20391 bp, Oryza sativa
agagggagaaaaacgcaatgtcaaccatactgaattttgcagcagtaaggcaataattgtaagcctagcttaaatcgacatcatcacatgcgtattggtgcctttatcatacctgagctatacactatctattaaatttattcttttcttctaccaaaagatggtattaaacaaagtatagtaacatagctacttattgaggaaggggtaagaattcaacacagcagctgaacatcaatactcccgcatacagttttttaaaataaattacaaacattactagtacagttgacaaaataacgcttgagtaacagatatgccaatggatctaactgaattccatagttatcagtgcatgccatgtaagagttcctcaaagaagtttatcacacgaattgaattaaggccagtagctcatctatatgatagatcaatatcattgccaagctaacaatatcattccatctattccaattaatgcagccacacatgatagtacaactggttttggcagaaaatgactttggagcatatacaaacgtttgataccaaatactataaacatattatagaacacgaagtttctagcaagcatgatgatagctttggttcgagtttgcaaaaatacgagggggatgtatatcattttttacaacatcagagcctctaaaaaccttgaagagtgagagggaagacatatatgcaggtacattagtctttcaaagcagatacctgtctgagctcagaagccttgttcctgttatgctccatgacatacctgtatcaaagaaggtataatcggcaaccgctccatttgcaaaaccatcaataatatatagatagcaccatgattgagaaatcatacccaacagcattgaagaggcaactgttgtccgaagggatcaccctcctcacaacaacaccttccattccagctcagctagaaaccatttaaaaaaaaaaatcactcgtcagaagaaatgaattgcaaaagtagcgcttgtaataatcactgccatcacattaaattgacagtatgaaggacagcaaatgcaaattactagaggcagaatccattccaatcaatgaagaagatgctgtggttaaagcatcaggaaagtaaaaacattatttttagataagcatcaagtagtaaacatgatgaacaaaaaaaaataattatattacatgggtagatagatacatgatccgctaatcaattgaaatcaaatccccataaagaagacactttaggaactagtacaggtttctaatctttatctaaacggtgcttatcaccatttctcctcctcaatcaggaagagagaagaagctagagaaccaaacacaaggaaaaggaaccccgcaatatatctatcagaaatggcgaaacgaagagcgttcacaggtgaccgaccgaccatctcctgccgcatctgatgccaaagcgcaggaaggcaggcaagaaccggacgctgcacgcggcgtaaaccttcgcacccacctatgacctaccagagaatccctcccgacgaaccccccggctacgagcgaagctacgacgaacagcagagcaaagaagaagaagaagaagccgacacgaaggaaggttcttgtcctctgtcgagaatcaatggaaggaggaggcgttccgcgaacatccgaaagggagaaaggagagggggggaatggaagagcgagacttacgaggaggaggcggcgcggggcgagggatccggggtgctgtccgggcagacgaacgaaatcgtgggggagaagaagaggaggagacgcgcgaggagagatacgaacgagagcggcgaggcgatccgagacggatctgaaggccaaaaagagggcaggttggtcgcggcgagacacgaggaggccgcgtccgtgcgccgcgagggaggctgtggcactccacgataaacatgtgtttggatcaataggttaacatatgtgtgtccaggttcatagctcaaatttgtttttttctgggatggaatagaaggtcacatcaaacatactcccttccgtccgtcctgacaaaaaaaaaatctaacaacgaaatatgaatctctcttaggttgagtttatttctagaacgaagagagtactttttcagatttgtttggtttcgagatcggtaaaaattggttgatccccacggagaaatatttcttcaagattcaagtcagattcacaatttaaaaattgacagaccaattcaacacacttcatctctgtcactgacatgtgaaccacactctcttatccctaaaaatgcatgaccacttcatatctctctctgtgttttatgttttatgtcatgccatgcaaattgtgcattatttgattgagcatgtgtacattgcaacaaagactacccatttgccctcttaaataaacgattcgagatttaaaagttgaaaaaacaaacatagaaacactcattcagacctcacaaaacatgccctactatatatatgtcactcgagtaatgtttcactaataaatttacatgtgtgtagcaaacaatagcagatctaatatgagtgcaaggagagagaggaagaattttgtttggggggaagggggttagatcatcactatttagagcagggtcaataataaagtagtcagttggctccaattatatttataccagttcatctataactcactttgtagctcgtacatacattgtattgttgggccctacacacttcacatcattattaaaaaaaaatgcagcattgaccccatgctgcagcatctctctcatgcccgacgcttttgtcttgagacgtgtgctgcaacctggtgataaaatcgtcgcccgcccgcgcctgcttaggttctctttagctctttcctccagatcagtattgcaatctacacttagtgtcgcaaactatttctcgtggatttccccctgagtagcaaagatcgaatgataattcattattttcttttaaaaaatctagatacgtgtctgtcactaaataaggcaaaacttttttttagaagatctcctgcgcttttctttttcaagaggaaaggttgcggggaaaagaataaaggctctatgtcaacgcgaagagccgcaccaccacacgcacacgggagggaacccagccaacctgtacacacacacctcggtggggtgccggccggtcaagtggcaggcgaatccgagcctcccacgcgaggaagcaaagccgagcagagaggccttgcgttgcgtgcgcctttgctagcttttccacgggcttgtttagtggtaaaaaaaaaaatttacccctacatatcacatcagacatacggacacatttaaagtattaaacgtaatctaataacaaaacaaattacagattccgccagaaaactgcgagatgaatttattaagcctaattaatttgtcattagcaaatgtttactgtaacaccacattgtcaaatcatgacgcaattagacttaaaagattcgtctcgcaatttccttatgaactgtgtaattggtttttcttttctgcatttaatacttcatgcatatgtacaaacattcaatgtgacaacgtaaaaaatccaaacattcgatgtgacgacgtgaaaaattttgtttgggaactaaacaggccccaacttgctcccttcttttccttgccccagattcctttgccacaacatggagaaagagatatatgcccagtgttgtgatatccaggttagataagattctggaaagttacaggagaataatatataagccgatatgatatgcttgttggttcagtgcatgcacaagagaagcttctcccaagaacccatggaagctctgcctctactcatgtttgttatggtggaagttgcagggccagggtagctgctcctttaccccaatcaccatccatccggcatcaaccaacaagagtccaaatcatatactagtaagcaaaaaccagccattagtgttgacgaccaaaataaccaacaaaactacttgccggtgaaaagtaagattctgcgcctctctgccgctgacattcctcccttgatttctttcgtgagtggcatgtgggtgggtcttgcaggagcaaataagctttcactgacatcatccggcccccacacgctttgctgaatgcataaacaccagcattgcaatttgtcaacaatttatgcatggtagtatttctgcaagaaagcattatcacctgggagtagaggcgctctagtatgcactagcttttggacggagactgaataagctggcatatttcttgttcttccaacacagaaggggaagttgatgtgcttccatgctgcttcagaaatgtgtcgtttgccaatcaagagcgacggcaatggcggatcagtgaggtaggttttgttatcggatctgcatttgaagcaaaatagactgggaattgataagcgattggagatactaggtaaccaaatgcgttttcaaaccaataccaaaaatattgaagtacttgggagactagctaagtaaaagctcaggagcataatacaatactaaacacatgaaataatcgaacatgtaaaacggtgcagctacgatcttagggttcaccaagtaccaccagagcttgttgatgatgatcaaggaaggtaggtacacctatatcaagcttgacaactcctccctaagttgttagaagaattttgtcttgttatctctatcgaagtacagaagattatggcaattaaacctgtccgttccaaagttaacattaattacttatcaatacaagggtgccttacatggatcaaggtactaattaaccaatcactacactcaaattcaagtttgtagaacagggctagtatttaattaagcaacttaacattcatttctctcttaacagtcaaaccataagaatcttgaaacaaatcgaagatgacaaattatccaatatgctccaggttatatatacttttagaaaaatcactagttaccttacctgcccaataatgagagaagctacattgagagtggatgtgttgaaaccctgctcaagaagccatgaaagaaacatctgatgtaatcacactctggccaggtggctttctgcaaatagtgtcatctcttatcttccttctaagagaatcaacttcatgccacaggttttggttagcataaatgttggacagaagcacaccagcacctcctttatctgagcgaacagactcaatcctcttgatcactagttccccaatatccaattcattgttgatactgcaagcactcaataatgccccgagaattgccaagtttggctcaaaaggcatgctttcaataaactgataaccacgtgcaataagccctgccctgctgaaaagatctaccatgcaaccgtaatgcttgatatcaggggtgaccttgtactcattctccatggaattgaagatagatattccctcatccaccaatccagcatggctacaggcagaaagaaccacaacaaaggtagtcgaatctggcaatactcccgcctctttcatgctaaagaataaagcaactgcctctttgccatggccatgagaagccaaccctgaaatcatggccgtccatgaatgcaggtccttctgaggcatcaaaccaaacaagccacgagctaactcaatgctgccacactttccatacatatcgatcaacgaattcttcacaatcaactctccttccaaccccaccttctccacatatgcatgcaaccctttggcatactccagggagcccagtccagcacacgcagaagcaaccgacacaaccgttgccacattaggcctaacagcctcctcgcagcttctcatctcctgaaatacctcgacacctcgaaggaacatcccagagtccacgtatcccgacaccatgcccgtccatgcaaccacatccttcgcctgcatttcatcaaacaccctgcgagcggcaacctcaaaccggcaagcaaagtaggcgttcatcagcgccgtctgcgtgaagagcacggaactgtaaccaaggcggaggctttgcccgtgcagggattcgcagagaggacgatcaccggaagaacaggcatggatcaagaacgggagcgtgtaacgatccgtggtaacgcctcggtggcgcatttggtcgaacagctggagggcgagacggggaggcgaggcgcggatgagggagttgaaggagaagggcgagagggaggaggcggggaggtgggagaggagcaggagggagaaccggagggagaggcgcgaggaggcgacgaggaggcgcgaggcgacgaaggggttgcgcgcgaggccggagacgatgcagtgggagagaagaggagcgaaggcgcggagggaagcggcggggaggaggagcgggcggaggcggcggtggcggcggaagagcgcgttctccgccgcccacgccggaagcgccgcggcgtgcggcggcgacggcggcggcgccatggaaattgcaaacgctcatctcgtccgcaaatacgtatttcaaaagcgaaggcgtaatctggtagaccgcttttgaaagcgagattagctcaacgcgatgatttcattaatcacggaacatgtatacatatagacctcatccataccttaaccactcaaccgacttatagcaatagaatcgggaggattaggacgagagatcggatgaaacagaaagacataaacaccgcaagcgataatatcgctaacacctccccgcagccggaacgttgttagagcgaacgttcaggctggaccggaactccgtgaacacaggagttggcaaccccttggtgaagatgtcggcgtattgggatgtggttggcacatgtagaactcgcacagatccaatggcgaccttctcgcgcacaaaatgtaaatcaatctcaacatgtttcgtgcgttgatgctgcactggattagttgagagatacactgcactgacattgtcgcaatacacaagagtatctcggactggcggggcatgcagctcggtcaagagttggcgcagccaacaggtctcagcgacggcatttgcaacagctcggtactcagcctcagcactggaacgagagacagtgttctgacgcttggaggactaggagactaggttgtctcccaagaacacagcgtagcccgaggtggacttgcgtgtgtctggacagccagcccagtccacatcagaataggccaccaagtcatgagaagaagactggcggatgtgtagtccaagatctgtagtgtcgcgaacatagcgtaagatcctcttgagagcggtgagatgagtctcgcgagggtcatgcatgtgtagacagatctactgaacaacatactgtatgttagggcgagtgaaggtcagatactgcaatgcacccgcaaggctgcggtagtctttgggatctgcaactggggaaccatctgtggaggatagcttggaggtagtatcaacaggggtgttgcagggcttgcaatctgtcatgccagcgcgctccaagatctccaagcaatactgccgctgtgagagaaacaaccctgaggactgacgagagactgaaacaccgagaaagtgatgaagctcgccaagatccttcatggagaactctgtctgcatagatgagatggtctagcgccggagcgaggtggacgaggcagtaagaacaatgtcgtcgacataaagcagaagatatatcacatcgctgtcacgtctatagatgaagagagacgtggccgacttggcctcaatgaaaccaatggattgcaagaaggtagcaaagcgattgtaccaagcccgtggcgcttgcttgagaccatagagggacttgttgaggcggcagacggagttggggtgggcagtgttgacgaaaccagatggctggatgcagtaaactgcctcggccagggtaccatgcaagaaggcattcttcacatcaagctgatgaatgggccagccgcgggagacggcgagattgaggacggtgcgaactgtggccggcttgacgacggggctgaaggtctcgtcgaagtcaatgccggggcgttgcgagaaaccgcgaagtacccagcgagccttgtagcggtccagactgccatcggcgtggaacttatgtcgaaaaatccacttgccggtgacaatgttggcgcctggtggaggagggacaagatcccaagtgcggttggccatcaacgccgagtactcctcttgcatggcgtctcgccagttggtgtcagcgagcgcggcacggtaggtgcgcgggatcggagacagggtagcggcttgaaggttcatacgtgtagtgggtaccggtacaccagccttgcctctggtggtcatgccgtggtcgttgtcaaccggagacttgccgaagccggtgatgagcgggcgtggaagaggaacgcgcgcactccttgcgcgggtcggaatcatgagcggcggtagaaacggtgatgaagcgctagaagatccgtcatggggcgacgtggccgtgcttgggggagcgcgcggcccagcatcgatgaggtcgaccgaggtggccgaggtgctggggaagtcctggagcgccgtgtgctaggccaaccttgtcggtgttggagtagagggtggcccagagacagccggagagttcgcaggccgtgggctagtgggcagagcaggcggtggtccaggcggtgtagtggagggcccaccaagcagccgagtggagggagagggcccaggccgcgcgccactgggcctgccggagccgatcggcgcctgtactggagcagtaaaatcatccaagaagaagagatcagtagtacatgtgtcaacagtagagttctcagcaaaggggaacgtgttctcatcaaacacgacataccgagaaataataaccctgttagtaatgggatcaaaacaccggtatcccttgtgatcgctggggtatccaagaaagatacacatggtggagcgggggggggggtagtttgttgggtgtggtggcggataggttaggataacaacggcaaccgaaaacccgaagatgtgtgtaagacgggtggacaccatggagggcaaagtagggagtgtggcgttggagagttttagtggggtggcggttcatgagataggtagcggtgtagagggcctcgacccaaaaggagccagggaggttggcttgaaagagaagcgagcgtacaatgttgttgagggaacggagagtgcgctcggctttaccattttggggagaggtgtgggggcaggacatgcgcatggtgacgccgttagtgaggaagaaggtacgggcggcggagttgtcgaactcacggccattgtcacattgaatgctgcgaatcggtgtggaaaactgagtcctgacataggcaaaaaaatgagaaagtgtggtaaaagtgtcggatttcaaacgtagaggaaacgtccaaacatagtgagagcaatcatcaagaatgactaggtaatatttaaaacccgacacactgggaacaggagaggtccacagatcacaatggattaactcaaagtttcccttagccctagaaaacaatgtagtaaagggtaaacgaatgtgacgaccaagctgacaagcatgacatatggtggaggagccgcctttgggtgaaggaatgaccgaggagtgggccaagcgagcaagagcctcgtgaccgaggtgtccaagccgacgatgccaaagtgtggtggtgctggcggcaaaggagctggccatggtgttgaagaagttcgccggaaaggagtaaaggtcaccgaaactattgcacctggcgaccacggtcctggtagaaagatccttcacagtgaaaccaaacttgtcaaactcgatggaaagattgttgtcagtgacaaaccgatgaacagaaatgagattctttataatgccaggagaaacaagatcattattaagaagaaatattcggttggcataaaaaaaagaggcatcgccggttgcagtgatgggcaggagggaaccgtttccaacaataatgtgtgagggggtagagtgagttgggtaggtgggagaggataggatatcggtgtccgaagtcatatgtgaagtagcaccggtgtccatgtaccggtcagtggaggcgggcgtcgtgagggttcctgtttggaacaaaccagcaagggtttgctggtcccaagcaggcgtcgggccggtagcgccgtaccaggccgaaggctgggccgactgctgtggcgaaggcgtcggaagaaggccggcctggttgtagaagctggctggctgggcgctggaggcctgttgcgggaggccggcagaaggcccagcgagtgccgctcctgcgaactgaggtcgtgggccgaggatgccaggggagcgcagaagtgggccaccgggccacatctggatggtgccggcccatgggtgctgaggtgtgggccagccttgaggagcatgtggctggcttggtccctgggcttgcacgatctggaggccgccttgagacgcttgtgaaccaccgccgccgccgctagagttgttggagttgccgccggagttgttgcgagggcgtcggtttcgattgttgccgccgccgccgcctttatttccgccgccgccttggctggtctggtttgggttgtcgaaacccgtggcatgcgccgggttcatgccgccggtgccgcggttgccgccggtggcggcgatcagggcggtagatggagcagaggatcccttgttacctttgttgatctcggcgaggatgagctggctgcgggcctcgacgaacgacggaaacggtcgctacaagggaataattgtttgcaagtgttcatacttagggttgagaccttgaagcatggcgaggacgagttgccggtcggtgacggggtcgccgagctcgccgcgggtgtcagccatggccttgaggcgacgacagtagtcgttggcgctgaggtcaccttgcacgaagttgtggaattccgtcgagacgtgcatggcgcgttgttctcggtgaccgaggaacatctgctcaaggcagagccacacatggcgtgcagtggcgacgggctgcagcacggtctccaggagatcggcagctatggtgccataaatccatgccagcaccacgcagtccatccgtgcccgtgtcgcttggtcggggaaggcgacgtcggagagaacgtgatcggagagggcatattggccgagcgtgacgaggaagaggccgcgccacttagagtagttcgccgcgccgaggtcgaggacgactggaacaagagccttaacgttgaggaccgacacagcttgagcgtggagtgcatcaacggtgtcgtcgacgagcggcgcgccaccggacgcggcgccggcgggttgctcgtcatgctggtgaggaggcggaacaccgagcgctgcgaagagacttgacaggtcgggttcggggcggtcgacgggcgcgccagcggaagagggcgcgtcgggttgaggaacaccgagggcggcgcgaagcgccgatgcgtcgacagtcaccgtggtcggggaagacgggctcgacgctgtgtttgccgtggcagacgacgagacgacgagggcagagatggcgtcctggacggccttgacagcagcagcagaagtggcgtcagcaagggcctcggcggcggcacgatcatccgcagagactgtgtcatcggcaggacggagcgtctttcggatggcagacgtagcggcgttggttacggaggtaatcgccgcggagagagcggcgttgtcgtgagacgacatagggccggcgtaagggtgagccggcggcggcaggagaaaggtttagggtggagcggaagcgattagatcggaggtatctgataccatgaaagcgagattagctcaacgcgatgatttcattaatcacggaacatgtatacatatagacctcatccataccttaaccactcaaccgacttataacaacagaatcgggaggattaggaggagagatcggataaaacagaaagagataaacaccgcaagcgataatatcgctaacagctttgtttccacccccacataattacacacactggccgctttaattgtaatttaaacagcttactaattaacattagatagattaattatcaatcaaaacctaatgaaatttcactggttaaaagaagtcgcatgctgccgcgttgtgaaattcttccgtttcataggcggcgccatggccgtggtcaaggttgtagccgtagccggcggcgaggtcagtgtacccaaatccatggctgaactgcggggggagaggcggcggcattatcatcggcgggaaggacaacggcggcgcatggacagcgttgccgccgatcaacttcgtcgtggtgtcgtggctcccggggctgtgagagactaacgggccggcgtcgaggtagtcgatgaggttggcggcggcggcggcggcgcccgtgtagtgtgtcatcgcctcctcgacgatgatgtcgtggacgcgctccgacgcctcggcctggaccctctggagcgcggcgagcatggacacgaggtcggcgagccccgcgcggcgcacgtcggcgtcgttccagacgcccgccacgcgcgccgcctcgtcgagcgcgtcccgcctgcgcgccgccgcgccgagcgcgtccttcaggcgctcctccacgcggttgaactcgcgcacgaccgcctcctcctcctccgccgccgccgccgcggcgtcggcgggggagcggccgaggaggaagcggtcggcgacggcggagacggaggggtggccgaagcagtgcggcctcccggcgggggagaagaagacgacggcgacgcgcgcgccgcagagcacggacagctcgctggccttcttgaagactccctcgcggcgcttggagaagcacacctgccgcgcctccttgttctcgatcagcttcatctcgatcctctgccgcccccgcgtccgcttccacctcctcccctcgccgccgccgacgtccatctccgccgccgccttcgccatcgccgccgacgagcccgtacgtgtcatgtgcaacgtgtaggatttatatagacgagaacgcatacatacaaggaaagaggagggaacagtatcagaaaaagggatattaacgttgtgaattttgtactgattgattgatgatgcatgagtacgatttgtgagttttgtgatctgtcaatcagaggagcaaggatgatgatgatcagtcaaagtaggtcagattgtcacggccggtttccatgtaaaagggcacaagaaatcaaacttctgttccaacggtatcttgcctactagttcccaggattagcatcggatgtaacaaaatgaaatgtgaatgtgatgctacattgtccaaaagttcagagataacatttcgtcgtgatggtcgatatggaggatttgtgagctctttgtacatttcaaatgcgcacctggttgatctcaattataccatctgcatgaccacttgattacttatcttattatggtggaggaaggcatgcacaaatttatttattttttatgaaccttcccgacaaaaatgccgaattggagggagatggaagatgaactggtcagcactcagcactatgaatacccaagcaattcacagatctaatcgcgccaggtgtaatcattatgagaattgtcatttggattgggataattcacaatctgcaattcagccgagaacacaataaagatcgaaatcttgttatttttcctactcgaaatcctgattactagtatcaaccaaaaccaagaacacgcgaaccatctacacaaatcgcagtacacgcccaaatccttattagctgacaagatccgccggcggcggcggcgccgccgcgaacgcggcgaagaacgcatccgcggccggcggcggcaggaacacgacgctcctggccgcgcacatcctcctcctgagcgggtacctccccgcgccgccgagccccctcgccggcacgacgaagtgcggcgcgccgccctgctgctgctcggccaccacctgcggcggcgtcggcgccggagggagggacgtcggcaggaggcgcgtcgccgccgcggccgaccggagccagcgggcgacgatcctcgagtccctgagccgcgcgagcgcccccgggcggaggaaccggtgcatccgctcctcctctcgcggcgcggcgcggtggaggcggcgtcgctccatcgccggagatagctgggagggagcgaggaagggatccggcggcggcggcggcggagataattataggggaaggaggcggggggaagcgagtagtggagggaaaactatggcgggaacgaaatgggagggaaactggaaaaagagggagatgaaaccacgacgcgcgcacagcaaattggtacacgaatgataacactatgtcactgacaagtgggcccactcacgtgtctatcggtttatcgtcgagagaattttaaagtcacaagagtgtatggaaatggaatgccagtgtttgatggtttgcagtttggtaaaaattcagcgcgaattcataatgttttaacccatgtttgaattccgatgatggcagagagactgagggcttgtttactttgttgctcaaatcaaccataccaaattttgacacattgtggcattatcaaaatttgatagcgttgtctttgttttatttgttgcgtttgtcaatatttggtagagttttaagagatagttcgtagaactgccaaattttggaatttggtaagatagtaatggttaaagtgtgtttaatttggtctaaccaaaatttaataatgtcaaaattttgtgaggttgaaaatggcaccaaaccaaacatgccctgaattgttactctcagcagtatgacaagaaaaaaagagtgatcttagtatactactatactagtcatcgaaatgaagcatcatcaggtaagttttattttggtcatacatcatggcagccatatacagtatacagtacaggagatcgatacaaaatgaccacctcaaaaaactcaaaaacattttacctcttctccaaagaatgcaatatcagctggtatacccacctccttcaccgccaccggcagacagacgctacgtaaaattgtggtccgcttcgtcggtgttcatccagacccagttacagaaacgaatcatcacagctaaaaactacacaagaattacatacaaacagaccgtggccaatgtacagcacacctactataagcaggaggaagttcctgcttgtgcttccggttttttccttttttttgtttgaccggttgtttcggtcacgctagaaggttgcgttccaaagcgccttctccccttcggcgcacttattgtgcacctcccagatcctcccctccgagttgcatatgccgctgcatctccagtcgaatgacgcggcgcaggtgttccccgcctgagctttccactcgcaatctgtgatcgacgacacgaaaatgtgactcggttcaaatgtttacgttgttcgtccggttggtattgctaggtatgaagagaagcttcagataataaatgcaagataggaggtagggagcttaccaggcggagtaccacaacaaagtctccggtcgtcgatatgctcgacatctaatccaataaaccaacttcctaatgaaacatcctcatttatatacttgtggaggacatgtctagcaattggattagaggaatcagcattagtttgtgcaacaatgagaacaaggcgtgcatgtgcacacaggtaaatatgaaaacaggtgttatctcacctgtttatagatatgtaggttgctagatcttttgaaatagcatacaattgaccagtagcatgccgaaaatatttgtttcctggttcgccaaatttccaatgctcaggttcatagtatctcacacccctggagacaagggttaacaaaacttagcaaattttgagggcatgagaaaaggaaaggagacattgtcagaaagaacagttaaaaccatgtgatgcacttacttctcagttaggacaggtccagatttcatgcatccaatatatactctgggcttcaatgcatgattagataaaatctgtccaagtgttgctgcaaaagcaaaacaccaatgtcataaagaatcaattgtctatagcagtgatgccctttctacatgcaatgaatcaaatatgcattgatgagactagctgcgtgttatcttgcgaaatatttgaaaccctggttaatgtttctacacatacaaaatggacacttaagatgaccatcaatgagtcaaagagaagcttcaaatacagacatgatggcggcacacagatatgatcactttcctctcatcttaagatcgataaaatgttcaaaaaagaacaatagaagggcataaaagatatggagatttacctatgtttacatgcacgtcatcatcaaccttcacataaaagtctgcatcccacaatgaaacagccgtagcaaagtatgtcttggttttgccagatagtgcaaggtatccttcaacatgatcctgaataaagttagaccacaataaataagggggcgaaatagcattcccagtgattctaggagaaacagtcacttgataaatacgatccatgaaaaaccaataagcaattaagcaagtgcttgtcttacaattctcatgaagtcaccatgttttctgtcctctgcttcaattgctctatcaacaattccacctgatatagcactggaagacatggaatgagtgagttgttttgtcaataacagaaaccaaaatcaaaataaggaaccatgactactgagtactgaaaaatgcaacacgttctttgtacctgtggccaatgacgaaacgaatgatgatccccttctcttcttcaagcttcttccttttttcacctgttttttgtctgttagtttatcgagtcatgccaataaaactatagaagtactgttccttttcttttcagcaggggaacaaaagtactgtccttcacttttttgcgatggaataaacagatttttcttaatgaaacacatattccagattttaatgtcaacaaccttgaggcatccaggtgtaacgtatggaatctcttctcttccgactgctaaatgcagtattgatgccgatcaccataaggtacttccgcctcccgattgactcggaaagtttgaactcttctgcaactggggaaccattgagcaaggactcttgtagagatcttgcagctgagagttctgtctctaagcttgctattgtcttatctagtgttctacattcaaagcatccaaaaataccgatcagaactaaaaaaaaaaaatcaacaagcaaacaaaaatattctcaagaaagacaaggcctgtacgtactgtacaccatgatgagtatcttgaacccgcaatatatctttgtaatcgggatgttggacctgctaacaaacacatgataatcagctaaagatattgacaattactctatacactgcattacaatagaaagaaagtatcatcttctataaaactaacttcatgtaatgaactggactaataaagtgttgaataaaattagagaaattaaaatgggaagaaaagcattacctttttaggaccacactccgcggcaactagcgtgttgccttcgtctccatttccgtttggtcgagcaatctcgtttgcctcaggcagtgtccacattctgaaacaattgatggggaataggtaagaaacatttggtaaacgaaatacctcgggggaggtctttcggcccagctttttaacctaccatcattgtaataataacatcataatgggcgaaaagactagctgaatttgcgaaaatggaactagacatccacaaaatgtggtcatgcttctgcagaaggaagtgactgaagagtggagtgctaaagctaaaatgttgggtgaggatacaccagttagcagaaactcgtctaggaagcaaattatgtgcatatttcaaatgggatcatttgcacagcttgtgaagccaataatctaatgcggtaagtaataaattcgaggttcagagagcgttgacactccaattcgatgtaatcgaggtaaaccaaatcaccaaacaacccccgtgaaagcaagaacacgaacactcctaccaatttacagtattccgctgcaaaaatcaagaacacgaattcatggccacacagtaatccagaccccccaatcaccccagatgcagaggcgcgtcaaatggcacagatctttgagctcggcgcagctcaaatcaacgacccagcactagcgaagctgagctcaaatcctcgaaaattgaagagagcaagaatcggagagcaggggggattctcttgattgattacctgttggtgaagagcaggccgaggcagaagctcccgaggcagagcagcacggcccatctcctcgacacccctccatcccctcctcctcctttcctccagctcatcgccgccgccgctatcttgctcttcttcctcctttctctcctcttcctccgcctcagaatctcatgcgcctgacaggagagcaacccatggacggatcacgagtcgttcgttcttgacttgttttggtgtcctcgatgggtgagcctttcttgcagctcagctctctctctctctctctctctctaccttctcaccacttgagcagcaagcagctcagctcacaccaccatgagacccatgtgggggcgtcggtcgtggtctcgtggaggagacgcagaagcagcgaggagcagcaactagtatactatgatagattaatatgatggagaaggactgaagttttagatccaaactttggatatactcctcccaccaaaacacgccatttctcctgcacagccgcagtaattaactcaactgcaagtctgcaagaagcaagaagcgggcagtgataataactggccgaccgtcaagatcttcggaggaggaggagaagaagacgaggcaggtgaagcgaacgcatcggcttcggcttctccgtcgcttacctagatggatgtatctgaagttctcaaccgtgtttggtttttgagtgtattcttgttttttaatttgtctgtttttgtattcttgtttttaatttgtctggctcggcttcacagttgcgcgcgcgaaacgaacgaacgcacatgggggtcggaggctgcggctgcgtgagaagaaggtggagtgaggtgatgggtaaaaagggaaggggcaaccgactgacgtggtggtgtgtgtgtgtgctggtgagacgtcgctttcggtgggtggtccacgaccacgaactcacgttgctgctgctgtccgcgccgtgcacccgtcggtcggtagcagtgcggtgcgccgtggcagggagggcgccggggggttttcttgtcctagatcgtccgtaataaaataccgttgtctctatttttgttcagtactactccgtaagcgaaattgatgagcatgaacaccggacgtctcaaaagatcgtagaggaatactccctccgataaaaacaatatatttatcctttaagatttcggccatcgatgatttctcgaatgcttagtttacagccaaatcaaatgatataaatagatttgtctcgaaaagtattatcacattggctaaatatatttttgaggggagtaatatgaaagataaaattactcgtttgccactagttgattggtgtttattcatttgctacttattactcaatatgctgtaaggaaatgtaaggatatggacacttgcgtaccgttagtgtctaaggagaagatgtcacctatgattttttatgacatggaggaaaaagaaagagggaaaaaatattagtaagttgttgattaccaatttagcttttagcatacagtttaggaaaaagtacacgcaaggtccctcaacttgttagccagatacaaaatcgtccctcaaccgcaaaaccggacatccggcgtcccccaacttacaaaaccggtcacaataggtccctcgacggttttgaccccggttttatcccacgtggcggctgactcagcgtgggacccacgtgggccccacatgtcaggctgccacatcagcctcctcctcctctctctctctctctcttcccatcttctctcccttcctcatctctctctctctctcccttctctgactcaaccggcgggaggaggagggcgtcggcagccggcgacgggtgacgcgacggcggtgatggcggcgacgggcgacgcggcagtggtggggggaggagctacgggtgggcgggcggcagggagaggcggcgcgcaggcggcggggaggggcatcgcgcggacgggcgacgaggaggggcggcgcgcaggcggcaaggaacaccccccggatggcggggggaggagcggc

SEQ ID NO: 46972 - DNA, 5485 bp, Oryza sativa
cgaagtcgggcgtggagacggtgaggtgggcggcggcggcggcggcggcgggggtgtgaatgggaacggcagtcagcgggggaaggggaggggagcgaatcgagggcggcgagggagaccgggacaggaaggggagcgccgccgttggagaaggccggcgaggcagtggcgcgcgaagccggcggcacggagcgggacggggcggtggcgaacgacgacgacgacgatggcgacatgttcgaggaggaggaggacgcgcgcaactcctccctcgccgcggccgcacgcgcgatcgaggagggtggggccgccgcgctcgcctccgacgaggccgatgccgtgtcgcccgccgccgtatcgtcgccgtcgttcctctgcctcgtgggccttgtggccggcagccggcgggggaacccgcgcgccgctcctccccccgccgtctgcgcgctactcctcgccgcctgcgcgctgcccctccctgccgcccatccgcgcgctgcccctccccgccgcctgcgcgtcgcctctccccgccgcccacccgcccgtagctcctcccccaccattgccgcatcacccgtcgccaccatcaccgccgtcgcgtcacccgtcgccggccgccgacgccctcctcttcccgccggttgagtcagagaagggagagagagagatgaggaagggagagaagaggggaagagagagagagaggaggaggaggctgatgtggcagcctgacatgtggggcccacgtgggtcccacgctgagccagctgccacgtgggacaaaatcggggtcaaaaccaccgagggacctattgtgactggttttgtaagttgggggacgccggatgtccggttttgcggttgagggacgattctgtatctagctaacaagttgagggaccttgcgtgtactctttcctacagtttaataggcatgagatggatggaagtactaggtgggctggaagtgagaaccgcttgggacgacccatcagcctgtggtccatgagtcaatggaccttgtgtaagcgggctaaggagcgggtcccacatattgccagggacacatgttagaaaaggaaattgattgaatgggcatattgggggtatttggatgaatatctgagctttgaatttgatgttccaatccatagaaactccaagaatccgagtgataagcttttgactgagattgataataattttttgagcaattttgcaatccctgtgaaggtaccatgaggtacaaaattttagtgtaaaatttggtacctcgtagtacttaagtaccaggagatatcaaatttacaatataaaaagtggtacctcatggtacctcctaaatgatcgtaaaattgctttaattttttacatagttcgaattctgataggttttaggatacggtgggatgagagggaaaacacagtatttccaatgaagttttggattcgcttttgttttcttttgtataatttggatttggaataaatctcaaggtccctaaaaaccagactagtattggatatgatgttttctagtataacaaatccgaatagaagtatgatcaaattcgttgtaataggaaatatgccatccaatactacattagtttacgtgggacgggcccacaagttccattctcaactcggagtttctgattctcacagaaattgccaactcaaggatgaaccaagaatgtcataagcacacatccctaaatctctcagacccaaacccatcaattttcacgagatccgagaaggtaaagtgggagagctcgaggatgctatatggtgaagtgcttcaacttaagggaagcataagcagaagctcgagggagagatgggtcgccgcggcctccattccctccaaggtccggctcatttgagcctcttagcgagcttgagtttggtgacgtcgtggtcgagctgctacagcaataactgtgtgcgacaaccaggcagactcgatgctgtataccggttctaaatttcattccaatcaaatgatccatagcggacaatacatctcgttaacaacaaggtgttaacctgagcgatactcgacaggattctttctagttgacggattccgtagctttttagatggcttgatccagtataaaccgttgtctcctattttcatgacgcaatctcgtgtatacactagtttcaacgtcccctgtacccttcaaatacaatctgcgagtacaacccattggcagttatatagctacttcttatccaattttacagttgagatttgagaatgcaataaaaactctatactagctatatgcagatttattgtattaggatacggttttgctacttatctgtcgacagttttcagcgctaaaaactgttgatttgttggctgttcgatccggctccaagattcgtgctgggatatttcgttattggatccaaatccactttgtctgcccgtttggcgctgttcctaattttcaaacagtataatgccgcgttagttctgttcttttccagaaatttcccgttggggaggagacccaagcggaggctgaggcggagaccccgctctcgacgattttctcgccgccggcggagaacctgctctcggcgccggtggtttttcttgcttgtgtgcttctcttcatccactcgtgtccatcgtgcccgtagctgatctgcttttaccttgctctcttctaaaatttccaggtgattttttcgctctcgatttggtttcatttttggggcattttagatgttgtgtttagatcccgcatggtgtttgccatataaattgttttaggtttggttgttgttcttctcctagatttatagggggtttgattcgttgatttcatcccgcatgtatagtcgtggatctggggatggaggcgctaatgctttctcttcatggcgaaccgtgatatatgtgtgctctttcttagttatgttcactagatctgatggtctattgtatcgtgctaatttgatttattgcagatctgcacagtacatatttgcatagtttgcagacatcccatttggattgatccctagtatgtatgttctgcgttgcatctgaagcatttgttcagaaaagtttcagatatgcatttgggttgatcccccctagtatgttatgtgacttatgtgtttcaagcatttttcgtttgagtgatgcatggacagatctagcagtatgttcttgatcgtttggttaattggaatggtgggattctagtccaagagatctggttgcaggttttgcaacatttcagtgctcgatgttttcctgttcatgaatttgtatcgggtgcaaccgtgcaagtttggggttgcaatttgcttggattatggtgtgatttgaatagagaagggaaaacattagtgcaactttatctgaatgctgcattcgttgcaactttttctagtatactgcctgttgtttggttgattaattgcccaactccctgtttgtgtctgaattcttctacatttgaagcatttcatttcagagatgtatgtcccagtatgttctaagttgtttagttaaattaaacccaattccctgcatgtgttctgcacttctgctcatgctttcttccgaattattcagatggtatcctgctgtgttgtttgctttacaaaatttctatacatgttctggattcttctgtttctatacatgttctgaattcttctgtgctgattcaaatgagttagcagcaagccaatacttggctcctgttgctttgagaaattatggctgttgattcacctactgcttttcttctgttttgtgtttctgttccctgttaattgctgcacaatcgtaaatccttttgagttggcgttgtttcttaacttgggaacaggggattgcacagctacacaattgttaacctgtttgaattggcctatttttgaatttggggacaggggatcacacgactgcacaatcgtaaatctatttgaatttttgaattttgggaacagggtactgcacagtttcagtcgacatgtacatttaaaatctcagactatggcaaacttaagataattaggcatgaactcagtctaatgcgtgtcagcagtagcaaaaccaaggtcacttcggtgcagaatacatgtttatatttcagaaatgtagatatagtttcaggttgtcaaaatattttgtagatatgcacagttgcttatatttctgatatgtttgttcagatttgtttggtggcatgcagttccattttttttacttttgcttttttaggtttcggtttgttttgaatcataggtgcagtatttttaagtgcagcggtgtatttgggagatttagcttaaatggggttttttgatggatttgaaaaaaaatgctttgcacaatgtgctgtgttttctgtttttgatatatacttagataaatgcctctattcggtggatctgaaatgtgtgggacttaaggttaaggtttttgatggtcagttctaaattatgagaagcatattattttgttttcaacatacgagatattaatctactgcatgtgtgttcttaatccccttcataggtaggccaacagtcactattaattatcatctacacagagcgttatttttttggttgcactatgcaaaataagttcaattatattccagttacatataacttacaacctagttacaaactaattacagtccagttacaacctagttacagtgtgccaatttacagttttgtgctttagaatcatgtattttttctattgttagatttgaattgaattttttattttcccttatgcacatgtacatgtatacaggtaggacacaaagaattattatattttgtaatagtgcttgacgatttatttttacttctgtacatactttgtactctgtactttttaatgttagcagatagcatgatgcatttttagtattttttttgtatgccttatctgctgctaagttatttttccccttacatactttttgcatgtcatattttttttagatgccacttatttgcaaacgaaagatgccacgtagaacaattgacatctcatctgaggaatctgagggtaactctataaattctgaaagtgacacatgcacagggtcagatgaagattatcacattgatgaggtcagtaatgttagtgcactgttttttttgaaactatggtaaatgcattatattatgtttgtatttttgtttgcaggttttggaagcactcaatatatctggatttgacaatatgcttcatgagctttacagtaagaaggtatatggtactgttattcctttatttgttctttttcaatctcctagggaatatattattataaaaaataaatgattctattttcttttataacatgttgtataatacatgtatgtatgtctttcttccagggtataaaaaagaagggagcgcacaatgaaactaaattggataaaatgttgtatgcacttttcaagaaggatg

SEQ ID NO: 46973 - DNA, 34542 bp, Oryza sativa
  unsure (1)..(34542): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacctcttctgatcatggatttgataacagagacgtcttgacgaattcttgagatgtttgatgccatcttattctccacatggcgaggacttgccatggtgcccctggtaagaaaaaccttatatgaagcaattaattaatattatatgtttaaacggtagttaaatggtgcccctaactatatgtttaaaaagaccttatatgttacataaagccatgaagtattcaagacaaaggagaatatgagactaaaaactttcacaggcaaagcttgaatcagaacacacaagtcatgaagactacaggaggaacaaaagtttattgtatagattgcaaaaaacaatggaatccttaagtttaaatagctgcatttgtattgacatttatgtaatgatttcaagctgactacacggtactttgtagctagcctaacaggtaatacaccctgtagataatacgattgcaaaacatcttttatttatacgatgtgcaattatattctctagcaaggaccctacagatcgagctgttccaaccagaaatgatttgttattctaatagagaagacgagaattagtctactgctacctctttaaaaaaagatcaatcacgtaaaattaatgttactatcattaaacaaactatcataatatgtatttctttttatttaaaatatattatttttatagatattgttggttaaaatagtatttcgaagattatatcgaagatcaaaaaatacttatattttgtaaggggagtattgcattacagatctactccctttgtcttaaaaaaactatttctatatttgaatctggatatgttcagatttaaatgtagaaatgttttttttcttttttttaacggtgggagtacttagcataggagaggtaaacaaacaaaactactgtagtacagtaatacacagagggcggcatcagtgttatttctggattaggcgattagcaccagctttgaagcaaaaaggcaaaaattttaccgcatcaaattaaagcacggtcacacagacctcaccatcagacctccacgacgaagccaaactgattgatatatagaagcttccataaagaaaagaggaaaaaaagcgaaccttctagaatccactagaaggcgatcgaattactacccagcacacaaattggcagtctccgcacgaatccccgcgcgcgcgcacgaaacacaacatgtatatgtaatgagaataaacaggagaaataaccagctaattaaggagaaacatatataaggttgcagcacatcgaatcgtaacgagatcacaccgcttggaacatgatcagaggctcacgaaagtcccaaccttttgaagcgactcccctccaggaaaagcatcccgatcacattccagaaccttctacccgctagctttcacgccatgcgctggtgtcgcaaaatcacagcttaagcccccccaaaaccccaagaacactcccccctacccccaccccaccccaccccaccccacccaaagaaagaaagaaagaaagaaagaaaaacagcaagcacgacatgcaagaagccgaactctggtgtggatccgagctgcggatgagtattttggggcaggtgagggagatcggaggacggaaaccctaacctttgcttcgaactcgaacaaaccaatacggggaagagacgcggcgccgaggcggagtggttggggagggaaggggagaaaacgaaagaaaggtgatgctgaggtgcgcttgctactgcgctgcggtgctcatatgcgagatgcctctgccacttatcgggttaacgggtcgtatatggtaatatccatcaccctcagagtatctgcttgatccccttaaaaagaattctcagttcatatcaatattacatcctttccccgttttaagtgaagttgtgtatttccgtctctaacatttgatcgtttgtcttatttaaaaaaattaaaaaagttagccgcacataaagtatttattattcatattttatcatgtgcaggctcatcctgctaacttggtgtgccgctggcaggacagcagatccacaacacttataattactagaaaataagcacgctcgttggcacgttattttcatagcccgtgtgtagtcttaatgttgaaattttaccgaaccatatcagagtcgatgtgactctaatgttataaaatttgattattaaaggtatagttggtcaaaattagcaccttaaagtaaaaaatgtttttttatcaagataaggagtattattaatggtatattatatttacatgtgttttatgatagtttaaaatatacatttctcaatacctattttttagaaaaaataattttagttcatttgtttgtgttctcaaataattatcacgaactcagtttcatttatcatccattagctatatatgtgttcatagttttctttttttcttcgcaacataaataaatctggtctcttctttgggatataatgcgtgcactaaattattacaatcgcaacatacagttattttcatgccctttctaaaaaaatattacccccatcctaaaataagtgcagccatggatatccgtacctaatgtttgaccatccgtcttatttgaaaattttaaaaatatttagtcatacataaagtactattcatgttttatcatctaatagcaatgaaaatactaataaaaaaattttcaaataagacgaacggtgaaacattgaccgtgaatagtgcaaaactgtacttattttgggacggagggagtatattttcatgcctccccccaacattgaaaaaaaactattatcgtatatataaattttattcgatgttcttcaacaattgtacatatataagttaaattttcaatgagcagctcacataagctagcttaatagctacgatacgttgtactcccttcgtttaaatatttggcgccgttgactttttaaaatatgtttaaccgttcatcttattaaaaacttttgtgaaatatataaaactatatgtatacataaaagtatatttaacaatgaatcaaatgataggaaaacaaattaataattacttaaatttttttaataatacgaacggtactctgttaatggacggtactcagttctgtccatcagaattaatcttttgagtaactctgtttcaaaaagatgacgcacaccgtgagcaaccacaaccaggcacttatccatcattaggactgtttttttcgaacgattctccccagaaacaacgcaaagtatagagcatgaaaaaaaattacaactctgggagatcgtaaacaggaaaagaagaaaaaatagcaccgcccacacaccgatagctctagcttacaaacccgggagaaggctagcatcgtaccgaccgctgctaagccaacaaaggaattcaagtgagatcgtctaaaatccaatcctaacaactgacaccaaactctactctagccacatcttcgagattgagggagagagtgagagagaagaatggaatggctctccacccaggccctctgacgtggccatcttgcataagctacggcgccgacacaagaggacataagtctaaagtgagcttgcaccggttgtttgtgaggttttgataaagggcctaccaagatgacgtctctagggagaggagcgaaagaagcaccgccgccgccgttcgtcaaggtctcaaagagaaacgagactgggttttcaccctacacccgctagaagagatgggacgacacgacaacaccctaaagaggagaagtgacacccgaaaagccgtcgttgccggcctaaccaaaacggtgctaggttttcacccgtcgcccaccgcctgcctatccatagcagatacacctttgctccatcatcgtctaaacctctgtcggcgtccctcgcatgccaccacatgggcaccctcatcgtgcgctccacgccgactgctccacgccggcctccagcatgtcgcgttgcgccagcttaccgccaccgccagctatgtgttctcatgttgtgtcggcctcacgccacctccacgcagcactcgccggccacgagcctccaccaagcgctgatggcgccatcactgccagccgccggcaccgcccttccactgacgtcggtgtcgtccatgcacagtagcctgctccaccacacccccattgccggccgccagcgtcaccgcgctggcctcccgccgtgtcgctccgctccgtccactagctcttgccgcaccacacgtcgtcgccgcccacgccggctgctccccgcccagatccgtagggtgttgggtctggctacgctgcctaggaggggggatccggtcggggcagtgccggatccactgccccataccggagaagccgccacctcccacccgacgcgctctgctccgcctcccacatcaaggaggagcttcgccggctcggtttcccttgccaccaccttctcagtcgggctcgcggtttctagcggcagcaaggcgtcgagataggtggagagggtggcggcgcgagcagctaggatttcatccccaagctacccgcatgagagtgacgaggggtttgttagattgatatttttaggacactgcgaaccttgaacaggcaccacatggcaattcttttacccactccctgagaacgcaaaaagctcacctagaaaacacagatacagtacagatgttcgctattaccaaagatcgttactaattttgacacgaggaatcttgggggataaaatctatataccctaactctcttctcaagcatataaacgatttcaagtatatcggctttgattcaccaataaattctcgctgctttatatataaaatgtatttggtacatcataagtttgacgtagatagataaaagagttgaggtaattggttcaaagtaacacaaagataaaattattggattcaaaatgagtccaaagcgaaacaccgataataaaagatagccaaaagtaaaactttataaattttaaattctgtaaaatacttattcatatcatggttgcgtattttcactcttgctgcaacgatctttgcttgcaagggaaaagagacagcaaatgcgcctctgcctcgattcgatcgtatgcctgtttgccaagaggacgtcaaggcggggtgttgacgggatggaacaacgaactagcattgccaacgtacgaagaaacaagtccagctgtcatttcaatggctgaaccaggtgctcgtaataaccaaatgctgataagctgatgtcctgatgggttagtaacaattagtctttttttttttgctcggtgttctaaaaaaacaatcattcacgattaggacaaattattaaaaaaatcgcacgagttatactacctatgtggccctgttaagaaatataaggcgcagtttgactatttagttttaagctttgatcaataatttgtataacaatatttaggttttgttggattattcatgttcgaaagtactttctactccctccgtttcacgatgtaagtcattctagtatatctagattcattaatatcaatataaatgtgaaaaatagatgtgaaaaatagagaatgacttacattgtgaaacggagaaattatataactaagaattcgtaactgtaagagaaatttgtttttggcagtcaaatacgccttatatttctgggcggaggtaaggagatcagtacttatttacgtgcacgcctaattaagcaaactgcttagcggttaagttggggcaatatgtgcccgttaggggagtgaacccgttggtgcaacacgtacgtgcattgccgttttggctgcatgcgttaggtcgtgggccctacgaccatgcatgcatggctagctctgtgcttcaaatttaaaaatgctctcgatgcatatatggctgtgtttaggtagcttcgaacttccaacttttccatcacattaaatatttaaacacatacataaaacattaaatgtggataaaaaaacaattatacagtttgtatgtaaattacgagacaaattttttgagcctaattataccatgatttgacaatgtagtgctacaataaacatttactaatgatgtattaattagacttaatagattcgtctcgcagtttaacagacggaatctgtaatttgttttattattagtctacatttaatactttaaatatgtgtccgtatatatgaaaaaagttttaccaaaacaactaaacacggtctatatatacgttttctatcggatgaacaatatatttttgttcatttgggtgtggatgcgtggccgggtacactggactaaatgataaatgctgggtatacccttaagggatgagaatgaatcgaaactttttgtaataatatataatcatattcagttccatagttcgtctttacattttcgacaaggttgatattaattaaacaatttaaactttaacaataccaataacttttaaagcatttagtttgaaaacattagaacaaacataatgtgtatagattattcttaaacatattttaataaaattaaatgttcaattatatattaatatgaaccatagccaaaaataagtttcgaagaccgtgttgttatccaaaacgttaattaagaaatggaaccatagagtatcatagagtatactgaagaatattgttttatgtagattttgttggaattaatgaatgggccttagcccactcgaagattaattctttggaaaatcacaaaagcccacctcatgggatggcatgcatgtggagtttagtaccaccttgcttatttaggagagggggacctccttaaaaggggttgatagcgtctcttgatgttgaggagaaagctcgggaaaaagatgccgcgtctaagggcgatggtgggcagtccagtgccaatgttgtgcacaagacccagaacaagagcaaggggaaatacaaagctcagcagaccaccaacttcaagaagaagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggaatttacctactgttttttcagttaatcaatctactaattggtgggttgatactgggaccaatgtacatgtttgtgctgacatctcattgttttcttcttatcaggtcgcacggggttccaccgtcctaatggggaatgggtcacatgcttctgttcatggtgttggcatggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagctttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctctcgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaactatcactttcttatttgcgcacatgggggtgcttggcgaaagtcaatgtaccaataacgaagaagcgtaaacttggacctaagactgtggactgtgtttttctgggatatgctcatcatagcattgcctatagatttttaatagttaaatctgaggtaccggacatgcatgttggtacaattatggagtctcgtgatgctaccttctttgagagctttttcccaatgaaggatacacatagtggttcgaaccaaccctctgaaataattctcagttcaatcacaccaccagaacaaactgaacatacacatgaacttgtctctgaggaggatgtcagtgaagctcctcgaaggagtaagagacaaaggatggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgatacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgttttggctacattgatagtaagccttttccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctacggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaactattaataaactagaggagagtaccaatatatataccctctccaagtgaagatgcatatactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtaacttggagtcctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatatggagtttagtaccaccttgcttattctaggagagggggacctccttaaaagggaggatgccctcctagccacttgaagcatgtgtggtggagagaagaggggaaacacacgcgcgcgctcgctcgcctcgcctcgccgggcggcccggcccggcagggcagggcagggcaggcagcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaaaccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacagctcgccttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacagattttgggttggttgaacgaataattagtcgataggtgtggcgcgtgtggagagaagctagggggtagggccacaccctaatctcccttttaaatcctattaaaatgcaatgaaattggaaacataaagcaaaatccattagttgaaatgtagagttggggaaattcatggtctggttactcttcagattcaccgtatatataattaccccctccatttctaaataaattgttttgacattcttattttttaaaaagagataatccaaaaaaatgccattgacaagcgtccaaatcccagaaatgacatcgacaagcgtgagtttcaagaaatgccatcgtacaaacgactttgtcccaaaaataccattgccgttagggttcatccattccgcgccgttaagttctataggatgaacagtgtatttaacggcgcaaaatggacggaaccctaacagtgatggcatttttgggacaaaatcgtttgtacgatggcatttcttagaactcatacttgtcgatggcatttctgggatttggacgcttgtcaatggtatttcttggattatctcttttaaaaaactagcttaaatgactgtgctttgctacatataaaaaggaaaaatatcctaatattttctaaattaaataaaccgtattttccacgaaatatgtcattgtccaaattaatttatatgtggctatccatttagatataattgttacgtaatattaggaagtttaaaaggtaacatggaaaaattaagagagaatcccttatataccactccaaattaaccggttcccttatatgccacttcaaattggcttctcccttctatgccaccggttcaagtttgttatcccttttatgacattgccgtcactccaccgctagttgacatttaacttcatagtaaaaagacgcatttgcccttaagagttggtatacaaccaataataaatatactaatgtagctactggatacaacatatgaaaaatgattttttttcatcgcatgcaattttagccatcaccatcacaaataaattttcaataaaagcatgaaacatgcagttttccaacaatatttttaatacaaagagcattttccactagttctgacaaaattttgttcactcaaaaaggattaaaaataaattagttatgatgttttgaagtttacacattttttacttgagagggtatattggtcatttacgaaaaagtaacgtttaactaacagtcaactaacactatagtgctgggagtagcataaaatggtggaaaaacttaaaccagtggcatacaagggagaagccaattttaagtggcatataagagaactggccaatttctagtggcatataagggattctcccaaaaattaaaacaggagtaaatatcttaatttcctggaagcgcacaacatccatcctgccgagaggcacacagccgagcacgggcgctccagcaacaagctggtggtctcttgcgggcaggaacccggcctccatcttcgtgtagcctcatcgacgtgcgtagccacacatcatatagtgttccacacatgccgagctgatcgctcgagtcggagccacgataaactagcgccgacctccggccacactatagccgccgggccaggtgcccaagttggctcgatgaccacgtgtgcgggccgggacttggcgccacggactccggtaccgtggtgttggacgtcggtgccaaacaactctagtgccgcgatagagtctaaatctaaaacatgtgttttagaggatttatttataaaaaatgtttctgaaaggacttaatgtgaaaaattaaggcctaaaaacctggctatatgaaaaaaacaacaaagtacggggctctcgcgtcgtcctcatgagggtggcttgggggcaacccttagcggcccacgccaccacttcctcaccccatctaaccgcctcgccgtcgctggaaaccgcacgggcggccagagtgttcggtgggacggatccggtcacgccggaggcagatcccctcaccccccctccccacgtggccatatcgggagtaggtgactccgacaagtggaggagcccatggctgcgcaacccggtagaggcgtggggcagtgcggtctggtggatgcacggggtggcgtgacggctgtactggctgatggtggaggaggccaaacgtcgttgccgggagaaggcagtggtaggcccgcgccgtgaggaggcgcggccggtggcagcgaaggccggcacagaaggggggcaaagccagcggaggcgaaggtagacgaggtgtggcggccggtagcggaggccggcactgcgcgatgagggtggtggcacgtggagactggccggcgaggggcgccggtgtagctgtgcccgcgagccgatggaggttagacggcggtggagcgatggtgcatcagctgtggataggcaggcggctggtgaaaacctagcccgaccaatggtggcgttgtcgtgccgtctcatcccctctagtggggttgccgggtaaaaacttagtctcgattctctttgagacctcgacggacagcggcgacggtgctttcgtcacttctctccttggagacatcatctaggcaaccccttgttaaatcgtcccaagcaactggtgtaggctcgctctagattctgatcctcttgtgttggcgtactagattagggaagttggccacatcggaaggcctagggggtgagcggttccattcttctctttcatcctctctctcttattcccaaagatgtggatagagtggggttttgtgtcggttgtaaaggttgggttttgggagatctcgattgtagttctgttaacaaccaaatttgataatctaagtatcggagataaagactagatcgaagcggaatccaagttcgatatcgtatcggaaacagagcaagaatcggctggactccaaatcggctacgaccagatcggctgagtccgagtcagaaagggaaagccgatacagccgattccgacaatatgattcggtttacgtcatcaagctgagttaatatacttcacgtggattgccacacacggatagagtcctaagaagggaattgtatctattaattaggatattttatgtaatttccttagagataagtacgggcaaaaatctgctgcaaagacttatggtatcttagagtttgttagagataagagtcgtgtctgacaaggacatattttgtaatctcgggtataaatagaccccgagccccatgtaatcaattaacacacgttaaaatacaatttcggcgcatcgccacccttttgttttcattttgtttcgacgagttcttgctttcgggttgagctgcatcggtttcgatcttcaactagaggtatgacttgttatggcggcttgtgttctcgggattagtgcttccatcattatgatactctaatcctgtccatgtaagttgtcgagttatcatatatcttatataatctctgacaatatcgctatctaacctctaatcggctaatatctatcactagggagcagccgattaggttaaatatcgacgttggcttagattatataagatatctaccactctatgaagcttccaatagcttgattgtctagatattgtcttttttttcatacttatggttgcatcagttgagtttgacctcataagtcgtgcttagaattataatctctagcctgcttcttggttgttgattagggtagtgtcggggtttcagctgatcttacctgatttagccttatgtttcatgtgcttaattgatatgcttgattcgccctttatattgagatcttattgcttttagatatgttaagcttcttgtttaatatattttactcgttttaatatcttaatatagagtagtatcggagtattagctgatacatgctagatctatcttatcggctatgctatgaacatatataatctcgttgttaatacatattgcgatctaagtgatttatactgtctcggcatggcgaccgatctatcccaatcacttgatttaagtatatatcgacataaagattatatactgttaataactacagccgatcgaatagatttagttcctttattattgcctcgcacagccgatcgatgcaaagatgacatcggctcgagtataaatgatacgtcatcggcgtccggccgatcggctatcatttatggattaactgttattcctgtttcttgttgattgtaggatcaaatcaactgtcacgccctcaaacctaaaggcaagatattttggacctgcactggagttaagcagatctcccaagcctcgtgtttttacatcaacaagttcctttatcatgaaacaaacgatacccacactttaatgtggaacatattgataagtactcatatatgttcaatattataaaaacgatggatagatttgttaaaaatattattttttttacttcaaagagggaattttattgatttcggaagagaggattacattcttggtctatcaagtctaagattcctgcgggagcacacaacttccactcctcacacgatctagacctcatagccatttgagctaaagcatgagcaatcctatttgcttccctcttgatcttgcaaacctgcacactttggagacactacatcatccctttcgcttccttgattgtcgctgcccagggtgatctcgacagctcctgttgtgacagagccttgaacgttgtcagtttccaagattattggcatatgaatccattccatggctacccttaatccttctagacatgccaatgcctcagcttggacagcagtagcacaggatttcagagttttttgcgcagcaagcagcactaaacccctgcagtctctaatgatgattccagcagttgaaactcctgtgtcttctataaaaccagcatccacatttacctttgctgaaccttcgggaggggcgcgccatttatcaacctgattggttgtccgaacctgcactaatttctcctttggttcatcatacattaatccttttcctttgatgtcatcgctttgttgtcggatcagcaacaataccttctcatagttgatgaggaaattaacagactctgcaattgtggccgtcccctttccatggatcatatcattcctgaggaaccatgctctccacagcaagtataaaacacgcgccttgtcagaactactcaagctatccaacaggacaaggagccagtcaggcccagtcatagcaaacttccttttcggcggtagcgcccagaactctctgatgacttctcgcagcgatcacgccatcgtacattcaacagtcgcatggaaaccatgttccccctttacaccacagatagggcagatacctacaggttgtatccttctttttcatttattctcccaagtgggcagcctgctgtgagcaagtttccatgcaaaaatcttaacttttggttgaacgtctgccttccacacattctcccagagcttcctttcaccattggtagcagtgcttgaagaggtctgaacttgagcactctcagttaaattccatgctagcttataggcgcttcttactgaaaaaaggcatgttttctcgtagtgccaagcaggaaagtcagatgtctcctggttcggcacatggatctttagaatagcatttgcatcttcctccgtcgcaacatgtctgattaaagcctcattccaggcgtttgttccagggatcaggagctcatgtacatacgtgagcctattccaattcttcttctgtataacctcaactttctcaccatgcgccacccatctattcctccaaatcttggtagtccgcccatctcttaccctccaaatcagtcctctctttagcaattccagcccatgttcgattcctttccaagttggtgaagtattggacgggaaagctgtatcaataagggagccattggggtagtactttgcttttagcaacctagcgcacaagctatttggctccgcgatcaacctccatgcttgacgtgctaataaagcctgattgaaacaccgaatatcccgaaagcccaggccaccatgaagcttagggctcgtgagcttctcctaggacagcagtataacgtcccgccttcccccaggccaggcccgagctttcataggtcatagactgccctcacagaccaacacatgtcttttctgcacactttgtcctcactcgtgcgcacccgggccaagcattcctgcacacaatttgccttcccccaggccgggcccgagctttcataggtcatagactgccctcacagaccaacacatgtcttttctacacactttgtcctcactcgtgcgcacccgggccaagcattcctgcacacaatttctcggtcggtcatccatcccaaattgctccatgccaagtacgcttaaccctggagttctttggagatcggtttccggaaaagaagttgcaacttgttgatatgagtattctattaatcctattaagccctgggatgtcacatcctcacccccttaagagagatcgacgcccctgtcgatcaaccccaggccaggaacgtctgtccagtgccagcgcatgtgccatgctttcataggtcatagactgccctcacagaccaacacatgtcttttctgcacactttgtcctcactcgtgcgcacccgggaagaatttctcggtcggtcacccatcccaaattgctccaggccaaacacgcttaaccctggagttctttggagatcggtttccagaaaagaagttgcaacttgttgatatgagtattctattaatcctattaagtcctgggatgtcacaagcagatagaaacctctcacaccaatctgttaatctcttagaaaatctttctttgattggttggaattgttctgatttcatcctaccttcgggagttggaaggcccaggtatttatcttcaaaacctgttctttgaatctgcagaacagctttgatctcctcctgcctctcctgtgagcaaaattcactaaacaacagagaacactttgctgggttaataagctgccctgtgcttttctcgtatagactgagcgcctccttcacacttctcgcttgatcaacctcggctttaaagaacaataagctatcgtcagcgaaaagtaagtgggagatccctggggctccccgacacaccttaattggttggattgaaccttccaagctcttcttctccagaatatgtgacaacccgtcagcaataaacagaaacaagtatggactaagaggatcaccttgccgtagacctcttattggacagatgtcaacacaggacattgtccacttcctccatgtatctccaaaacccattctttgcaacacaccatccagaaacgcccaatcaactctatcataggcctttgaaaggtctaatttcagcgcacaaaaattctggttctcccttttgcatttttgatggcatggaagcattcgaaagcgatgagcgcgttgtccgtgatcatgcgacctggtacaaaagcactctgtgcatatgatattacatcatgaaggagcggtctgagccgattaacaaggcatttagctatcaacttgtatatcacattacatagactgatgggccagaaatccttcatctcctccggcgacttagtttttggaatcataactatgacagtgtcatttgctccctcctgcatttcgccgttttcaaaaaacgcttgtaccactctaataacatcactctaataatatttgttaaaatattatgaaaatgatgtagggatgattattggatatgcttgtatgttgatctgtagaatttgatagattgtagaagatgttgtatgcttgcatgagattgaatatgtaattattgtttgatgatgtggcgtggttgcatgtttaactttagagctagtgagttataactttatagaaaatatagattagtatcaattcatcgtcttactttactcgtaaataactttcatataattagactatgggtgtttggttaccgagctatggctgcaccgtgaccagccgaaactgtccagcaagctccaagatagcaggctgcaggcttgtagtcccagcttaccaacatgtccatgataaataaattgtactgtaatttttatgtagtggtgcaccacatttcgataatttgacacaatatttttagtatttgcatttttttctaaagaaaatagtaaatgtgtaccatgtcaattattatgactatgagaaaggtaaaacaattgaaagaaaggaactagaagctcctttaaacagttcattttacagagttttttataactacaatcttaaatcagaagctcatccaaacaatttagttttttttccatattttaagaagatatatttgtagaattaaaaaaaaactagaagccaaaaactatgtttatctagatttctatatttttagaagctaatcagccgcttgtcataatactcccttcgtctttaaatataagtattttggttggatatgaaatatcctgtccacggacggagggagtaaatcttaagggcccatttgaattggaggaaaaacatatgaattttggaggatttcaatcctatggaaaatttttctatgaagccctttgaaacaaggattggatcctatccaatcctttgaaattccagtggaatgaacaatcctatagagattttggaggaaatttagcaagagcttcaacctcttggtaactttcctttgagtatatctctctcatctaattcctgcgtttttcctgtggttcaatcaaacagtcattcctgtgtttttcctgtgttttgtaatcttttattttacacttacattcctactaaaattctacgttttctcagtcctacgattcaatggggcctaagctcagctagagaggccgtttagtcttgtgcacgggtgaggaagtgagtggcgtgtggtgagtggtcgggtgcgaccgttgcgacgggtggtggttcggttcggtgttgtggacgagaagtctcgaatcggcttggctcaacctaaccccataccacccggcggatcaagctccaaaaccctagaactcaacggagcgagcgcgtgggtcgggatgtcggcggcggtgagtgccctccgccgcgccctgtcgtcgtcgtcgtccgcggccaagaccagcagcagcctgcgccgcctcctccccgccgcgccacttcgccgcggggtcctctcgtcgcagccccggccgtcgcgccgcaaggacagcatcgaggtgcattctcccctccctctcttcccttcccttcccatctctagtccgattcccctttccagcgagcgagggacggacgatcgatcgattgattgctgctttttgtgtaaaattgtgtgcgtccagctctctcggagtgaggaggggaggaggctcgccggccgtttcgacgagattgaggatgccgtgcacgccattcttatcagggacatcgaatcctaccgggccagcaccatggccgaccaaggcttcgtcgagagaaggctcacctctctggggttcaccaagggatataccagggaccaagctctttggctttccaagctcgtgcttgcattcttttcttcgtgggtcgtagggactggattcgccaaaatcgacgacagcctccatcaggtcacccatccttgtttgctcatttgcaatttcgcataagctcaactttttgttgtttgcactgcaatttgccaattagtcatttaccatccaccctgctgcagaatctgtgattatcactggagtggagcgttacacatgcatgaattttgtcacccaacctcacagcgatcatactgaagattgtgccgcgaaaaataaatgtgaacgttttatgattctcttctctcaagaacattgggtcgtatcatctgataatttcctcacacagtatgctatcagagtgaaacaaatacatgagaattgtgcatctgtatggttttgagcttaaactttattagaaaggctgtaaacccatgagatgatctatgatcattccttgattttgtggttcatctcttgttttggttgcgcagataatcaattgagctgtttcggttttctctacgtctaaattcactatatctaggaaatctatggatgcttatctagtttagcacttgtctctcttttgatggtgacagtaacattctcttaacttgcttagtagaagtattatgaattaaagggatttaaactacttggctcgggtaacccaagtatatacattcaattattcatgagaaccttttccatgctatacatgaacaagtatatgttgtatgccaacaatttgaaaatggttgatgattgaactctgaaacctgctactttgtgatcaggactgtggtaacacattcccaaataatgtttctccagagtcatgctagattactatcagtcctcaattatactagcatgcagcccacaaattattaatcttgtgtaccgagtcatgcttggttgttaggtaatgattgatgcattcttcatctatatatctatccttccgccatgatttcgtagtaaagctttacttcttttttcgtttcgttttgttttcttttttgaaaaaaaaggcaaaattattgccttatatattgataaaggggtaagaaaacagcatttacaaggggggtgggagtttcggtcatccctgaccagaaacgaggcctactctcccaacggaaggaactcagctaaggactttgctcctaccattatccagagccgtgcttcatccttagttttagccaggatgtccgtttagtgcttgcaagttgcctgaaaactctcgagtttctttctttccacaacttccaagagactaggatgattagtgattttaagtaaagctttactttcaaatgcatagcacaaacaatataatgttgattttgttagtacttacactgtgaaatgttcgattgagctgatattgtgggctttataagttatagcttctagctctgcatctatgctttgcagttgtggaaattaatgaaatttgtgttcttcgaatcaaagtcttacttctatagatcattcgattacccagagctgttttagtctgtaatgcttgtgctcctgccaattttttttttcatgagcaaatttgtgtctattattggcaggtcaattcatgaactgcgccttcctgttggttgacggatggataaataatcaaggatttttttttgtagtgtgtttacgttttaatgtatggtgtgactttaccgtgcggcctactttgtgaagggattatgatttcgagcttgtttttatctcagctgttgttgtggaagagcacatttcgcaaccaatggttcgtatctgtaaaaatttttaaaaaatctttttagaataaagtagcacgtcttcggcagcaagaagaacctctgctgtttcttacgaacctcctcacaccaagttgaactccaaatcagttgctgcatcagcatgaatgaacaacaagtgtttgatgatacaaaccggaagaaatggaatcacagaatgagaaacaatactctgcaggatgagaagaaacaacactctgatgggttcaagttgtggttgataacacgtagaaaaatgaatgaacagaatagtaaaaatatttttatgcgtgaaacttttctatgtctgtattattagtggtttaataaaaaaaaggcaaggctagaaaacaacatatactaggatgaaaacccctaaaatcaattcaattctaaatttacaaaattttaaatttgatttacggttgacaataataataaggggttgttcagttccccaaaaactttttctaaaaacatcacatcgaatctttagacacatgtatagagtattaaatatagataaaaaaaaactaattgtacagtttgcatgtaaatcgcgagacgaatcttttgagcctaactaatccatgattagccataaatgctacagtaacccacatgtgctaatgatggattaattaggctcaaaagattcgtctcgctgtttagttatgaaattagttttttcattcgtgtccgaaaaccccttcgacatctggtcaagcatccattaaaaaattttcattttacaagctaaacaggccctaagtaaagccaataaacagacgagagagagagacgacgaaaggcccacactgtagcaaactgtaagcatgacaagtgggcccggccgagacggaatgagaaaatcctagggttcgttccctcttcccaatccggcggcagccagcgagcgagaggagaggggggaaaccatgcccgcgttctccagggctcgaggcgccgtcctccgcgtcctcgatggcttgaagcgccgtcctccggcgagcggggcggcggatactatggtcccgtctagctacatttccctccggttcctctttttattttcttcttcttcttgtcttttctttgaaccttttcgtgttgccgattcctgtttcccaatgcagagcccagtcaggaagatccagatgcttgaagaggagcttcgtccgtccgggggagaaatctcacgaattctccaacgcgcgcgcgcccacttggaaagacaagaggagaaatttgatcctagctcacagtgagtactgtactattctatctagttccgtagtatatgaagtctcgttgctcattttatttacctttgattcttcatttatatgccgctatgtcatgcggttaagaaacttgctggttaattttgctcaaacaatttcactaaacacacactgcttgttagtcgcttggggatctcaccatctttccatgtgtgtatatatgcagcacataagttcatactcatcgcatcatccatatcttatagccatgagttatcttacgcaacgatcgcagttggtggccaacagccattattattattttttcttgtggtttctgtacaccaccagcttctgctataatatcgacacggattctcattaaaaacagcgttaaagcagtcactttatgattattgtgcttttaggttgcttcatcgctcggttagttcaactggttgatgctttgcaaataccgtgtctcgtctgtttttacaaaacatataattgctaataatccgcatatagacttgggtaatgcattttgtactaagtataaaagttagagctctcttgataaatgccttctttttccttcacgtggaatagcttgggagaatgaatgcttatatagttatattgaattgtctcttttcacatagtgaattgtccagcactctgattggttacaagttgagagatgaataaagcatgcgtcatattcaaaaccagctgtctgtggtgatagttctgaaggcatgtagctatgtggttgttgcatagaatatttaatttaaacgagtcaagcatagtatggttatttcacaaaaatgtatgaagctgttgatatttgtattcactgaatgtatgagatattttatgttgccataacataagaaagaagacgatgtcagaatatcagtgatccattagaatctctacatattcatagtggtataatttccaatcaaccaacagttaaaacaataagaaatgcctatgaagctgacatactgatgctattgtagatagactagtaggacaagatttctaatgttataattcccatattctaacatgtgtaagtgtaagaaatgccaatgaaggtggtaggctgatgctactataggttttggggctgtacaaacaaataattatcacttttgaacaattgaaaacctcaaacaacttgacacatcaactattacacataattttagtcttcttgtgcgcgggaattgtgggatgctaatatgctatgatccatcaccatgtccgtcttgggcaccactctgacccgaaggcccaaatgaaggttgtgttattttgccccttcatctggagattaactcctataacaacaaatatttgtgcacacaagttttaaccttttgttagaaggatcatactaagtttctatcagtaagtttgtcatgtttgacatggcttccataatgctgtttgacattgactttaattaaatttcacctttcattcccacattcgatgaacatcgtggtctcagttatttcagcccatggcgtcactaagtttctgatatagtacttctctaggagcatttgtttgctgaggactgacacattccactagtgatgtgtcatcattataactgttttactattctctacatgcatatatatttctgtacaaagagtccgagacaatgatatatatattttgcaggacgccggagttgttccgtaatggtgcaggttggcaattaaacaccttctttctatgccttttctcatcaatcattgccaactacaagtacaataaggtatgcagtgagatcattacattattctgaatacatgcattatgcataagcacatttaggattctatgaagctagcatgttatttatacaaaccaaccagagtaacaaacttgagaatttggaagaaaacaagcctcaatattgctctgaacgtaggcgcaggcacacagctgttctggcatccctcgtcatatgcaaatacaagctgcaagatatgctttgtcatttggaatagactgaacactaacaaaactactttaactaacagcagaagaagatgtagagctgctttttattgcctctaaatgtctaagttgcgacaaactactccatgaatactggaatttatatatgatctattctgaaatctgaacacaattgaaatgtacaatttttctgaacctaggttcaatactgtttgcattagcatcaagtagtggaattagaagagttttttaatttggaaattaaatgcgtgaacaataaccaatactatatttcctgcaataaggcgttgtcctgtaccttgtgaaagaaatattcatcgatgctcgctgcctcgagtaaagcatttagtgttcaaatgggtggtactcatatgatgaactcgttcaattgacagtgcacaaaacttgagacaccacaatcaatcctatggtaaagaaaaggggtatagatgaatctgcatccagaaaagttgtatctgttcagaaatgctttttcataaaattgtcactgaaaaatggcaaatgaagattatgatattcgttcatcagcttcctttttaaatgtaaaaatggcccactaaaacaaaattcatggtttgttgatcttgagttaaaagtatcttttgaatttgcagttgaataccggtccattattttcactccagacatttcattaagtaatttataggagggaggggcattttggaagctggataacgatggccctagtactttttgaatttgaaacatgttgacttgattaattttatgaaactagaatctttaggagtaaagtcagaatgatggcataacctcttagcctccaaacaagagttgtgaatctcaaaggactggaaggggagggcctttcgattttgcggtagatgaagaagagtgggtgcaaaaaactagaaagctattagcacatgattaattaagtattaattattacaaatttgaaaaatagatttatttcatattttaaagcacattctatatagaaagttttcacacgagacaaaccgtttagttgtttgaaaaacgtgttaacggaaatcatggtaaaatctatatcttaatcaaaaaagaacaggacctaagtagtgatcatacatcacagatggatgctttggaattagtgcaaatatgtgtggtagaagcataaagcaccaccaatacaaaatttgtaaatggtattttgaggtccaagtttggtcaaaacaatccaaatctactaacaattggtagtgcataaacgctagtctattaactccacttgcaggcttcctagcataagtaatttttttgttgtcttcatttcctttacattgtacactaaattgttttggtgcccgcaccgcaaccagttttcagaagtttcttatgatgctctgacacgaattgttgatcaatcttggcaggttgattgagctgtccttgcgttgtggaggatgtagccgagacggaccactggtatttgcccctcagtaaaatttgcctcagtaaatgactagtgtatggttgttttcatgatttgggattgaaattactcctggccggttgtttaaattgcaccatgacgtgtgctctgtgacttaagtagctgagtaccaatggaattgtctagttaccatgttgtggaattgtctcgttataaattgttatgcaactggcgattcacaaaccccacgacgagtctccagtagcgatctgttgctgaaccaaacatgaattcatgcgtctaggaaagagacggaacaacgcgagacgatagttatgaaacatgttacacgctgaacttacacaggaaatcatcactacaagaattttaaaaggcatcagatggttatgaacataatcatatataccacacgaaagtagccgcatgttcaacacgcatcttaattagaactcagaagtgccaactcaaaacaaacaatcagcatcatcatgttttgcttgtcaaaatgtcgcccttcccaagaaagataaagagcataaattgcttgtcagcataacaccacagtccacagtcacatgcttttaacttagttataagcctcttagaattaattattaactactagcatttggttcatgcttctcggttctcccgacctaaacagcaccccaaaaatcaccacggctgcaatctgcttgcaccacagcttagcccaactctgctgttcaccctcccggcgcagactgtacttacatgagaaataagtttagatttagtacacactgctcaaggacaaattatgtgtgtaataaaaagaaacagcgtacttacatctttacgcattcagacagcacgagcccttgctcaacattggcatgcgtgatcttacctatcgctgaaaatatgcctgcctgccctattcagataccaaagttaaaataaccagtcgagttggagaaactatttgccggactcaactcaaatggattattatggtgcgcatgtaatgagggcagtacttgtcagcaggcatgcagcagcattctgatagtcaaacaatgagaagttagatgcaagaagtttctgataacaaaagaaacattatgtggatcaacggaatgcctagatgacgacaaaaaccatataaatctcagcatattaggaactccctggctgtagtcagcattataagctaaaaaacgcaaagtcttgaatctgcagactatgattgtaataatgtagtgcacccagtaaagagatgaacatgcatggtgtgacatcgtaagatcataatattgtaaattgaatttccagatcaattcagaccaagtccgctcaaagtaaggtacgcttggattggatcacacggtaagtacatctccaaaagcaattcaacaaattcaaaatatacacaaccattaaatgatgaagaatgtgcatcctttttcttcattaacctacatccactctaccaaagattggtccaagcttgcaagagtaccatccatttgaacagcataacaaaaatcaattttatataagaacctaatatcacttgtaatgagaaaaattagccagctatcacttgaagtcttggagatgctgttttttagagagaaaaaaacatgctcaacacgctacaatccgtaaaacgccagtgcatgtttcctatgttactaacttctcctatcttcatcaaattaaaggtgaaggcttccaaatgacacaagttttgtatctctcaccacttctcaaagatgggctaagttatttggtgagaggaaggtgtagtattctttcaatttcaaattcttgttagggggaaggtagtactgcactactgcatcatctaatcgaacaatttcttggagtaccaaactaaaataagtaatggagcaaacccaccgtagtattgtactaagtttagcagtagcaacttcaaatcagcactcagcacatttgagtttaagaccttatcacaatgtggatttagtgcgctacttctatcttctcctctacgcaagaaatgtattaaaactttagttgaaatttcaattagttggtatcattacctacgtactggtgaaacatctccaaattagagctcgcgttattgcagatgagttggaatggaggctagtcctctcaaaaaagaaaaaaaaaatgttaccagttcgccaaaaccaaatactatatcaggtcataaaacccttacagaagttccacccagaattaatccctctagaaagcacttttcgagattcgaaaacagacatgttctggcattgaaaaagatctggagaacaacagagtaaaaactggccatggagtgtgagaatggtggaaagtaatacttctactttcgactaatgttcccctcccgtcaccttccccaaaatgtttaatggaaatggacaagagagctggtgcacagtataggtaaatttggaaccatcttgggctttccctcggaagaagaaaacagtttggggatttgggggtactaaccttgttgaatgcagatttctggagcagaagcttgtcaatctcagtgtttgtaagatcaggtcgaatgccacctcccattgctggagagaaggcacggtgagcacctgctgcagatgccacagctgaggtggcgtggtgggtgatcgaagatcgtcgaaataaggaagccatatgcccccctctttcagagctagcagttcaattaattcagttaaaacagttgagtatttttgtttccttaaaaatcagtaccgaattaactagaatgaattctcaatacagaacctaataaacccagctacatcagcagatcagcttgctctttttttttttttggtatctaagtgtatcattactacatgcaagtgtcatgtgaccgttgtgacgtgagttataccacaagtaaagaagagaaaaacctggaatttcaccaagcaaaccagagctaaaaattttaaaaaaaacagaacgtacacaaattcagaagtaaatctatctatccatttattcccaacaacaagaagaaggaattaatcttctggacatgataagaatggttgccgtgccacaatcacaagcgatcacacaaacacgaagagtttttagtcccaaatcagaaactactccagttcttttagccgcggacggggagaagatcagagagaaaaaaaaaatccaaattacttccaactcgaaggctcttgatccgccagcaaagctggtgggcgaaaggaaattaagagacaggtggatgctggtacctggggcagaggcggcggaggcggcggcgatgggcgagagaacagtcggatcgccgggacagaaaaccctagaatatataggaggaaggaggtcggccggaatggatcccctcaagttggggtagaactctaccggtggagttgtccaaatctatgtcatctgttacttgtttccaacggctgagataatgcctcatcagtttcatctgataaattaactccttaaattaatatgatttttaaatcaatttttttatagattttttttaaaaaaagacgtactgtttagcgcaattcggaaaacttgcgcgaggaaaataagagagtatgagttgggaaagacaacttccgaacgcactataagagcgactacaataaaattatgtaagcagattgtacaagttgccatatcatatttgtatttatgtggaggggagaggagaagaaagagaaaaaaacgggctatagatttgtaaccaactattattaaacttgctcaaagattatgttctttcatcccttccaaacttcaactccctcgttcacacgttttccaaattactagaagatttatttgttttaaaaaaaaaaatcatagatgaaagctattttaaaaagttctattaaatccgcggcttcatttcaccaactacactagcaaacacaccctaaaaatgtccaaaatggagtctaatccctaaattgtgttttggaaagaaaaaaaaaaggtactccatttagttctcctaactggcgttccgcaaattggaattccctttcacgttctttactccttttagttctccactaatctcccaattacacgcgtgagatgcagagaatataggaaaggtgtgggaagggatcgtgccatggaggaggagacggactgacggagaacgatttctttttggggcacaaacaaacccttcgatgctcacagatgctcacatcgtccgactgtttgcatattaattagacgcaaccaagcaaactacatacttcgttttaaagtataacaacgcctttaaattttattcctacttaaaacaaaaattgccctaaaatatactatataacaacatttttcacctatattttttctcaactaaatacaagtatacaacattttaccattcaaattccttacccttctcaaccaatcacgatattattctatttaattctactatttttttaattccaatgtctaacctaaaactctttatattttggaattagtatatttggttgggggttgtttttcttcatttcttgggtggccacggttcacgatttcgtttcacggtcccaatgagacgagtaattttgcttccaacaaaatttaacaagaaaaggagcgatttgaagaagctccaaattgacattttgggtgacgaaattcaaagaaattgtgaaccctggggtagccaggattcggagcggctaaaccagtgtttcttcccaattcaaaagacaaagagaagactcagcgttcctttttccttctaccagcaaagctgctgtgtactctctccgtactcgtaaaggaagtcgttttggacagcgacacggtctccaaaacacaactttgacttattatttgtacaaaaatatttattgaaaagtcatatgtatacttttatgaaagtatttttcaagacaaatctattcatatatttttttacattttcaaactcaacaacttaagagttattcatgatttatattcccaaggtttgacttaaacattatcctaaacgactttctttataagtacggagggagtatgaaactaaatgtctccactgcgacatgttgaaatgcgtaggccaaaagtataacaagtagttaataaaaatgtacaactctaatgctgcctccagatcacaatgtaacagatatcagcatagttgaatggaaacaaacagtgcagttaacatatccaaagggagatctagattagatagagacttccacatttgcacacatgggacaccttacatatgtcctctacaggcgggcttcttaattcactaaagattgcctttttttcctggttttctcctcttccatacaatagccagtgaagtagccaccaagaagaacggcggtaatggcccatgatcgaccgatgtttttgaagtgaacctctctccgaacaatttcaaagctacaaacaaacatggaaatcgtttgagctgtgattcaaacaggtatgaaatggaaacaggggaatatgcacgcactttgaaatggttttgcccaccattaccaatggcacggaattgagcttcttccccttaatttcatccagcagtgcatttagctgaaaaaaaaaagaatagcatccatcaaataaagcatgttccatctggtttatcgtactagatatggaactaaaacgcagtatgaaacatgtaccatccaacaaacacctataaccacctagttgcatgcgcaggccgaaaaaatgaccacagatcttgacacggaaatgtccactcaagaactattttcatattttcataagcgccaataaacagaatgaatatgtgtttaccatgaactttccaatggaggcatgagcaaatgaataagttaatatcaacaatttaatcataccaaatcagaccacacttgactataacaaaagatatatattttttgacggttcaccgaggggcgaaatggccacctgaatatattaagtcaaatggtcttacacagggcaaggctttcgctgtgcaaaatatcccgtgatttttttcaggtgctaaagaagacctaacaacaaactagtataagagagcatacagctacacctaatgcgcgtagagaatactaacaaatacaatcaaggatcttattcagtcatggttgtttgatcaagtctgatataacagaataatgaaggatatgaagatggaaaaggtctggtcattgatatgctcaaatgcacaatctgtgcaactgagaagaaatattgttcacatgctctttattaatgctgaaacgtgagaggcttgggatcttcttacacgagtttataaatgcctatcagacttaagtagttgcatcaaacaaagagaatgaagtgatcacaccaccgagggcaacagccagatgcaatacaatcatcaaaggaactacaaagccaaacataatatgtactccccccggacacaaaaacatgtcgcaattgcatgtgtacacgcaaaccatattaatt

SEQ ID NO: 46974 - DNA, 12255 bp, Oryza sativa
  unsure (1)..(12255): unsure at all n locations
tcagtactccatgtagatgtacatagtgctccatgtagatgtagctagtgctgaaggagtataaactaacaaattggcatggaaacactagtattttctaaagtgggtttgtatcctccaaactttataatatattgtggcgcagaactttcatctatggataaattgactctgaatgtgtcttatcaaaagaaaacgaaaaaagaaaatattttaaagaacacatgctagttccaaatggaatgcatatgatagcaactgcaatgtaacgaaacataggcaaatgatgtttgttcggaataaaaagcaccagaaggtttagccgtttagctaattcaaaccataaggaattgtttcctttggttttgataacattaaggtgtttgtgatgtatcataccatgcatttcaaatatcagttcaaaaaatacgcagtggaagttaagcatactacagtatcatgaatagcactgttcaaacaagaggccctaagaacgggttaagaaaatgatgaattctggaagaaaggtactttcacagcataagcgattcaatcataaacaatgaacttgatgtctgaaatcggaaaaataatcaagcaaccacacctctttacatatcaaggaacagaatagcacaaaaataatgacaggaaaggaactagggctagggaagacacaaacttgcaactttacagggcctactcaagcctgccaaaaacaacaattccagcaccatgactaattcttactggaccaagaatgctgatgaggacaagacaaggccttgagctgaacaaaagacttggcacagatttggatgcttatggtgagagggaacgcatgtagaggaatgaagcagtaacggataattcaagattgactagattacgtgggtcgaaccagagcattgcgggatctaaagcgaacaatggatgatgcctcccatcaagtaaaaagacattatctaaaaatcaagtaacaagtagaacccccacccccttccacaaaaaagaaaagaaaagaaacatttgcccccaaaatttgcagtatcaagaacattcaaggcaacaccttttatctatctattcagggttcagggtgcaggtcgttctgcaactcgcgtatacaatatttggtttcgaagagggaaagaagaagaagaagaagaagaagaagaagaagaagaagaagaagaagaagaagaagaagaagaagaagaagaagaagaagaagaagaacaagctttcctctgctgtaacgaacttgggggccgggattaccttggtggccgcctcagataggggaggatacggatccttgtggacgcatccgctccctgcctcgtgaacgccaggagctggcttgcgctggctgagatcgccgccgcggacctcggaagaaagggcgcggggacggcgagcgcccgcgcgtcctgccttgccgccgcagcccaagaaagatcgcgcaaacgaagccatgcccactcctctctttcgctgccagcgatcgcggctgcagggttaggttgggggttctggagtggagtgcgagaggtatggggaattttggacttacgccgttttagttggtggcaaaatcaatattaaagattaaagttgggtaagaccgaaattgactctttccttttcgggggaattggtttcacagtccattccctcagttattaaaaaactcaacctaactaaaaatataacttatcctaataaaataaatttaggcagagatactactttagagctattactaaaaccatattttattattaaatattcacttcaaatcactcttagcttatgataacaatccgacccaggtggggttgcccgaggcccgataacttaaggttgtccggaccccaacagtttcttggcacacccactaggggaaaggcccaatctccctaaaagactagtccaatagaggaaggttggctctcccttttaagatggcttcctcccaagctaagcaatagcttatgataacaatccggcccaggtggggttggccgaggcccaataacttaaggttgtctggaccccaacagttctttggcatacccactcggggaaaggcccaatctccctaaaagactaatccaatagggaaagggtggcttccttccaagctaagtgaggtgggattattcataggctcacacgttggccgaggcccaataacttaaagttgcccgggattattcagaggctcacacgttggccgaggcccaataacttaaagttgcccggaccccaacagttctttggcacacccactcggggaaaggcccgccgtctttgccagcaggtaatagtggaggagatgtcctcatcattcccacccccttaaacaagggcctagctctgataccaaatgataacaatccggcccaggtggggttggccaaggcccaagaacttaaggttgcccggaccccaacagttctttggcacacccactcgggaaaaggcccaatctccctaaaagactagtccaataggggaagtgtggctctcctttttaaggtggcttcctactcccaagctaagcaaggtgggattattcagaggctcacacggtcgtcgcccgactttgacgtctttaccagcgggtaatagtggaggatgtcctcatcagcttatctttgattttaaactagtttattttatctttgtttcaactttgaaccaccaaaaacttttttttatcgcatcaatgactacatgttgggcaaccagccataggtcataccccactagatgatggggcgcgcctttgcgcaccgcctagaggtatgcnnnnnnnnnnnnnnnnnnnnnnnnnngggtgaatgaaaatcattgcgttgcgctggatttaatccatatgcaatgtgtcgacgtttgatgtcgcgattctggtatttgcatagtatggggatcgttggtaccagggtatatgcgagattatagtaaagaagatggggacgaggatttttatacaggttcgggcccctgaattgttaggtaataaccctactcctgttggccgagccggtcgttgctcttattcaccataatcacactaatacaatatatggggtagcctatctaattgttgtcgatttggcggtctgaagtgctgactcggagtcgacaacagggtagcctccctcctcaaatccgttctcggtgagatcagagatagcgctagacccctcccgacggcatccataggtaccgatgaggatcaactaggcttctctccgaagtcgatatccggcagcttgtcttggcgtatgttggcttgtatgttgatcttgtgtcttgatctattgttccgtttctcccctctcctcctagggggtcttgtatttatacccataggtgtccccttgtccaaatagaactaggaaaaccaatatggatataatccgagtagtccttgtcgtttccatgtagaactctattcatccttccttatgcggaactcgctccatatccgaggtcagtttccgtataagacatggtatgtggtgggtcctgccgagatttagtcaactactattaggtatgtggtatccataaccttaacacaatgcccagtgtattttaatccatatgcattgctggatttaatccatggatttgcatagttagaaatatctagctccataaaaaattgaattcggagttgtgccaaacagacatgggtctttttatacatttatattcaagcttaattagttctaaaattgctagatgttcttatattttaggggggaaaaagtagcatataacaaaaaatggttctttgggatgcaaagttggatcaatcttttaaatggtttttcattcattttcctatttattgtttctcctaaaaatataggatattaatgttatcacataattatctcaagtttcgaatttatatttagacttaacgtgtagtatatctgttgatgcgaaaaacacgaggcctgggagatctgcttaactccagtgcaggtccaaaatcttgccttttaggttcgtgagcgtgccagttgatttgatcctgcaatcaacaagaaataaagataaagaaaccgcagttaaatccataaatgatagccgatcggccagccgccgatgacatatcatttatcttcgagccgatgtcatatatgaatcgatcggcagttgtgaataagcaaatcataactaaatctactcgatcggctgtagatgttagcaatatataatctttatgtcgatatatacttaaaccaagtgattgggatagatcggtcgtcatgccgagacagtataaatcacttagatcgaaatatatattaacaatgagattatagatgttcacaacatagccgatcagatagatctagcgtgtatcggctaatactccgataccactctatattaagatattaaagcaagtaaaatatatcaaacatagagcttaatacacctaaatgcaataggatcttaacacaaagagcagatttagcataacaattgagcacataagacataaagctaaatcaggtaagatcggctgaaaccccgatgctactctactcaacaaccaagaagcaagctagagattataattctaggcacgacttatgagatcaaactcaactgatgcagccataagtatgaaaagaaagacaatatctatacaatcaagctattgaaagttttatagagtggtggatatcctatataatctaagccaacatcgatatttaacctaatcagctgctccctagcgatagatattagccgatcagagattaaatagcgatattgtcagagattatataagatatatgataattcgacaacttacatgaacaagattagagtatcataaagatagaagcactaatcccgagaacacaagccgccataacaagctttacctctagttgaagatcaaaactgatgcagctcaacccaaaagtaagaactcatcgaaacaaaacgaaagtaaaagagtggcgatgcgccgaaattgttgttgaacgtgtgttgtcgtattacatggggctcggggtctatttatacccgagattacaaaatatgtccttgtcggacacgactcttatctctaacaaactctaagatatcataagtttttgcggcagacttttacccaaacttatctctaaggaatttacataaaatatcctaattaatatatacaattgcctttttaggactcaatccgtgtatggcaatccatatgaagcactttaactcaacccgatgacgtacaccgagtcgtattgccggaatcggctcaatcggctaaccctgtccgactcgaactctgccgatcctgatcgtagccgatttggactccagccgattcttgctttgtttctgaaacgatcttgatcttggattccgcttcgatctaatcttcatctccgatactcagattaccaaattttgttgttaacaatatcttatttatccaatttaaaaatgcttcatttataatttttttaatggatgacgttgttgacttttgcatatgatatttggacattgtcttattaagaaaactatccaagtatcatatatatatatattacttgtatttttcatatttttattatgacgatgataaaatattaaataacgccatctattaaaaatgtggaaggagtagtaatttttacttctttctttatttctttattattttctttattttttccactttcattctatttatgatcattctatttaaacattctatttaacgtcatcttctttttttggccggcggggttttcactccgatggtcataaccgcagtgaacaagaaaggtcaacgtcggcgaaaatgctttttaaaggcgatcgaacacgtgatgactatgtgaggttgtgacttgtgacgtggttttgtgccgttgtgtgcatcaggcgtagcggtcgagatcgacgaagcgaaggagtcgtcgttgctgcgctgttgtggttgttcgtttctggtaccagtagcgaagaatgaaggaagaagcagcagcaaccgttggatgacgatggatagataggattcgagctaatgccaccctctgcattagcttctccaatgcagaggatctggatccaatgagtaccctgctgaagcttcttcagtttcttattgttttgagggtgaatacaatgtttccatgtactccataagtaagataaagaccatctagctgaaactgattgcagcaaaaacaatacaacgagaaatttaggaacctgcatgcactttatgaaactgcttcatccatttgtccagttggaactccagtgcagctttttcactggccatgcccatgcatggattgtagttgtgtttgctgggagaatatggacccatacagatatcacttaggctgtgttcaaccctaacttccaactttccatcacatcacatcacatccaaaactttcctacacacataaacttccaattttttttccaaacttccaactttccccaaacttccaacttttttcaggaactaaacacagccttagtcttattaatctaaatatcaaggccgacaaaaaggaaaagaattatttgattccaagcataccagaaagtcagtagtaataactaataagctgcattagtacggaggttatgtcagtcaagacgtttggataaagaaatttaacccgtgagcatgatctggtaataagctgcaatactgcagtagtaatgtcggtcaaagtagatgttcaattatctaaacacaaacataaaaaagcccgacttgactgccctaaacaaaaacaaaagatttactatgagtaaaagaaatagttcctgatggagctctgaagcacaacggtgcaaggctgcccaggttgtcgctggtgcctcttgttacccaccatggatccagcgccgctgtctcacctcatcctctccggcctacatgctccaatgccctcaccgccctcgccaagctctgaacggccaccatcggtttccacatcgagcagacgcccgtgcacacgtacaccatcccagcagacaatctacagcactgataaatcgagttcaacctcgtcgagggcaggccgataaatgcagaataggttgcgaggtgatcaacagcttaattttaagcaggccaaacaacagacatgtttgttgctcagttataaagcatttgatggagcctgcaaagataatcacaagttatttgcaaaaaaaactttactatggactcgtgaaagcagaagaaagaacatgtagagaataaacaactgtggcatataaagtctgcaaataatagtttcttttatcgccctactgtgtgcagagcagcaaggattgttgaggagctgttcttatagatgtacaaggtgatttctttgtagttttgagctcacaaagttatgaaatcgtaaaatgcttttacgaatgaggcttgcatgcacagtggattccagttaatactccctctgggtaaggactaaggattcaggatctactagtacaactggcaagaaatatgatactaaatgacttatcagttgggatgtgctatcaataacaaagctgagtccagagtcccctttatatgtgtaactaccatacagtagcattaaacaagggcgtactagtcattctatagaatctaacagttccttaacttcaaatgagaaaagcgtactacattattcatattcttttctcaaatttcaacaaacttaaatgaagagacagaattaattaacttaaatgtaggcaagtagaatgatgaactgattatgtactaagaaaatcaagagtgctctcctgtgcaaactaaaagtaaagccgaaatactaaacgagaacacaagggtacatgcagggtgtccaaatcatcaatttggaacttatttaacaaagagcaaactgatcagcatctacatagtgcttctactgaaactgtgcatcctatattcctaatttacaccgagacatcaagggtacaacctatgtgcttaatgtcttgcttccatatatagatcctttagtgtaatcgatagttgtatggtaaaaacttttgcatggctactgttgtgtcaacagtagattttgctgcagaacagggtgaccagataattgcagtataactatgtgtagagtatataagcacatgtttttcactattcttggacctacctacaattcagaaaatgcgtctctgcttatgcaagttagcaggagggcaggaagatcaataacctgtttcagacggtcatcgatcttggcaaatccaatcccaacagaccctgaggcaaagaagatgagaatcagcttgcacaaccatagagtttggtcacgagtgtaactcttttttatccccatagaggtaagcattctttcaaagaaaccatggtctgccataaggcttgatttgtaggcctcaatgtcgttgacgagattggcatgaatggcagcttcgatctcgtcgaaacggtcagagggcgtcttttccagtttagagagctacaaagacacaggtgccaacatgaataccgacggggtatgccatataacaaccgattcaagaaagcttaacattcaactgaattatattgcacgatcaatcagaatgtttcgattcagagttagaattaggctgtttcaaatcacaaccactataaactaaattttcaagcattttttttgtttataatgacataagaattaattcttaatatggtagaaaaacgcatacaactctaatattaaaaaggccgaatttatcggaaaaggagtatccacaattgattgattatttaggagtggaccataaaccctaatgctaaaaattagggcagaggccctcaaaattccagaggtccgtcacttgaggagctcgattaggtcgatgagaagatggagacggggcgcacctcaacttcgccgctgggacgacgggcctgcggaggcgaacggggatcgccgtacctgctcggcggcagcgacgagtggacggcgcgggcaaggggtagaaggcggtggagggtgttggttgtcctggccgctgccattgacgccgccgacgtagaacacggcgaggtggcgccgcgagaaacccgccatgatcgcagtcgtcgcaagggggaagccatcctttcctcaccctcttcggctcttccccgacagggggaagtgatgactcaaaaaaaaaaaagttgagatatcctaacgggactagctattgggctgtccacagtttttgaggtccagagcagtcaaatttttgcacctcacgatctgcaatcaatgggttacaggaaacgggtctggaccagctgaaagcatagaaccaacctgtttaaagtgcgcgggcccgttaagaaacactaaacatgccaatcttttaaataaaaaacaaaacatacctacaaaacaaaagacccatcccaaaaactagactactcagaatttaattactaagcccatgaagagaacaaaacacaggcccagatagagatcaacttgcatatcaagaaagaaaaagctcgggcatcacacagccaaaaaaaaggattcgaaacaagaagcagatctaaaagaactcaagaacacagccgaaaggagaagaaaaaaagagatggaggaaaatccaagaaatgaaccaacatctgctcctccaggttgaatttctcacatacttttaagattacgttgcaatttcagtttttttcccaagaactcttcacccccatctcattttcttctgttcagcatttagatctgagcatcacaggcaaaaaaatcagtcacatttagatagatagaaaaatgctaattcaggtttcatctaccatgtacacttagaaaacagtccaacaattaatcttgcaaatgataaaatatgaacgacataaactcccaaaaaaagcagttacaaagctacctgggtaacaaaactaaccctagctagcaactagccgatgtccagtagttttaatgctcttgcatcatacaaaacactcttgtaactgcttcatgtaactggataactggattatcacactctgatgcttttgcttcttttttacacaatgatacatgcaccactaaaaaatcatctttcaacacaatgcctaaaagctgcatacaacttaagcaaacaagatgaaaaaagactagtgacataggagctcatgctcaattccaatgcatgccctgtaacttccatgtaactaccatgtaactgctatgtaactaccctgtaactggcatgtaactacgctgtaactgccatgtaactaccttgtaactgccttgtaactagggtgtaaatattatataactagattataaactgagctaattttgcaggggcaggaaatatgacactctatgggcacaccatgttgtatgatgagcaccaaatgatgtcagattctacgaggattgtgagtcacatggcatatttttggaaaaatatctacagaaattactcagcatgcaaaaaaaaaacaggtttagattgtaatgcacaaattcttgcaggggcaacaatgtaccttcacagggttgatgcacgaaataatgcaaactccaaaaagtgctataaatgctgatcaagattatttgggcatgtccagagatatcttacatactccagctggatttgaggtgaaaaatgaaataatctttttggttaaaaaactttacataaggtaacatggtatttagatttgttataattccttgatattttatcattgtagaactcaatgataatgacgagcaataggtttcctgagaactatgagcaaatgggaggtgaaatagaacaaggaacacaggtgaccaattcgcaacagtacatgtcaaacaaaaaaaatatttatgtaaaattatgaattttaatctgttttgttatcaaggcaatttgtgatcaatgggcaagcaagaatatagaagaactatacaacatcaacatgaacaatcagcagggattatcttctattatcaagacacttgccagtcgatggagcaaaaaagatatagatgaactatacaacatcaacaacacgcatcaggtaataagaaaatcatacagattataccatatgatcgaaataagtatataggtgtggaaaacattaagtatttgttacttacataatgcaggttgtaaatggcagcacaccggaagttgaaaacaatgtcagcgcatcggaattggaaaacaatggcaccacatcgaacaaccaggatgatgaagacagtgagaaccaaaacacctgggcatttgaatcaaacaatgaaacctctgaggtaagaaatttcttaatttaattaacttaaaatataaaaaagtacatcacacaatttagtgatataaaaaaagaatacttaaaagcacatggcaaaatgcagggacaataagctcacactgagaactcgacaattgatctggtggacaaaattagagctgatgaagaagaacacagagatcaggttgtggccacagaaccccagatgcaggaaaatagcaatccagagactgaaagtaatcagttgataactgagcaagatatagacaattttttggaagaagatgaagagagcaccccaacaatagatagcaaacacatgccacatattggaatgcagttcaaggattacaatgaggctcatgggtttttttaacttttatgcttatctggttgggttctcagttgctattacacacacgtatagaactataagcaagaagagaaacaacgagattaccagatacacatacaaatgcaatttacatggcaagaatgaggataacaacaaagacttagaggagcagtttcagactgagaggcaaactaatgttctgataaggtctgactacaagcgtgtaatggttgttaaagagacagtagaaaatggaccgtggaagatttcgaggttagacctgactcacaatcaccctctacgcccgaatgaacaaaaaaaaagttcctccgttcacacaagaatatgacagaggaagagaagaggctgattagtgttagaatttcaatggttactctcattgagaagaggatggcactagagatggggcaattttctggttttctttattcacaaaacacaaagccataccttcccgagggaggttggatacatatatatatatagccatagctggctggatggctgctagctaattgctgcccacactagtctaaaatttgaacgcgatgctgtccta

SEQ ID NO: 46975 - DNA, 10008 bp, Oryza sativa
tgtcctaaaaggggaaaaataacctaaaagcaagagaaggaccacaaggaccaaagaccacaaggcttattccatcattctccccctaagtcttgtgtgtcgtcttgtgggaaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtggaaaacgggggtctttgccagggccagagcggacttgctgtccaccctgagctctaccgctccagtgtctctgccgaggagatcaccaagcagtcgagcaagccagagcgcctggtactcagcctcgcagctggacagggccaccacctgctgcttgaccgactgccagctaacgaggcactcgccgaggaagaagagaatcccgctcgtgctcttgctggtgtcgatgtcgccggcgtggtcgctgtcgctgtacctgaggaagtgtgctttgccaggacacctcgagtagtagagaccgtggtcgagagtccccgcaatgtagcggatgatcctcttcacagcctgctggtgctccgtcgtcggtcactgcacgaaccgactgacgtagccgacggagaaggccaagtccggccgtgtgtgggtgaggtagcgaaggctccccacaaggcgccggtactgtgtagcatccacctcctccgccgtgctgtcgtggctcagcttcagtctctcctccatcggagtgagagctgggttgcaatcggtgagcccagccagctcaacgacgcgcttggcgtaggcggtctgtcgaagcgtgatcccgaagttgtcctggtgcacttcgatccccaggtagaagaagagaggccccagatcactcatctggaaggtggccttcatctcctccttgaatgccgccacctccgcatccttggtgccagtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgctggggagcacgaatcccggcggctggtgcacgtagacctcctccttcaagtcgccgttcagaaatgccgacttgacgtccatgtgatggacaccccagaattactgagtagccagcgcaaggaggagtcgcacggactccatccgtgccacgggagcgaaggcatcgtcgtagtcgatcccctcctgctgcacgaagccgcgtgccaccaagcgagccttgtgcttgacgatggctccggcttcatccctcttcagcttgaacacccacttaagggtgatcgcgcggtgaccacgagggaggtcagcaaactcccaggtgcggttctcctgaaccgcgtccatctccgactgcatcgtggcacgccatgccgcatgtttctcggcctctgcaaaagacccaggctcaccgtcatcacacgcaaggtgcaactgcgcctctaggtcgcgaggcaccagtcccggcaccggctggtcgctgagaagatcttccatcgtacggtaccgtagctgctcgccgtcgtggtacgcgtcgatgcgctccccgtcgtgggagagtggagtagcgaactccaccgggctgcgctcaacacgagctggcgtcggagtagacgtgcccggaggagtggctgttggtgctggagcacgtggggacaccgactggggtggtgtcgacgaagagctcgtcgtagtcgaagtcgttgcccgaggttgtgttggtgttggagtcggtggaggctcggggactgggtagacacgctcggtgaagaagagctgcctactcccccagctccctcgaagtggacgtactcgatggtgaagtcgtcgtacgtcggagtcaaaccatcatccaccgccttgtcccatacccaccctcgcccttcgtcgaacactacgtcgcgcgctgtgcgcacacgctgtgtctccgggtcgaggatgtggtaggccttcgagccctccgcgtagctgatgagcacccctggggtgctcttgtcgtcaagcttgccgatgtggccaagctccttggcgaacgcgaggcagccaaagacccgtaggtgggagaccgccggcttgcgtccatgccaagcctcgtacggtgtcctgccatcgagggccttggtaggcgagcggttgaggatgtagacggctgtcaccaccgcctccccccagaagatggccggcatccccctctgcttgaggagagcccgagccatccccacaaccgtctggttgtgccgctcaacgacgccgttctgctgcgggctgtacggcgcggtgtagtggcgctgaatgccctcatcaacgcagtacaacgcgaattcagccgccgtgaattcgctgccgttgtcggtgcgcagcacgcgcagcttgcggccgcactccacctctgcagcggcctgcgcgcgcctgatggcatccgcagcctctcccttgctgccgaggaccatcacccacatgtagcgggagaggtcgtcgacgagcagcaggaagtaacatcgtcctcctggtgtggccggtgtcactgggccacacaagtccccgtgcacgagctcgagccgctccttggctcggaagctcgtctgctggggaaaggagagccgccgctacttcgttaccatgaagacgtcgcagagctgctccacatggtcaaggcacggcatgcctcgcaccatctccttggcactgaggtgcttcagggcctcgaagtggaggtgcccgaagcgctcgtgccactgccatgcctcgtcgtcccgacgagcggtgaggcaaactggttgtgcgacctgcgcgccgaggatgtagagtcgattagtgcctctggttaccttggcaagaaggcgacgacggcgatcccaaatcctcatgagtctgtcctcgaccaacacgcgtgagccgttctcatccagctgtcccacgctgatgatagaattcctcaacgcggggatgtagtaaactccggtgagcagcctgtgctcaccggacttggcggtgaaggtgacggagccaacgcccttgatctccacgccggaggcgtccccaaacttgatggagcctcggacgccggggtcgaactcggtgaagaactcccgtcggccggtcatgtgatgggtggcgccggtgtcgaggtaccacccatcagccttgttgttgctggagctgttgcagagagagacgagtaccttcggctcatcaaggtggaggaaagccgctgcggccggtgccgctggaggaagctcgatgcttgcgtgtgccaggagcagagccggctcttcctcctccacctgtgcgacgtgggcctggccacgtcgtggctgtcgacagtctttggcccaatggccaagcttgccacagttgcggcaggtgtcgtctcgtgccggcttgtggttgctggcggcgccgccctgggcacctctgcgagcgccaccctcggcgcgtcttcgcgcccaccgcagctggacacctccgcatgccttgcgcggcttgcggccgcctatcgagggagaagactccccctttcttccgtcactctgagaggcctcccactgctcccgagtgagatggagcttcccgccaatggtgataggccccgagagaggctgtggctcatcatcgtcgacgaccttgaggcgacccaacgcctcctcaatcgacatcgtggagaggtccagcagagactcgatcgagcgagcgatctgcctgtacttctctgggacgcagtggaagagcttctcgacagctctctcctcgtcgtaggtgtcgtcgtcgcactgcaccatcttctgcaaaagattgttgagacggagggcaaagtcatcaacatccttacctggcttgaaggccaggttctcccactccttgcggagtgcctgcagcgtggacttgcgggcgcggtcgctgccgatgcgtgccgcagcgatagcgtcccaggcctccttggcagtccgcttctgggaaagcgagaactgcatctcgggcgggactgcagtgatgagggcatccagcgcccgtcgatctttgtcgtagtcgacgtcgccgtaccagactgcctcccacatgtgtcacacctggagcctcaccctcatcaccgcggcccactcgatgtagttggttttggtgagggtaggccaccctccgccgggaccaaagtccctgaccaccgtctgaacgccgtggtggccatggcgccggtcaggggagggagagccgcgctgcctgcgagggccgcgctctccgtcgaaccagccacctccaccgggagcgccacggccgcgcgcgcgctcagggctggcgctggcacgcctgcgcccgtctgggttcccgtcagcggccgtgcggtcccttgggtcaccgccgccgccgtgggggtgggctgctgcccaccgctcagccccgctcccgcgcccttcctcttgccagctcctcaaactccctgtcggcggtgatgtcaccggcgatggagccgttgatgctgctgcgcaaggactcaacctctgcctccgccgcacgtgccgcatcctccgccgcctctgcttccacctccgcgctggcagctgccaactccgctgctgccagtctggccaccctcgctgctgctgcagcggtctgagccgttgctcacctgcgctcttctgctgcggtgagctcgacgtcctactgacgccgagtgctcaaggcgaccgaacgccgagaccgaacgtcggacatggcgtgcctccggggggctgctgcgtggagaaggggaagggaaaggggaaggaggagcagcgggtgctgctgctgctgctggctgagagctcaaccgagcttggtaaggggtggaacacgagatgttttgcctacaggaaagtgtggctctgatactagatgttagaatttcaatggttactctcattgagaagaggatggcactagagatggggcaattttctggttttcttcattcacaaaacacaaagccataccttcccgagggaggttggatacatatatatatatagccatagctggctggatggctgctagctaattgctgcccacactagtctaaaatttgaacgtgatgctgtcctagagagcatccaaactaaataaagcataaaggagatgctagatactgtcctagggaagctaaaagcaaaaccgaaagatgctaaaagcaaaactgaaaggatgctgtcctaaaaggggaaaaacaacctaaaagcaagagaaggaccacaaggaccaaagaccacaaggcttattccatcaattaggacgctaaaggaatgcaacataccaacgaggagtatgattgtgatcctgtcatttctccgtggagggttgccatcattgccctacacgaaggaggatgttagcaatgttggtgcatcgattaactttgaaacaagaagcaaggatatgagtcaagtgttgtagtatctgaagaaaaaagaagcacaagacccaggtttctattacaagctcatgctagatgagaacaacaaagtcagaaatatgttctggacagatggcagatcgacagtgttgtatggtcaatatggtgattgtgtcagctttgatacaacttataagacaaacaaatatgacttgccgtttgctccatttgttgggatgacagaccatggaaacacatgtctttttgggtgtgcattcctaggagatgagacaactgagacatttaagtgggtttttgagacattcaggacagctatgagaggcaaagatcctattagcataataacagaccaagacagtgcaatgagatctgcaatagggcaagtgttcaagaaaaccaagcataggaactgcctatttcatatcaagaaaattgcagagagagaacaggtaacacattcactgacagtacaaagaaagatctatacaatgaatttgaagacattgttaacaattgtttgacagagcatgagtttgaaaccttgtgacacaaatgattgataaatatgagctgcacaatgtgaaatacttgcaatcaatttgggatacaagacaaagctgcatccctgtctattgcaagaatgactttttcccatttattcaaagcacaacgctaagtgaagggactaatgcaaggtttaaaagaggagttgggccaaggcatagtgttacaagcttcctaaaggaatatgacagaataaatgacactatatttgatacactgtattggaatgcctataactcaaacacaaaacaacccaaaaatctatggtcaggatactacatagaagagcaagcttcggagatgtacaatttaagcattttcaaaaagttccagcttgaattaaagaaatcaacaaggcttcaggtgacagtgcttgaacatggcaaagcatacttggtattcttggctctaaatcaaaaaagaaggaatggagagcaaggaattatgtagttctcacagacttacaaaatgatgagtactcctgtgtgtgtgcaaagttctcgaaggatggaatcctttgctcccatatcctgaaagtaatgttggacctaaatgttagcaaaattccgaacaaatacatcatagaaaggtggaggaagaaagacaacaacataacaggtctattcagaggagaatcaagtaatggacctaatgctatgctaatgtacaacgtgctctcgcaaaaaatgtcagaattagcatcaaagggttgtaagagaccagagatatatagttacctggttggagaagtggagaagttggatagcatagtggacagcatgattctagaagcccatggaaatcacacatgccaggtccaaagtaatgcaacaaacaacgctgttgttgaggggcaacaacatgggaatctgaatgatgaagaggaaattgaagacccagagcaagctaatacaaaaggcaggaaatcaataaggcagaaaagattggtggaaaagattatggataaagaatgcaaaaaatacaaaggcaagagtaaggggaagaataaaacattgatcttaacttttccacaaaattgtcgatttccagcaatacagctgataaaataaatataaatctgttgcaggtggccaaagtaatgagaatcagttgaagacaaagagaacaagtaatgttgcgcaaggtgggactgcttgtgagatgcaaccaaaaccaaagaggcggaagaaaggacaggaaaacaacaccaaagaaataataggtaaaaacagggcaagaaaaatatgtaactagaatgttctcatgtaatagttagggcaaaaaaagcatatatcttgttgagagagaagaacaagacatcatgtaacagtggatgttctatatatttagtactgagtttgacatcattgtacttggcatgaaccatttcaatatggttgctattttctaaacatggaaaatattatgtggcaatactggaagcctcctaagaacattgtaacctatacatttcaattctacagagcaaaaatccagaatcttcaaacttgatcacgtttgccagcacatgacaaatttccctacaataaatttataaacggtagaaaattagtacaaaaataactctacgatgcacaaagaatacttaggaaaagaaaaaaaaagcaataagagcttactttactggcccaactctgaaccaaatgttcagtctcagtttgtagcattttgtttttttcgttgaagaaaatcttattagcaagctgaatgcggattatgtcgatgtcacttttgtcaaactcattacacaatagagatcttggagaccagagttcgatggatttcatcacaaatataccagaatcagcactacagagaaaacaacattttaaaaaaagttcagatagataactaaaagaataatgttctcaatagaaaaaaaataacagtgcaaatgaactaacttgttttcttcgcgaggaacaggtgggaaaaatatctcaaaactgttgaaatccatagcactttcttcagcttcatctcaagcattttgagattgcttatctgaaagaaacaatatttagagaacaatatatagctacacataaaagaaacaaaaatatattctaaaatctttgaaactacttgattgatataacaataaatgtatgacaccataccatcaaatccatgattggatcaaaatatggatcatccttttcatgcaaagaatcaagaaatacaagcatcctgtcttttatatccaccacaaaaaggaaccaatgctccaggtaacaaatgggaaagaaaagctgtaagccaaaatagtgtttagcatgtgtttgtacataaggggcatacaaagaaaaaaaatcaaactagataattaccaaatcgcatttgtgcaatattcttaccattgctgctccttggaaggatttctcaatttttgctagctctttagagttaagatgtgatattagcatgtcctagaaatatatagaaggcacaataaaaataaaaaagaattcaatttcaatatatatagggaaacatacagggggatatagaaaaaaatgaggtggaaaaaggaaaggataacttacaccaatggaaggaaaaaagtagttcttcttggatttggatggatggtttttgtgaaacaaggactggcaaaatgcagagatcacaaatccattaacatctcctccctttttcaaagaattgccgaagttgcaaaatgagatgcgaacattatcaatgttaacagcatcctcgctgcagaaaaagatataaaaagcttcattgagagaaagtaatacaacaaaaaaatataataaaaaagaacacacgaattgagaaaaacaaaaaaaaagaattaaattactcttgatattcactatctgacaagctacaaatagcattgtaatatctgtgtgcattgtctgatacaacaaaacgacgccttggacaaacaaatgggtcacttctgtgcttggcaggatgtataatcctccttggcccatacagaggcactttaccaccagaagagctaagtccagaattgttaatacaaggaatcgacgcatgagatgagtttgtcagctgcttagttgtattgcaaatgtcatttggtgagttctgggaaaaaaataacgcaaacaagttaagtgactatgaaagcagctaaaatactagagcaaaaagagaaagataatgttgtgaaagtttagtaaataactaaacattgataggtactatttaatggcgctgataagaatacagtggtggtgaagcaactatggaacttattgaaaatatatgaaaacacaccatcttttaaaaaagagatgctctaaaaaatataaaaacaaagcagaatgtatatctaatggatatagttcactcacagttaaatcttggaatgttctcttcatgccaatttgagaggggttcagattagcatgtcttctataagtgttattgttcaatctggttcttgtaccaagtggtggagtcatataatcaggaccagcaaaagtggcaggcttcaataataaataacacgaattataatacaaaatatgaaatcacaaatataaatcaaaacaaaaaaaatatcaggaaacaaattggaaaaagaaaaaagactcacatttgcaggtgcttcattttctttgccatgtgtatgtgatttcaaagtatctggtgtgcaaacattctcgccaatattgtattcatggaaaatgtcaaatgcaagtttatcctcatcataaatgtgacctctgttgtcacggttgttaaattcagctaacctggacttaaactccatcgcaatttttgtaagaagagcaggtggttctgcacatgtagaaaa

SEQ ID NO: 46976 - DNA, 17134 bp, Oryza sativa
  unsure (1)..(17134): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccttttattaatcaaagtttcatattgattattgaaccccatctagaccattttgtctgctgaagggcaatatatattttattttctatataactcttttcctgaaaataatattgtgcttcacattgaacaaccaatctacactgttgtacaattagttggtgatgacctccagctcactcatgtgttggtctctgatggaccagccattgttgcatgcttgcatttgcatgcattcatggaccacttcactagctgtagttagtacaaacatacaagaatgcattcaggagctgtgtcactgtgcctatgtggccacaaagcaggaaaggttaagctacagtgatgctgatggtgagtgctgagagtaagtaggacactgccattatatgctgatctgcagccaaagtcaagaatgtccccagtgattgggagaaacacctgggtcccctcttgcacaacagagctttgcattatgactttttttttcctgcagacagcatggcagtggctgcacttgcatattggtgatgaacagtatctgaactatccagatcccagtgaatctgaaatcagtttacagttttcagtgtgcaggaagcagagcaagagattcttcacaacatcacgcgttacagggatagatgatcatcatggaagacaataatatgatctgtcattttacaagttgaaagtggaaaaaacattgttcgtgtagacaggtttctttttggcaatttatctcagaacacaagcagcagacaaggtgtcgtgtacaattaagaactgaagaagtgtccattgcacattcaaaaacaggagacattccatgaacaaacaagatatactatcatgtactttcttcactctagactgcttttcaggctataaatgaagtaaatctatacatcgaaaaaaaaatcaaaccagcaaaaagatttctggaaaacatttctcctacactaccttttgtcgatgcaatcttcgtatctgcattcaacctcgggtcactcacgatctgatatcgcggtgaatgtcatggaggcttctgttgtctcttgcgacaacaaaggagaagagtgtgccatgatggaagatagcaatgtggatgttgaggatgaaactatgtccacttctttcctcatgctcctgaccttaagatccataaagtcactgattattgcgggcttgctgatcttcgccagctcaacatccatttcacctgttagcatgcggacaaccatcgacattgtgggtcgatgtttcgtgacatcttgtgtacacaaaagcccaattttcaggaacatacaggcttgtgcaacatccaagtcatcacccaaagaagcgtctatgattttctccaaatcaccctcttcatagtgcacccatgtctgcaagaggagaaccccatttgtgatctctgggaactgtagcagtaaaagaacaaaagccccaattcagaacatttgctccctagctgagacacgaataacttttacatcatgatgatgatgctttcatgtagaagaaaaagttggcaactgatgtgtttggcagcatgcaactcgcatttcattatgacaattttactccctctattttttaatgatttgacttttaccaaacttttgttcacgaatgctttcatgtttgcgactcccaatatgtaatttccattgtgcccatgtaaataattatcttaaccagcacattcagcagtacccataaaactaaggcattgctaatgtgccctgcacagctactgagaggactaggctgtcaagtgaaatttgatcacattctataaaaagcacaaataatcacctagtaaattatgcggtgatcaagagtgttaactattaaaaccagaatatgattttacaaatataatagctgaaaacttgaaatgtcatggctaagattctaaaagcaataactgcatgtatctccattagtcctcttatgggaaaccaagacttccacttgaaggcaccaacattagttcatggaacaaatacaacactcatattagatataacttcagcctaaataaataatttagtgatgatggtaaaaaaagatagtaacttctgatatacaaggaacaacaaaaaaaagtattgtattttatcttaccctttcaagaagtatctgatcttcatagggtaatcttgtattggtgttggatctcccactaactatttctagtaacagaacaccaaaactataaacatctgacttccgtgtcacttgtcctcgaatggcatactctggagccaagtaacctctgtcatgtaaaactgagtaagtaaagctgcaggtgtattgatatttgatgggtcataaatataatccataaattactaaataatcatttgatatttgcaattttaattgccttagcttttccactgacaatcatttcataaaatgtaaaagaaattgtcggggtgtactgtcatatgggtcaaccatttaaactgaaaggaatgctataggcactaccatagatacccaagaaaaagataaggtacttgaaaaatgcatcgtacttgttaactcattataaaaagaacttatgacaaagtttacttacaatgttccagcaacccttgtgctaacatgtgatgcatctggaggcaaaagctttgctaaaccaaaatcagatattttcggcgtaagatctttatctagaagtatattgcttgctttgatatcccggtgaacaatgtggggatttacaacttcatggaggtatgttagtccacgggcgatgccaacacaaatatttactcgagttgcccagttgaactggatgttgctgtggccataacctgaaaaaacaaaagaggaaaaacaaaggaaactgtttgaatatctaggccttttcttagcactgtatgtaaaaatttgagaggataaagcaatagaaacgattcaagtaaccatacccaaaagtgtttgtgcaaggctattattttcaagataattgtagacaaggattctttggtttccttccacacaatagccataaagcttgacaagattttcatgagatacgtttgaaattgccatgagttcgttcagaaattccttcgctccctgtcttgactctaaagatagcaccttgacggcaacaagctttccattccttagctttccctgcaccattaatccatcatgatgaacacgtgagaattcatttttttttggaatttttcttcacttatttgtttgaactttgaaggctacttatattaccttatacacagatccaaaacctccctcaccaatcttattagacgggctaaaattttcagtaacccttgaaagctccttgtaagtgaattttgttatattcatatcaccagaggggtctgtacaaatcatgttaaatatttcagcaagaaacatatcaaggatgaatatggacaaatcatgttcaacaaatagggtataatgcagtctgttttagagatctctaccatcattatgctgagaactttgctgtcgggttgcccttctcttgccaaatatacaaaaacaacccattaccgaaatctaaaactactatgatggccttaattctgcagttcaacaaatacagtttcacttgtgaatatccacataagcatgtcatcaattttcaacagctgccatcatgtcctgaaaagaaagaatgcaggtaatggttagctaagaagaaaggtatattgagcacttagccacttaccatttcaaacattaagttcatgattaacattatacagaaatgttacattccaggagtgctgcaaattgtcatggtggcacagaatgaatgcagccttttcatttgtccataaggtccagaattacagctaaaccacaagaatcttaggcctaccacgacggctcgatgtcagactgaccttgcttcaactgttttactagatgcagcagttatgtgggtttcgtgataaaaaaattacaataagcagccaaaataggccattgattggttacagctcaaccaacatcagtaaagatgatctagttatacaacttaaagtgggagtaacatgtttaaagctcggggaatgcaagcaggaagcaggtgagatgaactaacatagtattagactattagagccagccagcagcagtacggattgctctatatttctagaatttatctacatttcataatttctacccacagaaacgctatcattgggcaggcaccatccgatcaattgctcgtcaacaggaccaactaatttcaagaaaatggaaaaaaaaaagattttctagtctaactaactctgctagtgatagaaacaatctatgattagacctactgcatcccacacgcaacatacaataaagtaatgcatgattaggcctggtctccaaagcgaaaacgaaagttccatcccaccattgttgttgacatcctaatcctagcacattctccactcacccaaaaaaaaaaatcagaatatgtaaactgatttccatacagattggcgatcacacacgacaaggtacaaaatcgaagatccattcatgagcatgtaaaattgaaagacaacctaagaaaagaactcaatttagccccccatcgaattcggggctctcatctatctcacgaatcattcccaaatctttaaccaatcaacaccgggaagcagtctactactactactatcaacgaacaagcaatccctaattccatactcaacgaaaagacaatccccaacctttgtatccgcagaatccagagaaatcaaccaagaagacgactcacctgataatcccaaccaagcaagaatccgagcagagctagtccaagaagctcaaagctccgggaaagcagcctctccggcgagctgttcgtcggcgaatggcagcttcgcagcggcggtgggcttgggttgtagcgaaccaggtggccgtatttgacttctccgcagtgggaatcgggaaacgggagcaagaagaagaagaagaacaagaagaagaggagcaggaggataggctggccggtcaaaccgttgaccacgtggtggccgcgttggccgcgtggggcccacctgtcagagagacggacgcgtggcgcggctcgggctcgacgcggcggcggcggctcggcgggtcggactcgggacgcgatcgcgcattgtggcatgtggtggtggttgtgggtcgggtccaagttgaaaacgagtcgattgactcgatcgctcgccaggtcagtgttacgatggctttggctttggtggcttggttggtccatttgcaggatcgtcgagctcgattagcacttgcgtgaaactgctggcactcgtgttgattgatttgtgattggtaccgtgacatgtttgttttttatcttcctgaataattacacggtagacgtgcacgtatatactcccttcgataaaacttatcgttttggacaatggtatgatctaaaaaaacaaccaccattatttttcattataagtactttttaagactaatttatatatgtagtaatcacaatgtataaacaacaaatattttaaaaataatttataatcaaagattctaaagtttaacctcgtcctaatctaaaacaatattataaaacaatattatcagttcggagggagtacatgtagttgattgtagtgtcgatataatgttggtttgtcatgctaaccgcaaaacagttaaaaaaatattcttttctttttcacatagttgaaaagtgagaattgcaattcagctagtatatttaagtatatgctatcgtgatttatttggttaaaattttaaagctactagctcttcaactatttttacagcttataattttgttagatattttttttctaaaagaaaaatgacggtcatagttgcacactgaataaagtttgtagtgttaagtatttaaatgcgaaggtagtaggccggtcgtcttggaaaagaagtgcgatttaaaacgtgttcttttgagttaggataacataataaagactactagcaatcaaactgcaataggttatgatggatactatatttcatatagggcaatttgcaatactcaattactcatggactggacttttggttggaggaggcacctaaattactctctatagtatgaacaaatcagaaaagctctaatttcaaatttaaaatgaaagtatgaacagaacaaaaggtactctattcgttctaaaatatagcaattttttaatagatgaaaacaaagatccgttcagatttatagtattaaaattaatgtcatatccgtttaaaatttgttatattttagaacggacgtggtatggtagcgtacttgtaaaaagcatgcgatctcacctgtcccaactatcgccttgttgctgtccagccatttggacacggtctacggtgagccagcactgtgcagtcaccgacgggtggggcccgcgggaacgaacggctaatgatttggccaactaaaaatgctaatctcagagtgctcggggactaatcctccactcatgagacagcttttggttactgcacaataagcctgcacttccagttcagtgtgctcgctctgcagctggtggacatttggattttggaacaagctgcaattttcagtaaacaccttgtgataatcttcaattgattatttctgattttcattagccgatcagccagcttgcaaatgatccaatattgaatattccaatgggacaaatttatatttaagttcctcgtaccattcaaacaagtgaccgttatgtttataccctagctttgagtcgtaattataatcttacctcttctttttagtgtgtgtgattttgtttttttttcttttttcaaaggaagctatgcccctattccattaagtttgcttgcatatttgctcatgtttctgttacaccaattatgtttttctctgttttgataacaagcattttagacaaataccagatgttccgatgcatctgtctgttaaattggtcagaaaaatgaaaaagattcaaagctcgtcggggcagcttgctgcttactctctccgtccaaaaaaaaaatttaatataggactggatgtgacacattctaatacgatgaatctggatagatatatgttcggattcatagtattaggatgtgtcacatctagtactgagttagtttttttatgagacggagggagtaggagtgtacactagtactccatccgtattaggtcataagacattttgattttagtcaaagttaaactactttaagtttgactaagtttgaagaaaaaaataaaaacatttttaacccaagacaaatttattatgaaaatatattcaattattgatttaatgaaactaatttgatattataaatattactatatttgtctataggcttagtcaaacttgaagtagtttgactttgaccaaagtcataatgtcttataactttaaaatggagagagtagtaacaaattttcagcgatcatagccttgtttcgatctaaagaaaggactaaatgatacgaacggaatttttttatgtaaaagttactctaaaatatcaaataagtctatttttggaatttatagttattaacttaattaaatcatacattagttactttctcgttttacatgccattatttaatcctcacttcatcacgtttaaatatgatattttgcttactccctccatccaaaatatagcagcctattatcagatgagactcaatctattctactatctccgtttcaggttataagactttccagcattgcctacatttatatagatgttaatgaatctagacacacatatatgtctagattcattaacatatatatgaactagcatggtggcccgcgcaaattgcgcggctagcatcattatattttctctcatataatagcatatatgttttctcattatattattcaaatatattaaaatgacaacataattttaaatttcgcaataactttacaaaactactaatgtgtaatattcatattgtattttatatacgtgttagttattaattatttttaatatcaatttttagttatttgtaaattatatatatttctatatggactctagactcatcttttaatatttctttttttctaattctaaattttttgtaaattgtatttttatatagactatatgctcttctattatttatttttatttctgaatttttattatttctaattgtatttatatgtggactctaaactcatcttttaatattttttaatttttaatttcgaatttcagttacttctaaattgtattcctatattgactttaataaatttattatgtttattctaaattttagttagttataaattcctatatggactctatactctacttctaatattccttatttttttaattccgaatttcttttttttcttaattgtatttctatatatactctatactctacctctaatattccttattttaaatttcaaatttctattatttcctaattgtatttttatatggactccatactctacttctaatattccttatttttaattccgaatttcagttatttgctaattgtatttctatatggactctatactctacttctaatattccttatttttaattccggatttcagttatttcctaattgcatttctatatggactctagtctcctattctaatatttcttatttttaattccgaatttcaactatttctaaattgtatttctatatggactctgtcttttcttttctccgattaatgtgagaatttctagaccatgagagcgaacatggaggcttctttttctattcctttaataatacaatagatatgagcaatgctaaaaagtcttataatatgaaacggaggaagtacggatttagacatgaagcttgctcagattcataatactaggttgagtcacatactcaagagtcatgtataacccaagattgctactccttccatccagatatgtagcaacccatgatgaaattagaccctatgttcagattcgtagtcgatccatcttaggttgttacatattgtgagggagtatagtatgagacggaggcaggcagtaaaaattagcaaggacaaagtgttgagagtacgaggtcaagaaaaaaataccagaaaagtggtggagcaaactgcaaaagcggacgtcatcattcatcctcgagcccctcaactgggcaccgccccccgtcgcgagtccacctcccttgacttcgactccacacagcagcgacgccacctactctctctctctgtctctcgctctcgccgtcgccgagctagttgagccgcggatggatagccccggtggtgcggcggcggcggcggcggcggcggagtccagcaatcgcgcggtgagattctgcaccccggggatccaattcttgatatttttttgttcttctttagcttgctgtgtgggattctttgtcagcttcaggcttggatgtttccaataggtcatgggagctagtatagtgtctgtatttcgttagaaagatttggatctctgggggtgttctgttttggaattgggttgtcgtttttggctgttttggtggggaatcttgtggattcttcgccatctgttgtttgttgttgccatacacatgcgagctagacatacatagtttatttactcttttagtgttttactctttcgattttgctttgctttagcggtttgagcaggcgttgttaacatgatactgctgtttaattccagttgcttgactgaataactgtcactgatattctgatcaaactgtttcactgaaaccttcataacaaagcgtattgtaatttgtaaagacgtttgcatggccatattagctactgaattcaatattagtttttttctgtcctcaaagattaacccagaaaggctcaaattaggacctagtgctgaatgctgtgactgtcagtcacacagaataaaccaaactactcctatttgagaattaagaaaggcagtatacgcactcactattagtcttggagagtgcactcgtctctgttcatacttgaagatttctgataaactatccagacaggcgtttgtcctactcttacttgcacctatctcgaaataaaagcttccattatctaaaaagatctcttctttgcaccatggtaggagcaccactgcagttcatgcagaaatttagtaaaggccctcttagtttcttgttccatgtctgaatgtgaacacatgcttgataatccctccgtctcataatataagggattttggagggatgtgacacttcctaggactacgaatctggacaggacaagagggagtagaagagtgaagaaacaaacagcagtgatgtggtgatgccaaatgagtatctattcctcgtgttagtatttagtactatgaatatatgatgcaataggcaatggctagtagcctagtacatggttgattcttggcgtttccttgtcttttgttacattgccactctttctttttaatttgcttcaaaccaatcatataattatttaatgtaagtgattgacattgttgttcgattgaattgttactagggagaagatgctaaaagtgatggtgtatcttgtcagaattcgcgacggccaaacctttcattacaaataccaaacagggcatttgatgacactctgccaacgtcaactagaatcaaaatatcacccagcccaaattctgcaagaagtggtttaccaccaaggccgaattcaactagaacaaaatcatccatcaggggcatcattccacaaaggagcttcaaagcaaagagttcattacaggatggtgaccagacaattcttctaattcctgacacaccatcatcatcaggacagcaggtgaaggcaactacatcaagatcattttctttcacaaaggtcatcaactccttatcagcgaagcgaacccactctcttccagttactcctgttgcagcttcaggaccttcttctcatgaaggtcatgcagacaacctgccaagtacagttgtaagtatttaactaggactgcattgtttgcatgctggtctattttggtataacacaattccatggcaagggttgtgggatttaataatacttgacgtaatatgacataatctctactaaaaattgaagatgtttttgccggtattttggtatgtcatccgtatttgagtcggttttatgttcgctcgcttttggtaatacagatccgtttatgaatcggattttaagttcgtttgcttttagaaaaacaaaatgagtcgtataagaaatctctttgagaaaactcgcatactaacttgagataaaaatcagactcctaattgcagctcatgattttctaaaaaaatatatatatccaagcgaatttccacagtgaattttatcctagctaaaccatataacaataataagattataataatcttcacccgttgcagcgtacgggcatttttttctagtacatgtatacagtggaaattaaatggactattatcaaacaaccaaactggtgcatttacaccttaaagtatgagatgcgcccagttcaccgaggatcatctcgtattaatgtggttcacaatggttgcagaagaatgaggttgaaacacaaattaggcgctcactctcagcaccaggaaatcatgatagtaaggatctgaggaggacggcttcatcaggccttatacgtgtgattcccacaaccccacgacctgttcctgttgaaactgttgcatcaaatgatggcattgaagaagcagtagatggtactaaccttggatttttactcttttgcatgtcagtgtacagtacattaggcacaaaacgttttgtagcgcaatcaaagttcgcgtgaaccaaaatgttctcttcaaatagcaaagctgcaggaaagaaacactgaattttgtgtcgttcatccttggtagctcctgaagatggaggtgaagacattcctgaagaagatgctgtctgcagaatttgcctagttgaactcaatgaaggaggtgaaacacttaaattggagtgcagctgcaagggagaacttgctcttgcacaccaggagtgtgcaataaaatggtttagcatcaagggaaacaagacatgcgatgtttgcaggcaggaagttcagaatctacctgtgactttattgagaatacagattcgaactgttaacagacaaccgcggaatggtgttcagcaaagagcagcacatccacacaggtatttcaaaacacacttttttagtgtgaagatattttgacccttataaaatgtgcacactggatgagtgttgttttcttcacgttttatgaatgacaattgttttgttcttttttctgtctatactatgagaaatatcattaatacattaatgtatttgtcttcttgttactaaattctccttttctgacagattttggaaggagactccagttctagtcatggtcagcacgcttgcgtacttctgtttcttggagcaactcttggtttgtgactttgtgctacacttcttttagctttccattatgtgaattttgtgtgtatatgtcaaattaacccaaccactgtcccacttgttggaacttttaacaggttgctgatatgaagtcacgtgcactagctatttctttgcctttctcctgtctcctgggcatattttcttccatcctcgcatccacaatgggtaatgaaatactacttgcttttctctggctctacgcaattgcaaaatcatgagttcagtacattgtgtagggaaccaaaaagccttttggtacctaagctcactgttttccaaattcagatttatttattgaccaccctaccctcatagttagatatatatatatatatcttgattgtgtaacaactttaccagggaaaacaattattatataatatgatttcagcttttcaacagaatgtaaaacataactccttaccgctctttccatgatctcattttaaaaccaaatattagatgttatgtagttacttgatcatttggtgtaaataaactcagattatcatgttccagcatttctgctgaacagctaccgcaattccacatttaaccttttttttttatctctgtgaaacagcaaccgataattacctatgggctttcgctacgttccagtttgctttcctaatcctatttgctcatattttctacaacttggtatggagcttttgccctcaataagtttttttttttttgccctcaataagttttttttttttgacgtaagctcaataagttttctagataatatcttcagcacattgcttattacaattactaaacatgcagttaaaaatgggggcagtccttgcaatcctacttgcatcgttcactggtttcggcatcgctattagtctaaatgcaatgctaatagaatacctgaggtggagactcctgcggaatcaacggttaactcaacgtagaaatcacagacatggtcaatctggaaacaatgcttcaaacgagaacactgcaagtaatgctaggcagcaaggcagcggaagcgatcaacagtctgcagaacatggctgaagatgatccatctgtggttttgcaggtatcatggtgatgataaagtaagtcttgtttgaactttcaagtagagtgaaagatagcagctcatattttttcatcatgaatactcaccttcgtgtagttgctgaattctgcagattcaaaatcaaaagtgttaatgaatgaatggaataaaggcgccactggtaaaaccgcaaatctgcaattccaagaatgccatggccggttgccacctaagttgatcgtgaaacaaagttattattcagaaaaagggggctctcaagtctctcaactctgaaccaaaaaggtccagcagtctccatttactcccggttatagtttagtagtccagtgtgatatgtgtgtttatgaaatgtataaattgcgaaagcaaatactacacaccgacctttgtatcacaaccatgaacaaactgtatatagctcatcgttgtcgattttactttgctgcaaactgtgagatggagatgctacaattctctgaattttctttctgcagtcaggttccctgaactgtatatccaacttcgacgaaatccgagacatggtgaagatgtttgtgaatttacagtcacatcatgatcattttcattacaacttcgtaagtttgtaacatatactacatcctgatacccaatgccataacaggcatgtaaaggttcattcaactggtcaaaaccagttggaaacctgacgaggcgtggctggctcccagggtcatgtcgtcgtggtagtcaccggcggcagccgtcttgctgtggcgtcgcctccgtggaacggcgaactccggtgatccttccttcctccgctcaggtgaagtaactcatccaagatctctcaacccctaaccgccttccgagctggacatcgaggatccagagtggtattttatcgaaatttatcaaatagagcagtatattcttaattttctccttgtccaagcagatcgacggggagggaagaagagcaatactaggctatgaaatcgatgttgcaatgtagaattcaggtttgcagttagtccaagtttgtgcaaaatagaagaaaaaaaatgttcttttcaccggtttgacatgatcattgggcaaaaaaatgttttttttttcaattagataactggattatgaatcaaattcaccagaagttttcaactcctaaaaatatatttttttaatatatattattaaatttcaattgttccggttcatgccctcacaatctcacatgatacatgccaggaagttgtacaaagcaatagttttttttttggtatttttggtgttgctacaaattttctcaacctaaggctccacaagattgaaaaaaaattggattgtaaaacatagaaaaaatacataaataatcttttgaatagaccataagaaaacacagaaagcggataagagaggaactcaaaagtaaatcttccaagggtttggagcacttctaactttcctccaaaatatctataggattattcattcagtagaaatttcaaagaaaaggatatgattcaatcatttgtttcaaaagtccttgaagaatttgtttccgatgttttttttttctataaatcaaaggggggcataaattaactgattttgttttagatttactacttaaaaatatggctacatactttctttctaaaattgaggtctgaagcaaggccctacttcaaaagcttaaaattgacagtaaaaggcaacatcaatatggtaccaccagtgcttcaaacattcttgctgacagagtcagcagcaagcttatgcatctcaagcagacagaaccattacaagcagacaagcttatccaacttacacactaccacatgcttctgaagcagacaacactattcaaccacacaatatccacagccagaaagcaggtaagagaatctgcctccttaaaccaatgcaacagcaggagataattctcttgcacatgatgatgctacctacatactattagcctagtgggctagggagaaagttcagaagttgacagttttggcacattgctaattgttcatagacatcaggggtgaagaaaaaaacaagcatgaaaaatgtgtggcaattctccacctccttccattttcattgccaggtttcctcttcttttttttttccgttgtgaaaagtcagtcaagattaggaaatgatatgatctgggatccaaattagggtcccagccaaagatctgaaagagatggaggaatcagaaaagaaattgattgggttcagaaaagatgccccatatctttgaaaagagtggatggtggtggtgtatgtcattgcactccacattccccccctccactttaaatttgtcacaatccacaaccaccaaaaaccaaaccaaaaccaaaaccaaatcaaaccaaattctaacacgttggcgcgaccggaaggtcgacgaagggggatcagaacagggataggcattaccagtaggcattaggaccctgaagaaatggatatgtgatggggagagaaggcatcacattcacctcatcatccaccgctgaccttcaagaaagggaggctatcttttttccaaccattggttcaattgggtgtgcacttgtcaagggttcttcagtcagatggggaccttgaagaagaggcacatggatggctggtccatttctttgcctgtcattgtccccaagaactggtgccaaattatgtaagcataaaggttcaggtgaattccctcatggatctatctatgagctttccaggatcacataaaaactacttttttttactgaaaacagcaatgctaatcaacatgtcagtaattttggaacacttctagaacaaagctgcttactactgatttggtagtagtacatatataagctcaatagttcttgaactgaattttcacagttgcatggaaaaccttacttgctgtcattaacagtacattgcaggaggaaaacatcatcaatatacagaatatggccaaagctagcgcctgcggcactacagcactactcaacatgaacctaataattagatgccctaagttaacatgatcagtattccaggaaacaaagtgtcggcatgtataccaaaatgtaataggtaccactaaaagtcaatgtaatatgacataattaccagacagcgcataacttagagctacacttgacctatgtgcttgggttccaggtcacagaactaagagctacagagacgtacagaactggacgcctaacgcc

SEQ ID NO: 46977 - DNA, 8683 bp, Oryza sativa
aaacatgcaactttgcaactgatggtgcatcaagcatgcaagccattcactcaccttcacaaaggttgcatgcggtcgcttcacttgatcagcattatctgaacatggaacatatcctgattcatctaagcagcccggagtagttagtgtttgactcaatggataatcatcttgagaagggctaaggaagttggatgtggaatatggaattgtgcttgaactgttttcattgtgaaggcttggaatgccatcttgcatcaaaagtgactgtgagtctatatttacaccaaacaagaagtgattttgaggatcagagctcccatcttgatccaccaggcattcccttccaggcagtggtgctaacgtggagttttgaggaatactagaaggtgtcaagtcgaagttctctatctgtgatgaaatgtcatgtgggcgagaagtgatcgtagattccactgcaactcgcttagatgaccatgggtcagagacaggtacaggggtgattcttggcacacctgggaggtctgaagcagcttctgaagggaatgatctcagtgtatcgtgcatggatgagacattggatggagagagacaactgatatttgtgtcagggaaattatgttgctgtgagaatggtgaaactgtctgcaatgtggagggtgtagactgaggggtggaggaaagctgtgaaaaaaccgacaatgcatttggtacagtctgaaagttggacaagtgtttctgttgttgcatttgttgatgctgaggttgctgctggtgtgattcttgctgctgttgctgcggctgcaactgaggcttctgttcgttaaatgattggcaatgttgaagcggttgctggaggtactcaggctgactatggccttggattgagttgccattgatgttttggtggtacatctgctgaaattgaggctgtgcttgctgcagaatctgactggatagaagagaagatctaccgacaatgttttgcggctgctggaactgcagcatggcaggtgatactagcttagtggtgttctgtaaagccgccgccaacgctatcgtttggtacatgtcaggttgcagaccaagtagggaactatccagccttggctgcatccacggactcataccaagtcctccaaaattcagagattggaaacctgtgttttgactatctcgaagccacataagagaagaagccaagtcatcctcctttccgcctgccaaaaccatcagaggtgaatatgattatcataacatcagagcaatgcactaataatacatacgagacatcattgatcattgtgcactgctatagtttaaagggctgactaagatgctaatgtcactcgtaccatataaagaaggtaagcctgttggccatggacgctttagtctgagaggaaaaggagatggatacatcgggaaagttgtcagaggctcgatctcccaaagagacacccttggctgtctctctccagcagtcgactcatcccatccaacctgcatgattcaaagaaaaccttgttcacatgcttaattttgaagcaagctcatagtgaaggtagaaaatgactaaagcacactatctgaaaatatgataagactaaaaatgaggtaataaaagcatatgagtggtctataaacaaacagatgtttcaagatctaccttgacagagcgccagtgtgagttcatccaacgaacaggatcaagatcacttattcctgttattgtccccatgtatctgcaaataagagcaattgtgcaatttaggccacttaatattaggtagagactgcaaaagctctacacatcacaacagaagataaaaccataaaggtataaacagacaatgcataaacacgtagagaaaaggaaatagcattacgtgatgctcacagaatgaattaaatgatatataacaaacaaatatttggcatacctcctaacactggattcttctgtttcaaaaagcatccggaaacgcatgcccaccgatatgcgggtatggtagacagcctttacatatttagccagtggtataacaaactccgaagggcttgctctgcaaaatgaatgcgaattgagtacttgtacgaaatgatcagatatgtgcaaaatatggtttaccttggattatagaaaatagtaaaccggctatttgttgatgcggcgtgagcagctgcagcaagcagaccaatatgcatgctgtcactagacaatactgatgatggcatgaccgtttgtggcctatttgcccgacgaattcccagaagcagctgattactgtcattcctgatcaaccagagacatacatcatacgacaggataaaaaatctctgctgggaatgacaaggttaaggtggagaaatttagtgacttttgagaatttcaaagaatgaacataccagataaaaaggacagagtctccagcaaccagtctctttgcacttacaaagacgctccaacccgtagtcagaagatgccgcttcggttggcctgcacaagtttaattttacatgtttatcatacttgttcaagattcttatttgaaaatagaatgtcactgatagatatttgactctcacataagttgtacgtgaaaacaaggcagcaagcattatgaggaaaataacaatattaagaaggaatggatgtaaacggaaaatagctaaccacgaaagatatgacggaatttccattcatttccatggaggtctttcgccatcaactcttgagctggaggctgctgagtgaaatcctacagaatcatcaaaggaacccttaagaaacactaataacttggtgtcttctctgaataagtacagataatctgttcaaaggatgccacatacaatagccaaccaagaacacataccagcggaggaaatactttctctgctgctcgacggggaacagagaatccaccatgtgtacttgtgtcactagcagttaacgttttgcagaaataatttgttggctgcttgctggcagtgcctagctcggcgggtaggaatggatccttgagctcttgctgcaaacaaaacaaaacaaaaaataaggagaaagtgtaagcttcttagatacaaacaagagtacacaaatatagggtagaaggtagaaaattctgttttaccgggctgagtggctgcagcgtcatttgcgcatagacttcatccgtctctgcatcggcctaaaggaagaaacacagaaaaagttgatgagacacaaaagtaacaacagtattacatagttttcaataagatgtcttgtgttgctccagacttacgtgcatggtcacattatgtagctggcatataagctgcggcggcaggttaggatagttggggatctgagactccatttccttatttgttgatgcagctacctacgtacgaaatgtacataagctcattaacatctcaaacaaatctttggcctttgcaatttaagatctgacaatgagatgttgcaatataagaaaaaacgtaaaatttacggtactaattttgctgatacttcaagtactgcagcaggttaatctagtacttatgaggataaaatctgtactaagatgaagaagactacctgctcactgtggccttgaggaaaataaaccacccgactaccgaccgcaggcagcgaaacgagagggccggcgcatgcatgccacaactcagaatttaggcacttctgctcctctgcaactgaaagaggggaaaatcatttcagaagaacacacagcaacataaattttagttgtcagcagtaattcttgaaccatcccataatcaaatcctagttcaaaacgtatttcaagaagataattttaaggctaacaaagatgtttaaaatcaaagatttttcaaaaaaaaatgaaggggaaggggatagagttctcaagaattaagaatacgaattgtttgcatgtttccagaagcagatgacttttacagggaaaaaagttactgcataaataaaaatcacactaatttgcttgtagacaagtataactaagcagtctaatgaaaaaaaaatgcatcatgtgtatgtatcattactgtaacaggagtaactcggttattcaaagcacaaatcacccaaaagatgaagaaatcgacaggctgcatcattgaattgatttggagcacataattaccaaacgaaatttaaagacttccaagccaacaacctaactaacttgtcctaagaacataaactacccaatggatgagaagagcattaatgagcaaaaagaaaagaaaaaataataataacaaaagagatgcaactggtcaactcaatgcccaatagaaagaagatgctagagtagctagtactattctctataccttccggcggcgacggcggctggtcggagacgccgccggccgacggcgagagcttcattcttcttcttctcttcttcttcttcccccaaccgatctagaatgcaaagtggagagtgcaagaaatggagcagagaaggaatcctttctgcaccgagatcacgaggcgttcccaaacgcgctgtcgtgtcatggagcaagcaacccagccaccaccaccaccaccaccaccatcgctttctctccttccccaaaccggccaaaccttcttgcctctccaacccgcaaccttttcgatcccaagggagcgagctcgaattccttcacatcacgggcgccgctacaccggcgcgaaggtcgtcgtcgtcgtcgactcgccggatagaatgcgcgcgccaagacgccgccgccgccgcacgccgccgcctttgcagctagctcaaagagaaggcaaattaagaaacgcgcctcagatccctcccgcctgcggcgagctccggagatgcgtgtcaccctcaccgctcgacaatccagccgccgctccaccgcagatccgccgccggagttgacgacgaactaggataggactaggagcatcagcatcctccccctatctccaccacctccaccaccacctcctcctcctctacaactccaagaacaacagtagctagagagggagagagagagaggagtgtgtgtgctcgcttcttgcgactttgctcggttcttgctgctgctgctgctgccgcctttgccgctgctgcgccgtgtgctgctgctgctgtgcagttctcggggttttaaccccacgagtggaggtgagctgagctgagctcctctctctctctcgctttctctctcttctcctcggttcaccctttctctatgcactttaaaaacacaaccttttctcctccctgcaccatgcttctacttccagttctaaccccgcagtaaaaaaaaaactctttttacagaattttttactgcaagtgcatctagtactagtttactgcaaaagtacttgatccatctcccaaaatataaacgatctttaagtgaatggtatggagtatatccatgcactcaaaaaattgttaatccgtcctaaaatataagcattttaacgtaatgttaaatcaaatatttttaactttaactattaatagaaaaaaaacaagatctatcgtgtaaattgatgttactagtagatttattagtattaaacaaactattataatatgaaactctttttatttaaaacatcttgcttttatatttttggataaaatagtatcttgaagactatatcaaaatctaaaaatgcttatattttagaatgaaggaagtatattttaggacagaaatagtataatataaactacaacaaatctggatagaagatatgtccagatttattgtaccatatacaagtatctcatatattatgatatggagatagtttgttcaactctcgttgttcaaaaataaatttatcttttctaacacataatttatatttagatttataggagtatttcgtactgaatgatttatcttaagacaatgagtactctactactagtacttgggtatactccttaagtagtacatcataattacggccaagaataagatactgaaaatgaggaaaagatgcaaggagagaaggtgtgatcactttgcagcgcacacacacaccgccttttctttccttgggccactgctcggtttgacatcgttttgctgctgctgttcatggatggataaaccaagcaaagacagagagagcggtgtcatgggtatggaccattgaatccaaacgtgttgcgatgaaaagggatcgcttctgttctcggtgagagatcccaccccctccatgatcctgcctttttgacttatgttttattcatcctcaactatatttaataatttggttgtttccttcttattacaccttgtttaattaattgaattaattggttggtttgcggagtaaattgtgtggtcaaaccaacatgtgcatcatatgtggtggtgctatacaaactggatttgtatgtttatactctgtatgtattgtttggttttgttttgaacagcttaagtatactgtctattgattttaacctaatgacgtccaaatcgcgtggaaaatttttcgcgaaaaatgggtggaatttaagaaaacgtagctgtcaaaaactagtccagaattttcagccgtagctgtcaaaagccacccccatcctctcaccaaaaataaaataaaaaaaataaagaaaataaaaaaatccctatccctatcacaaatacgtacgatacgtgtagctagatactgaaaataccgtacagttgggcaagagtacgtatagtacgtacatgtcggattctctctctcatgtgaagaaacagccatgaattaatggaattgaatcgatggaattccagcaatgaaattcaaaaggtggattagatcgatcacatccttttttcaggaaaatacagatgatttgtactgaaagatgcgaatctgaaaactgttcatcatcagcagctggaccacgaaagttttagtacttcgtagtaggctctgcgtcaaacacatatctgaatttttttctgcagcagctattgctgctaatgcatgcatgttcacacagaaaaaaagcaagtactggtcatcccatgatacaaggacgacgcatatgctcgtaattaattggccgcttaattgtatatatcctccatgccgacacctttctaagttctaaccctggattttgagccgattaagaaaagattaatggtaatagtacacacaagtttatattgtctctgcgatttgttcccggttaatgaagtcgccggcttacataaaaaaggttgatgttgtctcttcgactctaaacatttgttaagctagttggtgaatagtacaactcaattacacaagccaaggaaaaagaagagggaaaatgaacttgaactcttcatagttggggagataaatagtctgatatcaatagtttaaacgtaaaaaatttaagttaaatgaatatattaaaattataccgatgaaatgcatgagaaatataatagaataaatgcctttaactcttcagtttcatatcggttaggattctcgccctccaacggatgatccaacgattaggatttctagggcgatgtgactcagtgcatgtcgagacttttggttccaactatataagatatatagattgtgcacgcgacatatactcgtataaaataatcatgtgaattattagactcctcctaaaaatcaaaatagttgataacccacaacatctacagatgaattgatcagatccaattcctttctttccggggaataaacttaatcctcttttatcgtcggaaagggtgcagaatggaacaaacaaagcgcagagacaccgaacgtcagaaagccgataacagcgtttgccctttgggcacagtctccagccattttcgatcgacgcatcacatggcgatcgatcgcatcgatcgatcgatgcatatgaatggcaacatcaagaagcatctttggcaacgtgtgaagaacatccatgatctatatggctagagaaagaggaggagatggagaaggagaaggagctttgggtttggataagggtgtgtttagttcatgccaaaattaaaagtttggttgaaattggaacgaggtgacggaaaagttaaaagtttatgtgtgtaagcaagttttgatgtgatggaaaagttggaagtttgaagaaaaaaattgaaactaaactcggccaaatgggattctggtttggacagtgactcgaccgacacgcctagtcccccacactgtgccctatccttgcagcacaaaacatctccatttgccctcaaaagccatcttgggtccataccctaaaatacatgagtatatatatgcacgcatactctctcttggatggataagatagactttgctgaatttcataaacttttttatctcaaaagaaaattttgaactttgagaacacaagtgtagaaaaagtaccgagttcattactccctccagtcaaatttatttaacatcgatgtcaaatattgtttttactagagggagtatatcgaagtataacatttttataaattctaatttatatactctctgttttaaaatacttgtttggttgtctttctatatttattctaagccaaactttttttttatctttgataatcaatatattttaactcgtatggtttaacaacatgccaattatgtcttataagtatttctcaagataaatctacaaatataaatcta

SEQ ID NO: 46978 - DNA, 1116 bp, Oryza sativa
tcctgcacgccccccaaatacaagcacataaattatttataaagagaaaagttttagactgtaatgtatgatggtttataccttatatttcatctgaatgcgtcgaaggttgacctcgcattccatggcctcccgttttgtctcttccctctgcgaagaatgtattatttagttgcagaagtataatttggcatgttaatgctgatgaaccaccgtaaggccagttcattcatgaactaaccttaaccaaagcatccataagtgcctttgcctggtccaagttgcgccgtacctaatagaaattttcaaggtagcattgtgagaactagaataatgaaaaagcatatagtacttaaaatgtaagaattcaaaagccacagctaaccgattatcattcacaggataagacaaggaaatgatgtttcagaatttaagttatacacacaaaactagcacagcactcaagttgagagctatgtataaaatagaaacagaatgaagcaaaaagcccttaaagctaaaaataaagaaactgttgggactttttctctttttgagaggaaactgttggaatttgaaacaaagaaaagtggcaaatggcaattattccattcaataacatggatattaaattaagcagaacaaaccaatcatttcaaccaagataacagaagttctccccaaacaagacaactatagcaagaagagtttgcattaaagttaaaattatttacagaaagaccttcttgtgttcatttctctagagcaactacacagctaagttcctctttgtcaacaaacaatagcaaatcaagagtgcacaaaaaagaataaaggactagagttttactaattaacgtgcagatgaaacatgaaaaatattgaaaaacagatttctccatatcaaatcttggtaatcttgagacatgatttaacaaattaagagcttcaacagtgtaagcagacaaattggtttataatgcttctagtaaggtgtaaaaactgagtacattgcatagacctcctccacaataatatagtaggattagtgtttatcatacactggtacactgagaacctcatcaagcagaataatgaacaaaatatcttcaaaga

SEQ ID NO: 46979 - DNA, 18424 bp, Oryza sativa
tcaacaatcagttttggtattttaacaggaaaatggcaaattactaaaaaagacacaccgaagaaattgtactaacctgcaaacgccgcagaataggcttttgccatcgttccctctgataaaagaatgaaaaatgaatcagcaagcaaaaggaattatgtaaacacaattaaaactaaatatctaatacgctaaataaatatacactacgaaaaaaaaggctgagaccatgtgaggaaacaacaatgtgacttgttacaaaaactgaaaatgtaagcatatcgccaccacaagaaatttgttgttgcattctcattttagagaataccttgtctttccaataactatatacagcttggaaaactccataccgaacagataagtactgcaatgcctgcacagagaagcaattctaagcaaacattgagaaagaaattaacaaaattacaagtctgcagtaaccaaatagaaatagtgggaaaatggatttcttcccagaaatcttgaaaatactagatccagaatcaagtgaactacaaattcaacaccagaaaagatttccattatatttgtttccgctgaaaaatcttatctacatcattgtcttgcaatccttacaatctagtaaagttatatgatctctacactagcaaggcacactaaaccaaaaacctattttgatcaatatattaatggaataacaacttattcacatatatcagcacaagaaatgcatgaaatgtgaatcaatattagcctatataataaataatcaatagttattaactatagaagaagatatttctacaaccttagacattaatctttcatgtatcctttcctaggttgacctgactttggcatggaaataatggttacacatctaccccaacatcaccattaagatgataatgacattcataatcacaatatgttgaattagtgtgttatgttttaatttacctgtattctagaaggtaaaagtttttatgccctgtaggacttctactatcatataatacataaaccacgaacattaatttaaaacatcttgacaacattataaggaagtgcatgaagttgcaaagaatgtataatcatgcagaacaaatgacgtgagtgtggtgaatccaaatcgactttctgtggattcttcattgaccacggcattataaaagtagcaacagtctttgggtgaggcatccaaaagaaaagcacaaccacagaaagtgacactatactacaacatatcaatagaccaatatggcttcataacatagcaagtaaagaactgcataaagaagttgtgtaaccatgttagtaatatctgaaaatgcagctgtcacgtaagcatatgccaatgacatgtgacgggagttaggagaattaaaatttgaaaaccacacaatgtttactgggatgtcaagtctgaggtggaacaacatatatcacttcaagataagtgtgcaaaccatgtgctagagccagttcaagggatccctagaccataggtaacatgtcccaatacaattgacacatcatgatggttaagttattggaaagagttcatgttgtaaaatggattaaaaacaatgagtcgttatctcacagttgatcatgatgtcaatagataaggtatgattttactacattaacaaactatacatttcgcttgatgtttatacaagtatgcctgtattgcaaaatgcatgcacatagatccaaatgccaatattataatctcccttcctcttaaacatcatcctatcagtaacatgtaagattcccatttagcatgtggctttacctccattgcagcatcaagctgcaagaggactggtacaggtcctatgaaagttggtgtaatggctcctgctctttctcgagctttgtggtccaaaatttccaacttgaataggaggacttccaacctgtaatgtaggaccatttcaaactgtagcaaaaatacatgcttcacagggggaataacatagtggtgtctcaacagatttcttcatattcaagacagaaaacgttaaaagttaaaattattcccccctgttttgtattgtcagcagttatatgacgtacataaccagtaagtttagctcttgcaaccaaagtttcctcagaaatactacatgcaattctaagttcacatgttatagcctatgtcttggaaggagaaacgtttctaattaaaagtacaactagaaactcctgatgttaagttttagatttcaaatggtgcatacttcagttataatgaacatttcaactataactagtaaaccaagtcatctagatctccagaactttcttacttttcagggttaagattcttccgctcattgttgaagtcttcaagccagtcttcatcttcattgtccagatcatattcgacaaattcaccaatctcagccctggctgcggagtgtaacaaatcttagaacagaggccataaacaagatattgtaaaaacaataccagagcagtaggaaagaaacctcctcttccacgtatataacaggttggttgtgcgaaggttcgagtgtagtccctttcataggtgtccacagcatcaaactgaggcgttggtatctcttgaatgttcttcttagtgggtgttggatttccctgcaaagagaagtaagatcacccttttgaatagcatgatgccaactaaaaaaatatatggccctctgaaatagtggttgctctgtccactactctactaaaagaaacgagtacagcaacaacacaatgtgtggcataaatagtttttttcagaatcttagcagtttcaacaattttgattttcttttcaaaaagtaaggcaaaagtaaccctactgtttcatttatatagaaagataaatttaaatattgatagaatgaagtgtattgttgttgtagggttgcaagctatctgagacacaattaaagccaaacagcgcacatatctaataggatcattattgcaggttcaagaaaaggttatattggctagttgcacagttaaatgttgctagccaaatacaggtcgaagtacaaaacctaagaaatgcaaagtgagtactaatacaggaaaatgaaaagagctaatttcactgctccaaatagccgttttcttattcgtaacacatatgactgcaaacctgagattgtgaaatgaatcaaatgactattcattcatgtacataattgagctgaattcaattcaacttgctaataggatgtagaacagaacccagcaacttaagaaagctagcaaaatgcacccaggcaacatttcaaagaatcgtggcacaatccagtaatccagcactatgaatcaaattacctcgccctccgtggcagtagtagcagcagtgagctccggcgcggactgccgcagcagcacccctgcccttgcgaccgcgaccgccgcggccgtggggtcatcgtcctcgaactcccgcgccgacttgaggatggggagcttcttgtggatgtcgagcggccgcggcctaaacgagagcctactcatggccatcaccaccaccaccaccaccaccgccaccccgccgcctcatctcatctccacctcccccacctcctctccctctctctccacccccacacgcgccgaccgctaccgccccgcagggtcggggcccaaggaggggggagcgcgcgcgggcaaaccctaggtccgcgagggccccgtcaggcgggggcttgggttccggcggccgcaggagccgcgggggggcggcgtgaagggggaggagagaggaggctctccgcggcgagctagggttagggttttggaggtggggaatcgagtttctagggtttgaaaggaggttgaaagggagggaacgacggagaaaggggggttcgcgggcgacgaagggtggccaggccggcggctcgagctcgatgagtcgaggccgtacgtgtacgtatccgtatgggcgtaatggtgtccgtacgcatgcgtacctaagcaagtgtataaaggttttttttttcactagtagtatgcccgtgctaacgctacggtaatatttggtaatttatcctcaaccaaaagacgataacagtatttatgtacatagtagtattgttctctaaatcaggatttcagttgccaggaataacactaattatattctattatgattctattcttttttttttcaaatacaccattgtcgaagcatttttttcccggtacgtataagattgtgatatctctatcgactatttgcgcacataaatgtaaaacatgttctgacagtgcaaaatatggatggcaaccataatttaggtagggtgaacaaaacaccagatgtgatattctttctagcaagtaaaataataggcaatactaccatatgctatgattcatgcgttaaatttcatacaaataaaacaaacaaaacaaagagagagccgacaaaaatggttgttcttgagtagtttctgcaaataaataagcattcgctagacaaatgaagagatagagagagagcagagagactctgcgagtaggaagcaatactatgttgtagcaccagcctcttctccttttgcaagtccaccttaagatagcctcgtttaagaccgtatataataagctgcttataatttcttatagttgctgaagtcgaagaatatgtgtgctaaacaaaataaagaaagtatgtgctacctgatatcgataaatagataacctacgtgtgcatatgctaaatattccaattaagtggcatagtagctgagaaacaattaataagtaagggaaaaagtccaaataccctcctaaaatttatggaaatccgtctagcaacctgaactttaaaatcgacatccaacccgcctgaactttgccataccatccatattaccccctaaggtagtttttgatgatggttttgtatattttggaagtttaaatgaacaattttgaataactaatataacatatttgaatatgatcagttataaatcatcaatttattcttatacaatgatatcatgctattattatgttgatacttgtttttaagtgatagctaataaggagcaaaaagaaatatttaagtcaaaattttaatatatatgttcgaagtgtatgacatgtgatcaaactcatccaacttatatacaaattagataaaaactactatgcaaatcatccttggaggttatataaacggtattgtaaagtttagggggttgaatgtccggtttcaaagttcagagtgctagacggacttccatccaaaatttagggcgttatttggactttttccattaataaataaaaatgtagtacagctctaatgatattgagagaaaattcacctataggagcattcatgcatgcgccatgatcaatattacgagaaaattcacatatagttagttgcccgtgcgttgtaacggaatcattttacagtccgatattcagtttattgcaataacaaaactgacaaaagaatagtatgtctgcgaagaatagtatgttagacatgatacctggagtacttttcccaatagatatatcactgtactaacttggcaataaatgttttaaaaaatcatcacaaaagcttgcaataaaataggctactgaaatgattgttcagattagacatgtgatgttttttgacattacaattactatttcttccgacgaactaaaatatagaggtactggtcacatcctttgtcatcgttacaagctcaaagtaaccgacagtgcacaacataaggaccatgacagtaatttggttagtacaggataaaagttttcctttaaaaaaaacaatgacaagtgttcctaagaaaaatttgctgcaatgctcctccacttactttgagcttaatggtaagtgcaaaattgttacactgatatgatacatgcataggtgcaccaaatttgcataaaaatatgaaatttgccaaacaaggctataaatatgaaatatgccaaatagagactacttgagtatgttgaaacttgcaatacatgtatagatagtggttagatttgtttatatatgggtgagccaacatgatgttaataatgcagaaactcttgttgtgttcgtcttgcagtagtgtaacacaaaatataattttgttccattagtgataatgccttcaccaccataaaaatgcaaaacaaagtactcctttcggcatttcatcaaacatatgtcatgcatgaccaaaattgcaaaattgcccgtatatggtagtaatgatcttgacgttacccatcttgtacagagaagacctgcacaatcaaagtagtaaaccaggagccaaaccgccaaacccatcattaacacccaagaggtcaatatatataatcagatagatctgcctccttttgcaaagaatgattttcacccgttgttgaggaagctgacgaaggcggcgacgggaagaggcaggaaagaagtagcagctgaggcggtggtcgtcaccgaactgtctatcgagttcttagcctctcgccgttttctggtgctctgtagcactgttcggggtggacgcggcggacgtcggcagagggtgtagagtcttgactgagaggcgtggtcacggcctcacgggtggagaggatcccgacaacggcaacggggccgtggaggacgggcttgggcgccggtggagacatttccgatgaccgcacaagggcgcggagcattggaggatgatggcggcttcgggctagggctaggcggtgcggcaggaagggggcaacggtgaatcggcaacggcgctagggcgagcaggcgcggagggcagaggcggcgatgagaaggatgggatcatgggattgatgagggaggggtgccggaggagatcagcgcgatgggcggaggcacgcgagcagtgggggtggcggcgaagaaagcgggaagcggggtaggaagggggtcgcgatggagggcggcgaaagggaagggagcgcgcgtgcgaggtgtgacggagcacggagagagagaggatggatgcgcgatgtgagcgtggatggggcgtcctgtgcgttgatttggtgggaggatcctccgaaacatctcagccattaaattgttcaggactcaccgccaccactacataatttttaattagtagagattttgttcgagtataagtattacaccctccatcctaatatataaagctctgtttggttaatgggatagaaaaatgttacacacccaccaaaagacgtctctaaatcctaaccgttcattcttcctcttccatttaatcttaacccttcatttatttctcaatctcaattccacccctcatttcacattatccaaacacaccctaaaggttcctttgaattgcaggaataaaaaaaacgaagaaataggaaaatcacaagaatttgggaaggtggttaaaaacaggagggatttaccaaaacacaaaggaatgtaccggttttgattgggaccgttagaaaaaacacagggaatcggtatgtagaaagatagactcgaaggaaattttccaagaccgttgatctcttgttaagtttcctccaaaatctttatagattgttcattccatagaaatttcaaaggattggatggattcaatcctttgattcaaaggcattcataggaatttttcctataggattaaaatcctctaaaatttttatgtttttcctccaaatcaaagggaccctaagagactttgggatcgacatatccttcgattagccaagcgaatgaacacgagcgattatataggttcaagccacccggaggtgtaaaactctacacatgttttttttgctatatggatctggaaagtacaagctatgcctttttccaactaagaaacaagcatcctttttcatagcatgtctccttccttttatagcgtaaggaggggttcaccgtgttgttttctacttcccctccgtattgtctttcagctgtcttgtcaatgttggctgatgtcgagtgattgctccctcagacagcggggagtggagacccattctctagagtgaagatccgaccagggtgttagtcggcgagaggtgcagggtatctgcgttcgtgatggatttgcggggcccggccaccccgcgaggagagggagactggagtttatacagattcggggcacccggaggtgtaataccctactcctgtgttggtgttcgttgtcttccctagatcagctaagtacaaaggagacatttacaggctacaaagtgagagtactgatctaaaagaatccaacccttcatccgtatctggtccccttcctttcatactacaaggaagggctcacattattacgaatctactcttagtcttgtctcatcaaccgttttgtcgttgccaactggttccctaacgcaggtctcaacacagttggagctttatccagaaggtttcactgctttttcagattctcagaagctggctaccaaacaactacttttcataatctaaagcttccccaacaggtcctaagtttctgtaaaatcagttgttgctttatgcagcctcactaaaatattgtaaacggctttatttggagctttcccttgtttaatttaccaaatgatttctcctctatgcttttgattaacattttcttatatggggtctcatttgttaaaaatgccctgtggtgcgtcaggggcagggctggctgggcggttccaaagttagccagacaaaaatttgaatttcatagatgaaattgactaatttctagcaataaatcggcccgttttggctaagaacaaccagtttgcaaggaatccgaccacgaaaatcgatcaatttggaaggaaaaccgacggatgaaaagtaaatttttcactggtggtactaggtggacaatttgaccatgtaaaacatgttttcaaagaaattttgtgtccgaagtgttgccaatatgatcataccgtttgcaggaattttgtatttttaatatagcaacattgtacttcacgagacacattagtattaggagcatctccaagagcctctccattgcactctcaagccaaattttagccattccaaccaaaaaatatcctctaacagcctctccaactggatggtaaaccctccggctggccaaaaccctccctccactagccaaatttgaccagacaaaactcactagccaatcatgggccccacacgccgtcctcctcccatctcctctccgacttctcgcatcgagccatcgggccatgcgtgccacttcccgccgccggcgccggcgacggcgccaccagccgcttgagctacggcacgaacatgctcgacccagaggacacatgcatgaagtggctggacaccaagccgctgagcttcgtcgcctacttctccttcggcagctttgcgtccctcggcaccgcccagatggaggagctcacccgcggcctccacgctgccggcaagccgttcctgtgggtggtcagggccaccgaggaggcacagctgccccgccacctcctggatgcagcgatggcgtcgggcgacacgctcgtcgtgcggtggagcccctgcgccacgggatgcttcgtcacggggatgacggcgtttctccacggcgagatcgagcagtgcgtgcgcaccgtcatggataggaaggagtaggacgccgggagcgatgcggtcgcccccgcccacacgcgtggcgaggcgcggcggtgtcccccgcggcagctctgacgccggcgagaagtggaaggcgttggttcgggagggcagcgaggctgcagcattggagatgtgtcgacgacggcacagaggagagaggcgccggagctgtgaccgccgccgtcatctgtgccgtcgcccgcagcgacctccgcccgcgcacgccacagtgagcgacggcgtgggcggcggcgaggcgacggacaccacaccgacacgctcgggtagcaaggatgaggaggacgaaaatacaacccatgtcccattaatttataatacacggtgacatggatgaatctcagacgtctatttttttatccaacggtatttttcaggttttcagtacatatgtagtttgcactatatattttttatgtttactctttctgtttgtcattttatcctggactaaaacttagttttgctatgtctctagcttcgggtgtttgtttagtgtaaaaccattctgtaagattggtcagctcattttatttatttttaatttttgtacaaagataatccgttcttagagcatctgcagcgttgggttgaatcgacgggtttggccaaaacatcgaacctagcacactgtgagatgcggctttttgtcagagtaattcgacctccgctgaggagtcgatctagtctagctgattagaaaaaattactacctccgttttttaatagatgacaccgttgactttttctcacatgtttgaccattcgtcttatttaaaaattttatgcgaatgtatgagatataaatcacacttaaagtactatgagtgataaaacaactcatagcaaaataaattataattacataaattttttgaataagacgaatggtcaaacatatggaaaaagtcaatggtgtcatttattaaaaaatgcagggagtatttcgttttgagaaatttttagttggaagtttgaaacttgtcggttctcttttatttccctttcgctgtaagacggtcaagactctgtaagacggtcaagactctgtagcgttctcatttcattaatgaaatgggagagaacagcccattcatcctacccccttcaagccgcatcgtgtgtgagttccatccaaatcttatccaaatattgtgttgtacgtagaagtcagcggtcaccgtctttaacagagccgctccccgctgaagcctttcttgtgcgttcaccgatctctgcagaatggaccagagattgatccatgagcaaacaacataaatcagctctaaagggtcttgtgttcttttatttttgaaacatgcagtatttctgaacttccatatagtccaatcaacaactgcaattctcactaccacaaaatttttctcctttttttaagacaaaatttgctacaagacatgcaaaaaaacgcgtaattagctgaggaacatcgagaaaacgtgaaactgcccgaggacactgcaaaaattgtgtaattggccgtaggacaccgcacgcattattttattatttcccggttaaaagttgtgagtatttttttgaaatgccaagactgcccccaatggcagtatattctcttcttcttgttgttggttgctgaagcagtggcagcggagcgcgtcccgcatccgatgtccgtcccagctcgttggtcgttgtcgaatctccatggatgcatggtgtcgttgagcacattgttcgacaggtcaaatagggaaaacaggaggaggtgacgacgacgttagcggggatgacgccggcgcgtgatgtgctcctccgtgactccatcccgatgtgaaggacagagattagggacgtgcgcgttctcgcacggaggtgggccacctgctcggtgaggtcgtcaaggtggcgctgcttccacatccacgaccgccgcaccgactcccctgccgccgacaccgtgctccccccactcccacttgaagaagccatcaagaaccaaacaatcaacggggaggtggatggccacggcgtcaccaccagacgcccgccacctagccgcgcccaccgctgcttgcctcctagctacgcctgccgctgctcgccacctagctacgcccgccgctgttgctcgcgccgcagcccacctcccacccctgcacgccctgtgagagagagaggaagaggggaaggggatgcgcctagtcaccgcacgccggcgcctcccccatcgactgcccacgtcacactcctcgccccatcgcgcgttcccggcgaagtcaacaggaaggggaaagaaggaaagagaaggagaaaaccaaggagagagaaaaggggcaatccgggtatttagaaaatatctcacctcttttgacctgaaaataataaaataatgcgaccagtgtcctgcagtcaattacacaatttttgcagtgtcctcgggcagtttcatgttttctcggtgtctttcagctaattacgcgttttttgcgtgtcctatagcaaattttgccttttttaaaaaccatgaacccacctcgcaaacaagtgatgtatactatggattggtttcaaatcaaacaaacagctcactatattccaaatgagtatggcaattggtcattctagtaaaaatgtgctggtggctaaggtgatggggaagggctagggtatctaagattcaggtctgttgtggataggaaacatttggagtgggttaaactaatcaatcttgtcggtcaattgaactgactggggaggaggataaagtggtctggaaattgactaaggccttgtttagttcgcgaaaagaaaattttttggtgtcacatcggacgtttgaccggatatcggaaggggtttccggacacaaatgaaaaaactaatttcataactcgcctggaaaccgcgagacgaatttgttaagcataattaatccttcattagcacatgtggtagtagcacttatggctattcatggactaattaggctcaaaagattcgcctcgcaatgtccatgcaaactatgcaattagttttttattttatctatatttaatgctccatacttgtgtccaaagatttgacgtgacgttttgggaaaaaaaatttggtaactaaataaggcctaagaatggtatcttcactgttaaatcattttataaagtaatgatgattcaaaatactggctttcaatttaagaatatttggaaatttaaaatccctgccagagtgaaggttttcctgtggctgatgttgaaaaatagcattttaaccaaggataacttgctaaagaggggtggaaggggaaggaggctaaatgtcagttctgttttgaaaaagaaattgtggcattggagcaattagctctttttcagtggcatactcggcatactaccaaatagggtgcctaggagtgacaaaagagcaattgttcctttttactaagagaaacattatacaaattagggaattgtttagctaatggtcttcctcccagccagctatcctcccaaaacaaagttcttttgccattacccacattcttctcacataacattaagaatctctctttaactttcattaaccccctccaaaattgagaatctccaggtcttagctttttctgagataaagtcttttgacctagatacttagctaatatcaaatcttgccaaatgcctttctcattttttaggcgccaaagccatttacccaacagagcaacattcatgcatcctgaatctaggatcctaaacccccttgatccttaggagtgcaaacagtttgccaattaataactaagtgatacttcttgaccccttgatcctcttaccgtaaaaaattagatctgaaaaaatctattcttttctttactccttttggcaactcataaaagacatcatgtataacggcacactgctaagacttgcatttatcagggtcaatctcccacatcccaagagtttcccctgtcaacatcttaattttttctcaattttgttttcagtaggactccaatctacactgtgaattctcttcttatcaattggacccccaaatatttcatgggcaatataccatttttacaagttaaaatctgacaatttaccacttctttttcttgggcccctcctaaacagaacagctcacttatgttagtgaaacgccatagattagtgaaatgcaacccttcccttccgcctgtagattcgacgccccgatttaaccttccctttcgcttctgccctaaggtgtacatggcggccgcactttgtgccatggtgggcgccgaatattgtggcgtgcttggaaccccgcgcgctcgcatctcccctctattgggtcggatcttacgggccgcttcctctggaccaaacaattcagtaaggttatttcaagtcttgtcacatcggatatttggacactaatttagagtattaaatatagactaattacaaaacccattccataatcttggactaattcgcgagatgaattttttcagcctaattacgtcatgatttgataatgtgatgctatagtaaacttttgataattatggattaattaggcttaaaaacttcgtctagtggattagctctcatttatgaaattagtttttttattagtctatgtttaatactccaaattagcatctaaacatccgatgtgatagggactaaaaaatttgggacaatttcgtttttgcccacactttaatctctaatattgattttgtccctactttttagggttttcgtttttgcccccacttttttttgaacggaaagatacttttgcccctgttttggatggaggagttaatggtgttaaataggactatataccctctcccatatctattcattaattatgtttttgccctcaatccctcattagccggaacagaaagttgagatttctcatgtagacctagaaataacaagagttcaccagaaagctaaaacgtctatataatgcaacgttgtacgttaggagtaaatttgacatccacggaacaatgtaaataattggacacaattggacattgcagaaaatttgaagcccaacctcaaatgcttcaaatcgcacacagatttcatatatatggtactccacaatataatgtcagacagaaatactagtatccacaggctaggagaaacacaaaacgagaacggaattcaacaaactcctgcaaaggagaggcgagatccccgctgctaggcgtggccaccgcggccgccgccgcggcttccctagcgcggaggagcggcagcgccgagacgccgaggagcaagccccgccgcgccagcacgtacaccgccgctgccgactgggacgagccggcatcaccagacgatgatgccaagttcgatgcgacgatggccgcgcctctccgcacgcggcctcgtcggcggcagcagccaccggaggacgaccggcactggaacgcgagcggccgcggcgccggcgacggtgcgaggaggagctaccccatcccgtcccccgcgacgtgacaatccccaacccaccaaaccctagcccccgcttcctcctcccctcctcgcggtggcgctcgccttcgagctcggaagcggaagcccacagtgaaaatggctggagggaggggctgcgcctagcccgctctccgctgccgccgccggctaggttttgaccgtgtcctgtgtgcagcgagagaagtctggaagggttaactgtttcccagaggtaaaaaggtaaatcactaattcgaaaaatctttatttccttttttttctctattttttactgccataaatccggtctcactaacttccattcaaattaggggtaaacgtctctttcggttcaaaaaagtggggccaaaaatgaaaaccctaaaaagtaggggcaaaatcaatattagatatcaaagtgagggcaaaaacaaaattgtcccaaaaagttttagccccatctaaacagcccctaaatcgcagaacaaacccacttcactagattctgtttgaagtatgatagtttggccaaagggtttgagctaattgctgaatttatgataatgccttgactgtcctctatggtgcaaaagactcttccaaactccccattatttttatctagggatcatgaaacacccaacgagtaaagttgaccccaacaagtgattcatgtataagcaaagaattgtcaccttctagcatataagtaatggttcatgtaaatgctgcattccttggtgaaattgcattttgcactggcctcagatgaaaacttgcatgttcgacagcctgccacattccaacccaagattgcagaacctccagaattaccaccttgtactacagatccgggcttcagtgacgggttatctgtgacaggccaacacaactcgtcaaagatgagtcatctctgacgggccgaaaaaatatcctcttcaatatatggctactagggaggacccgtcacagatgtgaagtcatctgtgacggcttgcacttgtaacccgtcacagatcacaaccatggctcgtcacatatgacatgccatctgtgacgggtgtagtattatgaatcatcacaaaagagaccactcatctctgatgggtatttaactaacacacgtcacagataacgttatctctgacgagtggtagttatgacccgtcattgatgagtgaaaattcaaaattttaaattttgcaaaaaacctcggattgagacatgtcttatataaaagttgtagttctcgatgatatccacaactttataactaacaacatttctattagagatcatttatatccccgaacatgcattacaagtgatgagatcttacgtttaaaaacaaaattttgagttttttttcaaattacatggatggatacatgccccatatcaaagtaatagaactcaaccagatctacaacattataatcgaaaatattttcatttgacaaagtttacatgttcaaaatacaaatacatgttataaagtgagatctattttgaaaaatgaaattttgaattcttcaaacaatatcggatgaagatattttctatgtaaaagttataaaacacgatgactatttagttgataatattttcatttgaagtcatatttagggtgttaaatatatgttaaatgattcagacaagcatagacaaaataataatattgggtgagtagtcaatatgtattgagtaggtgagttggtaagggagctctctatggaggttgaggtcttgagtttgaatctcatgtttagcatgcaagttatattgcgtgaaaaattgtgaatttgtaggtagtgatgtgtaaccatgtataggatggctagtaaaattcaaaatatttttgaggtttttttgcgtttaaaattcaaaaattgtatttcttgctgtgtcatcagtgacgtgtcgtaagttacaacccgtcagagattagtcatcagtgacggtcaggtagttacgacacgtcattgatgactcatctgtgacgggtgacaggttttaacccgtcagagatgacttatataccggtcagagatgagttatctgtgatgggtgtttcactcgtcacaggtgattttgtcatcagtgaccactaatcactaaccaagaccaaacccgtcaaaggtgagggtttgggcccgtcagagatgacctggtccggcgtagtgtgggtctggaaacttgcaatagttggtatgaaaattattattttgatccttgagtaccaattgatttatgggatatttaactttggaccacttttaaaatgtgtcaattaattatttgccactcactatctatgacatgtgggttctcatgtgtctatgacatgtaggtccttgatttatagcctccacaacacaaaataagttggatgctactgatttgatcacatgatggaaccattttccaaaagactgaacagagttcttcaactgatacaatagtgcaaggttggcaccacatgagtccaggaaactgcaatctgacatttgttgttaaccaccgtcattatctcaactaaataatttgaaaaacagtccaagctgaaattcagttgcttcccttaattctgtgcactcatacaggaagctaattgatgttcagttggctttagtccgttctccttcccaatatcggtatgcatatatcatgcataattgcaattctggcctgagccatttgttcctccccgtagaacttccaatgattgtgtactaacacacccatgttaccgtagacgagcaaacattcacgtaaccacatatcaagtattggccatgacaggtcatagagaacaggcactggtggagaaaccatttttggtcggtcggccgaaatccacaataatcccggttcctctaaaaaccaagactaaagatgatttttagtcccggttggtggctacagtgggcatatttgatctttagtcccggttggtaacaccagggactaaagatgatctgtagtcccagttctaaacctgtcaggccttgtcaggccccctgggatctttactcccggttggtaacaccaaccgaaactaaagatcctaactttactcccagttggtgttatcaatcgggactaaagatcaaattcaacgcttaatatataatccttcttccctatcctctcctctacaaccacctcgcacttatcctctcagatcgatctccctctcctccctatcagatcgatctccctctcctcctccccctccgcctcctccatttgctgctcccatccc

SEQ ID NO: 46980 - DNA, 5936 bp, Oryza sativa
tccccctcctcccttcccacgcagcaggcggccggctgggccgcgcacgggcccagtggcgagcggcggcaggcggcagccgctgccggtatttttttttacaatttgtgattcactaagatgtataattttgtgatttgttgcatgatctgagatatataatctgtgatgtatttggtttgtgtgtaattttttaaagatttgtgatgtatttgatttgtatgtataagtaacttaagatttatgatgggaatgttttgggatgttactttgatttgaggtttgatttggggatatgtatcctacttgatttggagatatgtatcccacttgatttgggagaaaatacaaggattaaactctagctaaaaaaataaaaaaaagagacctaatgggactgccgctactctctctttagtgccggttggtgttaccaaccgggactaaagataaccaacaccaaccgggactaaagatggatctttagtcccggttatttcaatcgggattaaagatgggtatctttagtcccggattcatagtcctggttaaaaaaccgggactaaagggggttaccaaccgggagtataaatgatttctttaccagtaagggacataccattgtcaccaaatgacaaacaaaaggctagttgctgctgcatgcaaataacttgtcattgactagagaaggaggaggccatggtttctttttagggaaaaaaaacatgtatcccgacattagactgtcgagtcaaagcgagaagccttgaaagcgaaaaagaaagaagagcaaagacaaatatttacaggggaaacagcacttagggctactcctcgctaaacaggaaaatgccggcagctctctagactgtgacttcctcctttatctctgcaacaaggagttcctcagttttctgcttatgatcaaagacccgtgcgttatgttccttccaaatacgccaacaggccaacataaaagaaagaatcaaacgaggccatggtttcaactccccccaatgcaagactatatccatcatctcagagtaaagcattccaatatcttgacaagccaatgcaagacaacttactttagttggtggcacccaaggtggcaaacgatgtactcaaccagtcagttcataagaggaaaatgaaaaaggaaggggggaaaaataatacaccttgatgtagggtttcgcagggatggcggtggcggcttcgttgctgctcgaatacgtcagccgctcgctgcggtggccgattcctcgcgctctcaaggagctcctcttgtcgccccactgccttaaagagagcccacggtggctctacagctcaagacggtgttgggacgaaatcccaacagaatatggtcagctctctcctaagccagtcgccagatttgatctgtgtaaattgattacccaaatttattgcatatcggatccaattagctgtgtgtttttcctaacattgggtatatgaataatgtcttttttttttcttaaaacttctcaactctgttgccatatatgcagagttgttctttttttcatttgggcgacactgggacatctaatagttttcttttattttggtggttcactcagacgaatttccttaaacatgtaaccagagatattactgcttattgagatctcaagcttaatcacgccaatagcaggggatcaaactatctttattccaggagttcataagagctcggatataatccatgttccattaatttataatacgaaggaaaatccatgttctatctttatcaaacggaagtttaattgcattataaaccaatgttccattattaaattataatacaaaagcatgttgcatgtgtttgcaggctttacagcttgaaagggcacaacgagatcctgcagagaagaataaaggggctgtttggtttacacgaacttattccaagtccctgtcacatcggatgtttggacactaatttggagtattaaacatacaataattataaaacccattccataagcttggactaattcgcgagacgaatcttttgagtctaattacgccatgattttgacaatgtgatgctacagtaaacttttgataattatggattaattaggcttaaaaaaatagggtgagaaagggtgagaaagcacctcgttttccacgcgcacgcttcccaaaatactaaacggtgtgttttttgtaaaaaaaatttataggaaagttgctttaaaaaatcatattaatctatttttaaaatttaaaatagttaatacttaattaatcatgcgctaatagctcacatcgttttacgtatctttccagtcttaccaatatccttctcctcgaactcaccctaaggctctagaagagcgcatgatttcacatatgggtaatttaaaccgcggattagataaactagaaggaaggatcgatggcctgagtgctgtcttagaaagggaggtgctacataaaaagtaattaaccaatcactttatttatttactgtatatatactagtattgcatatgtgttttcgttgcttgtttatcctaattatgttcattgtaactttcagatgcgatgaatggacactaagggtggtggtgggtctgactggtatatatggtgttgcttttcttgttaagaaatcatgaaatgcagagtcataagaagaaggaagatcttttcagaagcaagtcaacaagtgagataatggtcaaggggaaaatccttttaagcctttactttggcattttttttgctagtttagtgtttagtgtatatgttcttcacttcatcctggactagaatttaactttgctatctctgacttggggtgtttctttagtgtaaaaccattctgtaagattttggtgaagctccttttttattggcaaaattggttcttagcatccaaagttttcaattttggttttatagtaccaaagttcaccgtttactataatagcaccttatatcgtacctccgtttctatttatatgccttccgtcgcactcttctgttttccgttttctttaacagtgctggagatcatggctgagagaatggatcatctttccccttcttaattacaggattagttttgatctcctgacgaaatgagcgaacgtactcgttccgggtttgcatcgtctgcctttgacgcaaacggcaaattttgtccaagccgttcgtctcttaaccaacaactccatcgtttggtcccacgctgacactcccattctatggactactctgcacttaatactagccaattaattcagaattaggtcttgtttatttccctaaaactttttcttaaaaacatcacatcgaatctttagacaaatacatgaagcattaaatatggataaaaataaaaactaattgcacagttagggagaaaatcgcgagatgaatcttttgagcctaattagtccatgattagccataagtgctacagtaacctacatgtgataatgacagattaattaggctcaaaagattcgtctcgtggtctccaggtgggttatgaaattagttttttcatttgtatctcaaaaacccattccgtcatccggtcaaacatccgatgtgacacccaaaaaatttcttttcacaaacttagttgtttgctctataggaaagccaacaaaatgatctccgcaataaaacaaggtaaaatagagctcgcaccattggcaaatttgtgccaaataaaaagaatatagaactacatctaatatatttactcatctctcgttccataatacttaaccttctgaataaaattagagtcaaacaattaatctttgactatcaataatatttgaaacatttggtttgaagaaattagaacatgatgtataaaattagtctaaaaaatgatttaataaacttaaatatttactttttacgtatattataatataaacaatagtggggttagaaaaaatatttgagcccgggcaaaaatttcaccatcagtttattcaaaagtattaaaatttaatggtgttttcgccggcgatggcttcgcccctgaatattaaaatatactacctgtgtcccaaaatataagaactaacgatcagatgagacattctgtagtactacaaatctgaaaatgtctcatccgatcctaagttcttataatttgggatggaggaagtagttaaatatatattttgtaatatgtttcatagtacaaaatgttaagaactatatatagacatagtgatatgtagattttttttttaattgtacgataatttctcttttgtttacggtgaatataggacaaaatagctaagttgattatatccatgagtaggttgttaaagtgatttattagcacatcagattctattgattagtggctgttaattagactatgaggtgggcctaacatacaacggttgattgagtgatgaacggtttagatgttatcaacggcaaagtttgccgtttgcctgaaaggcagactatgcgaactcactcgtcctgtcgtccgttctcggtggcgacgagctcgacagttctcgccatccctgtcgccggacatccctatcgtacgcggtgacggtggcggctggccttgtcatgccgatctccttgccctcctcctcccctggacgtccccatcgccaccatcgctggcattatgcttggagaactgcatatgaaatgaaggtgccttctaatgaatttcatcgagtttttttttaagaaaaaggtcataagacctggcttctattgaaagtccgaaggttgtgctgggaaacccagacaccagattacagcatagggagggacgaggccttcaagatgaagaaaaaacagacttagactcaaactaccagctctaattaaaagaaacaccacgcccaaaaggaccaaaagggttgctcatacaagcagtttcagacacaaaacacaacctcgggggtcgacctagttcgcgattgatcgcgagaccttatgacccacgatcaggtccccccacatggtttctttttttggcaccacattacttctctattttagtaattttatacacctaaagtttgtacacctcaagtttacacatctaaaatttataaatcaaaagtttatatattgattcaaatttaaatttgaattcaaatattttttatatatagaatttctatacatctaaagtttatagactcaaagtttataagtcaaaagtttatataccctattcaaatttgattttgaattatatccgattcaaatttgaatttgaattcaaaattttttatatatagtatttctatacatctaaagtttatgcacctaaagtttataaacccaaagtttataagtcaaaagtttacatacccgattcaaatttgaatttgagtacaaatattttttatatatagtatttctatacatctaaagtttatagacccaaagtttataagtcaaaagtttacatacctgattcaaatttgaatttgaattcaaatattagtttatagacctaaagtttataagtcaaaagcttacatacccgtttcaaatttaaatttaaatttaaatattttttatatagtatttttatacataaataaaggtctaaacaatcgctaacatcagctgtgtaaaaatcttgagcaataaagcaactaagtattctccgcactcaatgggccgaaaaatggatttgcactgatcgcgtgatgctcccgcacgcgagcgatcgctgattagccatttcgcaacctcagcagacaggaagaactgaagcatctaagacaccccctcaactaagctatcaccctatgcccagcctattacttccagtgttggcagcagcgaccttcatcttctctcccaactccatcatcctgttagcttcttcagcacgccctaaagccttccactgcagcaaataggaagcaatc

SEQ ID NO: 46981 - DNA, 1012 bp, Oryza sativa
aggttagcactttggaagcagtaagatttttcctgtagacaatgtcgggggtgaagttaacaagagagcgaacaataggttcgaaagatccggattaactatttccaaatatttcagccgagtgcttcacgcgatagtctgtatggcatgtgatgtagttcggccaatggacccaacgttcaataccgtaactaggttggtgaaactacaccaaatgtgttggtcatttcagactggagcgaccgcgtaatttttgatgtaactggatggccggggtcagtgcacgatcaccgggtgtcctgatcgagtgctatgaggaagtatcttgatcggttccccagggtaccgccaggtatttacttatggtacatttgtttttatggtattaacataattcttagtgcacgacattaaattttttgttgtaggtaaatattttctcgtcgataaggggtatgcgaataggtaggggtttctcgcaccgtatcctgaagtgaggtactagcagccgcaatttgaacatgcggcacctccccaagatagggatgagattttcaatttctaccactcctctctgcgcaggtcggtcgaacgacttttcggacgtatcaaggtgaggtggcaaatattggacagtattccggcttacacaccacgtgcacacaacatgattattcatgctgccatggcattgaacaactttattgttgatagtaccgaaccaaactctatcagtaccaaccccctataccatactcatatccacccggtaccggatgtctctccagcacatcacacataccatgcgcgtgataccaaggctgtgatggatatggtccgtgaaaatattgctaatagcatgtattagcatttcatatttagcagtatttacttttgtaatagtatcggagtcatctgatgtaccatgtattaattgtgctaatatatatgtactgctatttattttgcaatgatgatatgctctctaatatatgtatgtactgctattgat

SEQ ID NO: 46982 - DNA, 4605 bp, Oryza sativa
agcaattttaccaagctgctgtgacaccccgcacttttaccaaggacgggccctctctacatcacatcagcacttttactaaggctgacgcccgcacttttactaaggtctagcagctttcctacagctgcggtgtagccaactggaacacaacgcacccgggaggaatttcccgatcggtcacccatcccgaaactgctccagggcaagcatgcttaacctcggagttttttcgagatcggcttccagaaaagaagttacaacttgttgattgagtattctattaatcctattaaaccttgggtcgggatgtcacattctcacccctttaagataccaacgtcctcgtcggtcaacccaggccaggaacatctcctattagcaccacgtatatacagataattttcggcgcacatacgtcatgccatacgaccacatcgtggatcatcccgtatgcaccgtatgcccgcatacatattcatatatacgtatagctgcaagggtcggctctgataccatctgtgacaccccacactttaccaaggccgggccctctctacatctagcagctttcctaagacatagactttcctcatagactaacataagtcttttctgcacactttgtcctcactcgtgcgcacccgggaattttaagcaattttaaaaattaaaaattatgtggcttatatcattaattaatcaggtaactagcaaaattgttggaaacaagaataagccactcaaaatttataacattcacatatgttgaagtaaaacaaataaataatgtccaatataccaccccaatatattaataataataacatggaaatattatacgaacaaacgccactataaacagtcagcatgtatacatacacttacactaataatgcaatacatcatatatttgaatatatggttgcacagcacatacatggtattaggttgggcttggggtgcatggtagttaatatgtcaataaatatatctgtgagaccgttatagggcgtggggtgcatagcaccattgtcctacaacatgcgatacgggtaagccgtctggcacctctcacttaagttgggttcatcatctggctaattagcactaagaagccacacatctcaaataaataattaatctcaccaaagggacctcaattcaccagcagtagtaattttccaccaaacacatagctccacataggaggcctcacacaaggccacaaaagagagtagcacggcttagcactgaagtcaagcagtcaaagtatggccatgtctatagcaattactacaagccggtgcatatgcttatgaacccaagcccatggtaggattgagcagagttggggagaagaaaggtaagtagcagggagtgaagaagaaatagctgacgcccccaattagcaaaatgcattattcattcccatttacctgtaagcaagctagctagttcttacctcttggccaaatgctcaaaccaccaccaatccaccatgccggctaggaaggggagagaagaaattgggtaggcagggaggtgatttaccaaggaggagaggccaacagatcggcgaggacgaacacgggtggatgaccgtggacgaattcgacatctagacaaaggtgaactttgcacacaagaagacttcggaaagtagagttacaacctctcgtagataaagttggatcaaggatccttggttggaaggggcgtttcttcacctctgtaggaagggaggttctggttaaaacaaccctctcatcgacacctatctaccatctcacaatcttgcataagaataagtggctatataaaaggattgatcgatttcggtgtgcttttctatggaagggggatgatccagataatgtcagttcgggtagtagtctcattaactggcagaacgtttgcaaacctaggaatttggggggcctcggtattcttaatttggaaaaattctcacgagctttaaggctgcgctggctttagtttggctggaaggaagacaatagaccttggcataacatggaagtgccttgtgatgaattggacagagtgccttttcgagctggaacagtcattaccctaggaaatggaaagaaatgctctttttggtctgataactggctttagggttgctcacctaaagatttagctccagggatcttcaacctgtccaggagaaaaggaaacaatgtgcacctcagccttcaaaacaaccactggctgccaatcctaaaccccattaccacgataagtgaaattgatgaactggtccagctgggtagccgtttgcaaaaagtcatgctccttgaaacacccccgatgacattcgttggaaatggactcccaatggagaatactcagcaaagagcgcttatgaagcacaattccaaggtatgattactagcataaacttctctcccctatggaaggcccaggcggaaccaaaacatcgtttttttggctggctcattttgcatcagagaaccctaacggcggaaaacttgctgagacgtcactggctatgtaattggatatgcagtctgtgtacaaacgctttcgaagatgcaaatcacttggccaaagaatgcagcttcacaagaaatgtgtggaatttagtatgcagctggcttggttacaatctctccccacaatcttggcaagacacacccatttcgaattggtgggattccttgatttttcttgcaaaaggagattcggcaaagaagaagattggagctctactcacaacgtggtggcaggtctggctcgagcacaatcgtcgaatcttccatcataaatagcaaagcgaatcacaagtagcttgcacgatcaaaaaaaatattgaattaattgagctttcgagacaagcctaaaggctgtctcagctgagtcgtttctcttctctctctgtaataggctttatgagtttattttcctttctggatgtcccctcttttctttgaaccttgatgtttttcgttttgtctgactctttttactccttctaatatatccggtagagctcctgccgttaatctttcaaaaaaatagacaaaggtgaacccctcatttcttaccatcatttattgagcatatagtgcagccatggcatgagcatcaattttctctgcacttgcacatcactatgagaaccaccaacaatttgtatccatcacacaaatgctagagccagagaggaaaggaaagagggagagaaagagcagccacagccgcagctgcagtagccgccgtcgccatagccatagcagcagccgtcaccgccttagctgcagtagagctgatccacacctagaagcagcagatcggtagccatggagtggatggtgagttaggggaggaacaaaagccttagcaacagcagcaagggaggagaataggaggggaataactagtgctgctgccttatctgttcgagagagaaggagagaatggaaggggattaaattgctggatgtacactactagactacacaagtcattaaattgaacctactaccggaatagtattgtgaagttcaagcttagagttagataaattagctattaaacataagaaagctggcacaataaaataaactctgcagagcacattttaattagagagcatttgcatttcttgtgctgaaattttattgaaacctcagcgtatataacaaatttcaggaaagaagctagagttggaacgtgtcaattggcagcagtatattatttcggtttcgatcacagaaaactcaggcaagtctctcatttgatcatgttgatagacataattctatttcaacgtaaaaacctatttcatacaaatatttctcctagtattgcatcaaaatatattttctagaataatgatatggacgatgatgatatgattgacaagccgatgatgatggagatcatcgggatactagtatggtgggtagggggagctcacggatgagatgattgatgatgatggcaggtcagggctctccctacatacggtgtataaatataaggactaatcaccccatcactcgtatcagagaatcgtatataccgtgtcgaccatagatccgtcttaagatgggctagtaccttatcaagtttattatactccacatgggtaaatagtagtagaatgggagatgatataaaccccatgaatgccgatgaagtgcattccaggcgcatatagtagcgcggtggtgtggagagctgataggctcaacacaaacgtggagtgtagtaacctgaagtaggagaatagttctgtgttcttagtatggtgccgcatctagcgaagtgcgacagtcaaacatgttaagagtagctatgggtacagtgatacaagcctgcacagtgctaaattaaatcatgattcacgtctgtctcctggattggaggctacggggagttgctacaaactctattcaatgttacgagtgtattttagcttttgcaaatcttcttctttttaaaaatccctttacaaaatagacttagactggtgatagtaatgtaggtgactatgttacataaattatggtatataatatagattattaacttattatgcatgcatttgtattt

SEQ ID NO: 46983 - DNA, 2139 bp, Oryza sativa
agatgggcttaaaactcttagggacgaattaaaggtagttctaactatttctctgttgcgatctctaatggtgggttattatttggcaaaataatagtttgttaaataataatctacagtctggcacttttatcttcaatgttaaaagtgcggggcgtcacagctgcggcaaccacactgtggtgcagcggctgcaccttacagccgaacaggcctagtatgttttttattctctgaacttaaatttggactttgtgagctagggccattctagtcttgcatttgcaatccataccacctcaaatttgtctcgctaatttagtttgaaatgtgtctcatttgtaaacggtactacgtaaatatggtattgcttagatgttttttttctcaataaacaaaatataaagatcgacgaatatgggtggtttctaaacttatccggttgtgtcacccaagtgaaaaaaaaaactacttgatatagcacattttgggtggtatggaagttaacaataataattgaatggaactaaactagcatataaaaaacccaagaatctcctatataaaatcctaaaaacaaaaatgtcaagatattataatacaagtgttacacgttgttgaatacaccaaggtctccttttgaacccctgaaatttacaaggttttcacattgactaatttaatcggtaaaattatgtcaacttggggctgaatctggaccgaattagcatgggccgatcagcccgaagcaaatcatgaatttttataccggacagacttgatcttgtactggaaatagatccctttcttttatgtctctcaaccataggtcaagttgcaatcacatcccttggccacaaaaccatgtataactcgtctctcagacttccaaaatcgatgcaaattcgaaacagttttaattgatgtgatgcctatgtagcatgttatcctggtcttttaggtgatgtggtacgacagcattgaacggggagcaaacaccgagatagcgagacaagagaaatttaactatttgccacataggaatgtcacctcttacaaactctttttttttaagaatttgccattttcgatgaagtgacgtgccaactcatactactagcatgcataggacatacaaaatgtccattttaccccttatgggaccaagtcagcccatcccctccctccatctctcttcatctcctgctagccaggcaaatcgagaggcttgacgtcggcacccactatctcctccgcctcaacgtcctaggtacttactagtaattcaaacgatgtaacctaatggcgatcgatgtgcttgatggtcaatttattatgctgcttagagtaattttcttgttttatattgaagagttcaaggaggaggatttccaattccaggtgggattgttgtcctctaccattgaagtttttttttatttgtaggcaactgcattgacatcctctaccttcgttattatgaccttttaattgttgtatactccctccgtactcgtaaagtaagtcattttggacagtgacacggtctccaaaacacaactttgacttcttgtttctataaaaatatttattgaaaagtaatatatgtatacttttatgaaagtatttttcaagacaaatctattcatataatttttatattttcaaactctacaacttgagagttattcatgatttatattcccaaggtttgacttaaatattgtcctaaacgacttcctttacgagtacggagggagtatattgttatttgcatgtagacccttttgccccacacggtcattttttttattagaaaaattagacagttggtgagagtggttgacattctattagaaaaagtttggagttggtgatggggtgatgatagaactgccaccactactactcaattttgtaagaaagtttggaatatgatgtcaaatattgggagacaactataaatcagacgctcaatatacagctaaaacttatgcaccgtcatagatgtcttatccccactatcctttgctattgtattgattagcctccctccccctttctctccatgcccggatgactaagatctgcgtggtacaccactaatctcttaatctttttcaaaaagtatttaaccaa

SEQ ID NO: 46984 - DNA, 701 bp, Oryza sativa
ttcctgcagcccctcatttctggtcagggcttatggctgttaaggagtccttcttctcgtatggatcctttaaggttcacaatggtactcagttgaggttttgggaggattgttgggttggtgccacatcttttggtaagctatatccatcactttataatatagttaggaagaaaaatgttgttgttgctgatgtgttaaacacagagcctcttaatgtctcttttaggagggccatcgtaggggataatctagtggcttggcatgaccttgtgtcgaaagttgtgtcagttaacctttcagagcaaaatgatgtttttagatggagagctaataaaaatggaatcttcactgtaaattctatgtataatgctctcatgtattgtgatgtagttccaaggaggactttcatttggaaccttagtattcctttgaaaattaagattttcctgtggtacttatggagagggattactctaaccaaagacaatcttgcaaaaaggaagtggaagggtagcattaaatgttgcttttgtaattctaatgaaacaatacaacacctctttttttattgtcatttggtaagatctgtttggaacaccgtttttataacctttgggattcgaccacccactagtgttgctaatatgtttggtagttggttaaatggtgttcaatctagactaaagtaccaaattttt

SEQ ID NO: 46985 - DNA, 5014 bp, Oryza sativa
ggtctttgttgcttaaggaagaggatagccacaaattgaatggatattgcaagatgttagaggcaagggtcatggagttgtatgcaaaatatgggtggaaccttagaaggagattggtgtagtagtgtttctcttttctcttttaagtgttgtcactttggtactttttttatccttattgtaaagaattcgggtctaagtactcttgtatgacgttgggctgtgtacatccattgtggatgtagaggccggattttaatccattttctaaaaaaaaaaattcatgcgttttcaaattcactgtttccatgcgatttcctatcctatttctaatttttttttctgttctgcattccaaaggatccctaaagttaggaatattctcaactaggtacattaaaatctttccacccaacacatgcaaaatatgttcatacatttttctttctcatattcttccttcttaaaactattgtattgctaatttttaaaaattatgatttttaaattagtcaaatttgggatgatacaatatatttttagtgcaccatgaaaatatagaaaagttgaggaacgttctgaaatggaggaggacaacgcaagtgcaaagtcatgcatttactggtgcattagctaatacttttatgcccagtttaaaacatattatttagctgattatctacttgattgtagggatatttttttatatgaatgctttgaataagttatctatgcaatacagtagaagaacggttttttaaatactagatgacaccccgcacgttgtagcgggacttctaagtgatcaacattgatttttccagtaggattgcgtgtgtaagaataacactgatacaattatagtggatcacttccaatcaaatatggaaaatctacagaggttgtaaagcaatgtgacaaaagaaatacatttttttgaagaaagacatcatataacagtattaataaaagctatttgacagtacatgaaaaattgcaatccttgtcatgggcacatgccatcctctttttcaactcaagatgcatgctagtaactgtaaatgtcatatgaaaacactaaattcactttaggttgctcccggaatagtgtattcgatgataatcgagttaaactcttatatcaatagcaattgacatgaaaggaaaggttgactaatgaaaaatcagatgaaaggtctagccttcatagacaattgcgtgaaaaatggtgcaattggacttgtgcattggaagcaatggtggtcatgcccatggttattaagaccggaccagtgactaaaccgttagggcactcggtttactggtttattggtttaaccggtcacaccaccggttgaatatggtttaaatagatgagtgttgcaatactaaacacaacatgtggcatagcctggtggttgaaagtcttcttggaaacatggaggctgtgggttcgattcttccacgtgacgctgcagcctctgctcctccacatgagcggtcgaaccacctccggttttgtccggttcaagcggttttcgccggtccgtttgattgccgatcttttagccgccggtctgtttgattgccgatcttttagccggacaggaccggccaacgcccaggttccggttttttcgggtcggactgttggtccggtccggttctaataactatggtcgtgcctagagtgcttagtttgcttgttacccgagaaaatgcaagccgatcttttagctggacaggaccggccaacgcccaggttccggttttttctggtcggatcgttggtccggtccggttctaataactatggtcgtgcctagagtgcttagtttgtttgttacccgagaaaatgcagtggcagttatttaagaattttactatggcacaaccatgatttatctcggaacatattacactcatgcgctttcctcaaagagcgtaacaggggtgactatcgtatccttgtaacagagtgaatgcatgtagatggatttgggatgagataaatatagtaaacaacctttctcgtgaaaggatgaataacaaattgtatgcttaaagaagattaaattctatttgaaaattcagtaaaacgaagactaagcatctaattaaccatttcagtatgcctgtgaacattcctagataaaatattattcagtagttttccacacatcttctgccagaaaaaatgaagatgtcagttgaaatcgcaaaaaaaaagttccatttgtaatgtggttagaaaaacgaaccagcagatatgagagtacataatgaaattgaaaactaattaatcataccgttcaattcaagttactatgtacttaaaaaaacacaaagccaaatcaaatgatactgtaaaatgatagaagataaacagaggagttaccaagatgattggatctacccaactaaatgtgtagaaaatacatggattatacactttctacgtccatccaaacgaacccatcttctacattcttgtgttttcaaattcgctgtttccacgtgatttcctattctatttctatttctttctgtcctgcattcctaaggagtgttgaatttaggaatatttttaactaggtacattaaaatctttccacccagcacatacaaaatatgttcatacatttttctttctcatattcttccttcttaaaactattgtgtattgctaactttgaaaaatagttacatttttcaaaattttcaaatttgggatgatataatatatttatagtgcatcataaaattatagagaagtagaggaacgaggtgaaacggaggagtacaatggaagtgcaaagtcacccatatatatttaccggtgcattagctaatacttttattcccggtttaaaacaaattatttagctgattatctacttgattgtagggatatttttttatatgaatgctttgaataagtggtctatgcaatacagtagaagaacaaaaaatattttagaagatgcattttcatagacatggaacaagtaatccaccacaataatccgagatgaagtaattgtaaagtattgatctttagtactagttggtgccaccaactggtacaaaagatctcccgctctgaccactgggcctgacaagagtctgacaggccacaaccgggactgtggggtacgcagtactcgggtactcatggcaaggccttgggccatggagcattgggtggaccgagtgtcttagggctatatggtttacttgtaatttaagaaagggattgaaaataaggtgatcaatcttatcccatgtaaatagattgtaggtacacaaattataaggaataccgtaccatatccgcccggccgaccttgtaactatataaggggcaccggggcaaactctaaggggtgatcacgctctgcatatgtgcctacgagcaattccaacgctgtgctgcgcaaacctacagatccaatctacactaactagactagagtattacctcatgctgagggcctgaaccaatataaatatcagtgtccccatctctccttaatatttcgcaccctataaattatattgctgatcataagaatcgacagagactaaagatcatatggctgggtgggctaaacaaccggtagtaaaaaataatctttactaccggttcattttacagccgatttttgccgatagagcaaagattggttctcaagtactgtaggaaataaataaataataaatttaatattattatagtatttttaaaactaatcttgttatatactccctctgtttcacgatatacgaattttggtctctccatctcttgtctctctttgttagggttatagataccacatacctaatagtagttgactaaatctcggcaggacccaccacataccatgtcttatatggaaacaatcttcggatatacgatgagttccgcataaggaaggatgaatagagttctacatgaaaacgataaggactacttggattgtatccatattgatttccttaattctacttggataaggagacacctatgggtataaatacaaggccccctaggaggagaggggatacgaaacaatagatcaaggcacaagatcaacatacaagtcaacatgcgccaagacaagatgccggagatcgacttcagagataagcatggctagtcccctacggtgtctacggatactgtcaggagagacatagcgctgtctctgatctcgccgggcacagattcgaggaggaagactaccctgttgtcgactacgtgatgatacttcaggtcgccaagtcgacaacagttagataggctaccccagatattgtactggtgtgattatggtgaataagagcaacgaccagtttcggccaacaggatgtagggttattacctgacaattcaggggcccgaacctgtataaaaatcctcatctctgtctcttttacctcaatctcgcatatatcctagtaccaacgatccccatactatgcaaataccagaatcgcgacatcaaacgtcaacactcttgtctagaatcatcaacacacatataaatttggatatagatatgaagcacatacatgaatacatacataaatctatttaaaatatgaaacatcttataattaatgtgaaatagtgggagtaagttgttttactccattcaaactaactatttctgaagtttaaagcttaaccttgtatgaaatattaagaattatagaatcggaggaaatatggcttcaaggcaatatagtacataattagtgcacttaggctgtggtctggaaccttgccttctgacagggaaaataaagcaagcgaatagagcgagattaactaagtattagcctaaaaacttgaaaaataaactaatatgatttttttaaaacaacattcttatagagaaattttgtaaaaaaatacacggtttagcaatttgaaaaccgagcgcgcgaaaaagtgagaggtaagttgggaaagaagggggagcacacaaccttaaatggttctgtt

SEQ ID NO: 46986 - DNA, 1425 bp, Oryza sativa
acttagacacctgagcgccaaatagcatggcgctgaatatacattggcacgctgacttagtctaccatccgccatggcacggcattcagtggcaactgacgtggcgctgaggtgtctaagttcagcgccatatgatttggcgttgagcaaaaaggtcatttttaaaataagttttggcagcggttcatttataaaaatagtttttgcaaagggtaaaattgtcaaaattaatgcatggtgcaagctagctacttcaagctccacacacctatatgtaatttagttctagtatagccgtatagctagctaaactaaggttctacacggctgactttgatcctacaactcggctaaactgctactttctccgtttcataatgtaagtcattttagtatttcctacatatatattgatgttaatgaatctatatagatatatatgtctagattctttaacatcaatataaatgtgggaaatgctaaaatgacttacattgtgaaacggagggagggagtattctttaatcatgattacgtgtctagattctttaacatcaatataaatgtgggaaatgttagaatgacttacattgtgaaacggaggagtattctttaatcatgattacgtttcctaaaccggtaaataatatattttctaaatacattttccataaaagtttttattaaaaaacaaataaactcattttacttgataaacaacgtgttaatagcccatatcgtgttacgcaccgcgttaaatataatcttaggcaagatgccgtttccaatgcagcccctgtctattaaaacacagggttacccatgttatgggcaccatctcagccaatctcccactcaatatattccccctcccatcctgtgctgtcttgactcttctccttcgtagttctaccaaatggcttccggcgccgccgtcaccgccgccgccgccatgtgcaccgtgctggtgatcctctcaaccggcggccagccaccggcggcggcggcgcagaccgattactgcgccaccgcttgctcctcgagttctaatggaacggtgacgtgctacaacaacgctatcaacacatgcagctcaaactgcagcatcacacctcagtattgcgaccagtgccgcagagagtccaaccagcagtgccagaactactgctacaatggctgcttgtacggctgcagcttgcagcacccgtaaattcaacgcatcccttatttctttttattcactgtaagaaataagaaagggcaccccccgtctgctcttgtgcatctgtctattttgtgtactcgccgtatgataaaaaatatataatgttagaccttttccattttgatacaggtgtgactttgactataacttagccacaataatttaaacaatatataataagtgcaggagatttaaaaaaa

SEQ ID NO: 46987 - DNA, 3010 bp, Oryza sativa
  unsure (1)..(3010): unsure at all n locations
gttagaagcgttggccttggttggtctggccaatctaggcaaaccatctgtgcctgacggcgttgttctgggtatgataggtgggcccatatggtagtgcactgtggatttgctcaatttcagtcggttttgactaacatgtgggccctccaatccatatgctcgcgtataatttgtcggaggtacacttcgtcgtatggcgggtgtattttcatccaaaattacttgcatacaaatatttaccaatagttatggaaatggttagtaataatctcctaccactatgtttcatactttattttgtattctttatgtaggaattgatggttaaagttaatgactgtcaacagtggcataagttcgaagtttagtgatcctaagtatcagatgtgtgaggattactgggatgaattcgccagctacagaatatctaaggaggcaagaaaaatgagtgaacaaaacaaggccagctctgcaatgaacaagtatcctcactgacttgagccaagcgaatatgctaagaatatacccaaatggaatgagatggagaaaaagctatattgagcaggtgcaacacctgagacagagcggtggggaacccggacaaaacactatgtgtactctaggaacacagaactatcacctttggggagttgatcgccgcatgatctcatcggcaagagctaaaacagagattgttgagacccattcgtagtcatcaaagggtacttttgtgcctgaaagagatagatgagctcacattggcattgaggaacccccaacaccctggacgcatgaaagatgtaggtctcattccttcgaggtgtaggtacaacaagtataacataggagggagaagatcacagatacttcatgcaattcatctcaaagatcgatcaagatgaaacaaaatttagggagacaaggatttcttttctgatgttcgaataacagggatcctccactccgtcgatgtgctctagagaactagatctcgattaaccccttgcctcatcaagcaaagatccacgaagaagtctttggcctccgagcaggaaccagtgaaacttgctctaccaagacaacctccgagcagccagctcggaatgtcctccaagtctgaaggcgaactctactctcatacacctacccaggtcaaagtacagcttgagcaagctcgagggtgacacttaactgtctaggagatcaccctccaagagtaataaacaccaaacagtagcctaacgacaatccctaagtgcttaggtcctcctagctcgctcaccagcatcaaacctcacgaccacccaagaaacacactcaaatcactatgggagcttaagaattagatggcagaggtcaagaaactctaggagaagctagcagatagagacgcaaaatcggaattgtcaaaggagcacagggggggggggggaggtaggaatatatacccactccatgatgtcatgtagccgttactcacatctttgaactagaaagatgtctggaagttccggacagaaatgtcaggaacttattctgaccaacatttagggacatgcagaaaaacaggggcctagaatttccggcccagaacacctagatgtttcgacccacacattatgagaaaacccaaacttgtgcaagtgttatgcaaatgtgtctcttatctagacaccttgagcacatgaatagacggatgcaaccgtttggtatcccctgatagtatggcttttaatagactgaaaagtaaaaaagaaatttaaataagctccgagtccttgcgccgatttgcatcatgtttgtacaggtctccaagcacacttaggctgcttttgttattttgtgttcccaacaaagctgctgcccacggaaaacagaacaatctattatagcgtgattaattaagtattagctattttttcaaaaatagatcaatatgattttttaagcaactttttgtaaaaaacgcaccgtttagcagtttgaaaagcgtgtacgcggaaaacgaaagggggagttgggaacacagccttacatatttttacatagtttttaaaatgttagttgatgtgtctgtttgtgtgatataggatatattcttccgaatagtcccacaaaatgaactacgacacaggtgatgcatggacggctttacattcttattattacctttacatagtttcatacaacatatacatatatagaggcatccatgcatgcatccatccagttgtccggcatgcatttgcttatttatatgccatctcacaaacccacaacacacacactcataacacacaacgcatttgtttaactatatatatatcggccgtccacaagcacacacacactgcacaaacaaacacagatatatatatattcttgggttaatttcttcatctcatgtgggagcacgagttgaagcagtagttgaagcagaggccggtgcactgctggtagacgctgtactggcactgactgcaagcctgtggccctgcgaggctgcaggccttgccgcacgccgagatgggcgccggcctgcacgacgaggcgcagctctgattgcagattgagtggcaatcccgctgctgcgcctccacgggtgggatactgacgagcacgacggcggcgcaaacggcggcgacaacgactaaaacgacggtgcggatggaggccattttgtgtcagcttatgagctagagaggggaagaagaggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46988 - DNA, 705 bp, Oryza sativa
tgaaatatgaaattttaatagttgaaacatttatactatttttcatcatgattataatatatgttgttgtagagttttaattgaaagacattcaatagtgtaatggaattcaaatcagataagtagtttagagaaaaaaattgtatgtatgcatagatgaagtcggagtatagacaattgcatgggtgcccgatattttgctagcatattaagaagcaaattgcgaagctgcagaatggtttcatataaagataatagtacctccattaagccattaacttggactatagaatacactacataaatacactcaaatttgggaaattttggctcatagcaaacaaaagttgtgttagtacaactagcaaatcccaaatgcatgttgatgaaatcgttgattactataggcagcgggaccacttcctacaggaaagcaaccatggggcatcgatcatcatcctcgaagggccatgctggatgttgcctccatgtaggatgaccaactggtaggcgaatccacatcaagacatgcaagatgtaacttgttagaatttataacttaagaccaaaaaatgaatcacaacataaaaaactgccacatacctatagcaaccaaacacaacctgccaagttagcatctgcactagtccttcggcatgcatctcaattcacacaggtgcttgtacaaccatgctagggcagcag

SEQ ID NO: 46989 - DNA, 3752 bp, Oryza sativa
  unsure (1)..(3752): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggatgacaatttgagaagttggtacacaaccaaccaactaagaggaactccggatgccttcgtcaatctctgcccatcaggtgcctctaaaggcttgacaccaatgtactgaaccactacaccccctccaattaccggaattaatgtcactggtgattgcttggccccgtataggaagagccaagatcatggtgacctcctcgagtgtcagcgtcagctccccgctgggtaggtggaaagtgtgactctctggcctctatcggtccataagagccgtcaatgccgcggcgttgtacagaggcatgtgccattgtgccatagtgataaacgccaacaactttgcccaccgttggaacgaaatgtaccagttgctgaacgggatgtgtgctgtgtgatctctgactcgtagagtcttgaggcgctgcatccgtagacataaaaaatttgttagtgtcagtaaatccatgcaataaatagaaatgcttaaaacatacaaggaatagtgaaatggaggataacctctccacttgctatcctaggagcctggtgcctctcctcaaagtactcctctagaccgggaaacaacaccctcttacaattgaacatgaagtcatcagttaatgatacaattatgatatgcaaattgagaaaaaatgtacaacaaagcaaaaacaacctgtgtactggacccaccacctccccccgtcctacggcattttttcggtcgatccttagatttgtctcgattcggacaccgagttttcttatggcctggttgatggcatatggaacatttgtttgtgtctgtcatgtgcttgtatctttgtagcctttatccatgtcatttttaaacgtttttgtccttcgtcttcctccagtgtcgttcttcaaggacaagtcaggaacaaagaactcacgtcataactcggccactgggatggatctaagtagggctcaaacctcggggagtatgtgtgctgcacaacctcattggaagcttcgaaacatatccgtggggacacctccatgtccaaaccttggagtctctagatggttatcatgtgtgagcatggcatgtggtggagttgaggaaattggcaagtaaatgtgttatctcttgcaaccacgacatagtgacatccaccccattgcacaccggccgtcttgactctgccttgtgtcagttacagctgcactgacctctacaaccgccttacaactgtcattacaattctataaatagaggagagcttctcatttcacaacacacacctcaaggagcaattctcactattccatattgtattatctatagtttagtagaaataaaaattaggagcttcggtcttattcatcccaatccaattcatccatcgtgtgagaaaataactcctcaaatgtgggtttggcacgaaacattaattgcctaacagtcatcccctcaaattggctttcactggtactttcatctaccacatagctactaaaatggagtcgtaccaatctatccatctacatcagttgaccgataaataagagtgcatgattctaaaatagtatgccagtctaaaaatagaaaaatgacattggtaccccaaaactacctacaatatttttgtaattttaatgcctaaccaacggtcacaatgtccttaggatctatacctatcaacatcaacatgaatcaatatgaatccccaaattcatccatagcaaaagagtacaaaacttacaaagccaatatgaatcctccataccaacatcaatatacaatgtggagattatgggtaccccatacccacacggcatggttatctgactagttataggggataacttatatctatggaatatgtaacagatcatgacttgggtattacgtttccttttatattatggagcggcctacagtcctgatttgataatattgtaaaatagatttaggaaaccgatactgtattggttaaggtttctatcttgtaatcctgccccccatactatataaggtgggcaggaggccctctagggggcatgacacacaaactgatcatcagatcaatatacacccggcggattcaaatccccaaacaggagtagggtattacctctcgtcgagagggcctgaacctgtctaaatcctttgtctccgcatccatccacttttaggtctcgtgcgctacccccttttcatattgtcgaaaattcgttacgacagttggcgcgccaggtaggggttgcgtcgagttttccgtcgagaagtgcgatggaatcaacttcataagtcgccggcttcatcttcgcttcgggagttttcacttctttgccgccgacaacttctacaatctgttgctctccgactcggacccaatctagctggcatatcagtctcgacatgctcgatggattcaatttccaccgccaccaagttgattgcttgatcttcgtttactaaaagaccccaagcacgatcgtgcggcatcatcttcattagcaagcctcctcgctttgagagattaacttgctcatgcggctacgacggtgcctcaaccaacgacttcgtcaagctcttcttctagccggaagattaatctcggctcggcgagttcgatgaccaacctccaccgccgcgagttcttttttcgatcgacaagatcatctgcatgttgctatatatacatgcacactcaaaatagccacgtgagttcgtccaagtctgctcgggcccatgtctatatatgcatgcacacaggagcacaacgacaagctacagaggatacatatacagcgtggttaacaaattcttattaaatcatcaccgagacttcctggacatacacaagaaggacaggtggacctccaaattctttgattaggagactaaccaggtcgatgcatataatgctgataatatatgtccaccaagcgtctgggtcacaaaccttcactaggtttatcgttttaatttctttaaataaactagatcaatattaatttttctagtcatttaattcacagatcaccaattatttttgatctgttattttgtgtgcatggtcagtgtactccgccgctgttgctgatggtgacattatcttcaccgccggcagccgtcgtcaccgccgactggtgtctctgcctacacggctggcctattatgtcgccgttgttgggcgtctacgacttcaccgccggcctgcctccgttgccgccgactggtgtctccgcctacacggctggcctgtaatgccgctgttgttgggcgtctacgactccaccgtcggcctgccttcgccgccgccgaccagtgtctccgcctacacggctggcctattacgccgccgttgttgggcatccacgtcttcaccgaccggcttgccttcatcaccgctggatggtgtctccccctacacggctggcctattatgccgccattgttgggcatccacgtcttcaccgaccggcttaccttcgtcgccgccgactggtgtctccgtctgcacggctggcctattatgccgccgctgttgggcatctacgactccaccgccggct

SEQ ID NO: 46990 - DNA, 11225 bp, Oryza sativa
ctaccgttgttgggcgtccgtcgactggtgtcctcacctatacggttggctggtcacaccaccgtacatgggcatccatgtcttcaccgaccggcttgccttcatcaccgccgactggtgtctccgcctacacggctggcctattatgccgccgttgttgggcatgcacgtcttgaccgaccggcttgccatcgtcgccgccaactggtgtctccacctgcacggctggcctattatgccgccgctgttgaacatcaacgacttcaccgccggattggcttcgtcgccgccgactggtgtctccgcctacacggctggcctattatgccgccgttgttgggcgtctacgacttcaccgccggcctgcctccgttgccgcccaacggtgtctccgcctacacggctggcctgtaatgccgttgttgttgggcgtctacgacttcaccaccggcctgccttcgccgccgccgaccggtgtctccgcctacacggctgacctattacgccgccgttgttgggcatccacgtcttcaccgaccggcctgccttcgccgccgccgaccggtgtctccgcctacgcggctggcctattatgccgccgttgttgggcatcctcgtcttcaccgaccggctttccttcgtcgccgccgactggtgtttccgcctgcactgctggcctattatatgctgccgttgttgggcgtccgtcgactggtgtcctcacctatacggttggctggtcacaccaccgtacatgggcatccacgtcttcaccgactggcttgccttcatcaccgccgactagtgtctccgcctacacggctggcctattatgccgccgttgttgggcacgcacgtcttgaccgaccggcttgccatcgtcgccgccgactggtgtctccacctgcacggctggcctattatgccgccgctgttgaacatcaacaacttcaccgccggcttggcttcgtcgccgccgactggtgtctccgcctacacggctggcctattatgccgccgttgttgggcgtatacgacttcaccgccggcctgcctccgttgcagcccaacggtgtctctgcctacacggctggcctgtaatgccgttgttgttgggcgtctacgacttcaccaccggcctgccttcgccgccgccgaccggtgtctccgcctacacggctgacctattacgctgcctttgttgggcatccacgtcttcaccgaccggcctgccttcgccgccgccgaccggtgtctccgcctacacggctggcctattatgccgccgttgttgggcatccacgtcttcaccgaccggctttccttcgtcgccgccgactggtgtttccgcctgcactgctggcctattatatgctgccgttgttgggcgtccgtcgactggtgtcctcacctatacggttggctggtcacaccaccgtacatgggcatccacgtcttcaccgaccggcttgccttcgtcaccgccgactggtgtctccgcctacacggctggcctattacgccgccgttgttgggcaaccacgtcttcgccgaccggcctgccttcgccgccgccgaccggtgtctccgccttcacggctggcctattatgccgccgttgttgggcatccacgtcttcaccgaccggcgtgccttcgtcgccgccgactggtgtctccgcctacacggctggcctattacgacgccgttgttgggcaaccacgtcttcaccgaccggcctgccttcgccgccgccgccgaccggtgtctccggctacaaggctggcctattacgccgctgctgttgggcatctacgacttcaccgccggccttccttcgccgccgccgactggtgtctccgcttacacggctggcctattatgttgccgttgttgggcatccacatcttcaccgatcggcttgcatttgtcgccgccgactagtgtctccgtctacacggctggcctaatatgccgccgctgttcggcatctacgacttcaccgccggcctgccttcgccgccgccaactggtgtctccgcctacacggctggcctattatgccgccgttgcttggcatccacctcttcaccgaccggcttgccttcgtcgccgccgactggtgtctccgcctgcacggctggcctattacgccaccgctgttgggcatctacgacttcactgccggcctgccttcgccgccgttgactggtgtctccacttacacggctggtctattatgtcgccggtgttgggcatccacgtcttcaccgaccggcttgccttcgtcgccgccgtctggtgtctccgccagcacggctggcctattacgccgccgctgttgggcatctacgacttcaccgccggcttgccttcgccgctgtcgactggtgtctctgcctacacggctggcctattatggcgccgttgttgggcatccacgtcttcatcgaccggcttgccttcgtcgccgccgactggtgtttccgccagcacggctggcctattatatgctgccgttgttgggcctccgtcgactggtgtcctcacctatatggttggctggtcacaccaccgtacatgggcgtctacgtcttcaccgaccggctggccttcgccgccgccgactggtgtttccgcctgcacagctggcctattatgccgccgctgtttggcgtctacgacttcatcgccggcctgcctctgccgccactgactggtgtgttcgcctatacgtttggcggacttcgccgccgttaatgggcttcatcatctacaccactggctttgttccactggcgccgactggtgtttttgtcaccattgatggactgcttcgttcccacatcggctacttttgctgtcaccgagggaatacgacaaagctaagtcatcatttattttattctttatatgatatttttccttttcctttgcctcactacatcaactggttcgccgttgactagtgagtcgggggctatagatgttatatcatattttttaaacaattttcataatatttatcttgattgcttacaacatattctgagtacaaaagtgcctatcgagttatggagttccatcttcctatgctttccgtttggtttgccaatggatagttgtctttgggccgattcctagcacccgggggcttgttggatggacggaataacgcaaagtgctaagtattattcggaataaatcaaaagcatagagataagataatttattttctgctcttaataattgcaaaagtacccgagtagtaaactccgacccgtgaaactttgttccattaatgacgaactcatgtcactcatacgcatgtttgggaagtgcctaggccaactcccggtgcttgggggctatgactagtcgggcagagtttttaaacataaggagtcatctgctcggggaaatcaaaattgacaagaggagaaatacatatttataaacattttaaatacttgaatttttctcgagtattatatttacatcagatactactcatcctatatgtttgttctgtaggatccagatctagatatgcataaaagggattcatggctttaagcttatctcctacgctttagggatggatcagtcagaacatcaccaccggcttgctttcgccgccgccgactggtgtctccgcttgcacggtgtcacgaccggaaataactcaacgggcgttccttacgtgcgtgcattattccttgtcctaggaggcaaggtacaccaaaagttgatacaattcagagtttaacaagcggaagcgtaattaattaatttattacatgggcggcgaagacccaatacacaagaagacaaacgaaaaacagcggaagactagggtgtcgaccacatccgcttgacggcaggcacgagccagacaccaaagccttcatcatccaggggctcctcttctgggtttggcaaaaattgagaaagactgagtacaaccaccgtactcaacaagacacacccacaagtgcagaataaatgcaagggagtacaagggggttataatatagggggttagggtttgcagtaaacagcattaaaagacacttagttgctcaaagctattttgtaaacacgattgtagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttacgcaggttttaagaattaaaacactaacttgggtacattgctcggcttgcccataaccgagggcgcgactattcgaataaattatactctgatcagaggtgtacatctttacccacaagacacatcttcctcacgtgtaaccacgtgccacataccaccacggtatacggacgaaagacgtgacatagtttccaacccatcctagccataaacaagagtaccgacccaaccccacctacggccggaacccccgggacaggtaggcaggactgagcccctagcagcaggacaccggccctgtgccatgacatctcgactaccggccgcagctcgtgtagccttcatttgccctagagatgtccatcgacccccgacttcgtccatctctatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggaggtgtgaatccaattccacaataatccaaccattccatagtgtccaggtgagaagagtattcccaaagtctagagttgtaaaaccaccgaatgttgcctaattaaccagcgaagcatctaccaaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggtttttgacttcttaaggaaaaattaaagacttgaacggtccaattccgagttcaaatggccaagttatggccatttgaagtttatatgctctttaaatggatatttgcgaatttcttcatttaaattttaatttaaaaagggtttattgcgtcagccgaggggagggggcgcgcggaccgggtccacgggagtggggcccacgcggcagcctcatggtccacggtggaccgggcgcacccgggttcgcaccggccggcgccgtgggccccacgcgtcagccgcacccgagggcgcgggcggctgacggccgggccccacgcggcggccactcggtgcacccgaaggcggccactcggcgcggccggcgggaggcgccgcccgcgcccctattgtcgccggcgtcggccataggcacggcggagcggtggccgagagaggggaagggaagggggaaaagaggcggcggtccacggctcaccctaggtcgacggcgacgacgaaaaaggcggccggagcggaggaaggcggcggcgcggctcgggtcgacggggtcgacggcgttccggcggtcggcggactcggcgagggggtggacggggtcgacggcggtgcggcgaagccggaggaggcgacgtcggggcgggagacggtcccggcgagcggagaagcccggccggaggtcgtcggcgacggaggagagagagggcgacggcgcgagctcgattccggcggggagacggtgcggcaaggggcggaaacgggcgagggaggtgcggggagggtttaaatagggttggaagggggagagagcggccggaggggatggaaactgccagggtggatggaataaggactttcgtgagcttcctgaagtatcagctgtttaagttccttgtcgtccggaacgcatacacgatttccgttccatagggttccatgttcatcttctgtgaaaccagcggctttaccttgtttcatattcttgaggatcccatgcatatctggatcattcttctgaacctcgcggatttgatcgagcaaggtaggcttggcttccagcgtagccaagaatccatgaccaactatgcttaggttcagggcttccatctgttgatgaagttccggtggaatgccacggacgccaagagtgttgcaacggctttttcgactcagcgcgtctgcgaccacgttggccttaccagggtgatagtggattcccacatcataatccttgatgagctctaaccatcttctctgccgaagattcagatccgactgggtgaagatgtatttcaaactcttatgatcagtatatatttcatagcgattcccaatgagatagtgccgccagatctttagagcatgaaccacagcggctaactccaaatcatgggtagggtagttgccttcatgaggccgtagctggcgtgaggcataggctaccacatgaccttcctgcatgagcacgcaccccaatccttggcgcgaagcgtcacagtacaccatgaagtccttgcgagtatccggtaagattaaaactggcgaggaaaccagcttttccttgagagtttggaacgccttctcgcattgcgggctccacacaaatttttcttctttcttcaacaactgtgtcatgggtcgagcgattttggagaagttctcgatgaacctccggtagtatcctgccaaacccaaaaagctgcgaacctgagtaactgtcttgggttgcttcccatcagtgacggcggtcactgtttcggggtccatagcaactcctttagcagatatcacgtgccctaagaatttgacttcggacaaccagaactcacacttgctaagcttggcatacaattgatgttcccgcaactttcccaacaccagacggagatgctgttgatggtcttcctctgattgtgagtataccaggatgtcgtcgatgaagaccacaacaaacttatccaagtattccatgaacactttgttcattaagttcatgaagaaggcaggagcattagtcagaccgaacgacatcaccgtgaattcatacagcccatatcgcgtggtgaatgcggtcttcgggatatcttcttcacgaatacacaattggtgatatctggaacgaagatcgattttagaaaacacagtggcacctttaagctgatcgaacagatcatcgatctggggaagagggtacttgtttttgatagtaacttcattaagagctctgtagtcaacacacatcctctttgtcttgtccttcttttccacaaaaatcacgggagcaccctagggggaagtgctcggtcgtatgtaccccttttctttcaactcttccaactgtttcttgacttcggccagttcatttgctgccatacggttgggtcgcttgtacagaggagtggttcctggagcaagatctatccagaattcaatctctcgcttgggcggcataccgggtagttcttccggaaacacatctccgaactcactgacgatggggatttctgacagtcctatctgatgaagttctgaactgccgacagaggttgggggtgcaaagaaaacaaccagttgatctggccctcggtacagagtgacagtgcgtcttgcgcaatccactactccttggaattgagccaaccaattcatcccaatgatcacatccaaattcttggtgtctagaagaatcaaatccgagggaaaaggaattccctggatttctataggaatggtagggctataatactttgctgtcataacccctctaggggtggtgatgagcagagggttcctaagcctttctacccccaactgatttctccccacgaatggcacagacataaacgagtgggaagctccagagtcgaacaaaatggtagcagggatggaatgaatgaggaacgtaccaacaatgacgtctggagttgtcagcacatcctcggcagtcacgtggttcacacgatcccgaatgacatccttaccaccgttgttggggcggggaggcgcttggccttacgagcgcctcggctttgggcatttatccgcaaagtgcccgggctcgaagcagttgaagcacagacgctgctgaccttgaatgtctctgcggccttgaccaggctgcacaacgggcgcaggaggacggggcgcatgggtcccttgctgactctgctgttgctgcggctgtgggacgcgcaccacgaattgaggtcggggcgcggagcgtgggtgctgctgctgctgctgctgcgaggaggatccccctggatagggattggtgtagcggaccctttggttagcaacctgttgattgtggaaattcgccaagcgatgcttgtgcgactccagttccttgtgcttggcttccaagcagatgctcttgtccaccagatgttggaaatccggatagtccccggagtccagacgcacggacaggtcagggtccattcctgccaagaacttctcttgcttctcctcatcttcacgaacatcctctggggcgtaccgggccaggttgttaaactcatgcaaatactccatcacagagcggttgccttgcttcaactctcggaattcccttttcttaagggccatgactccggcgggcacatgggtcctccggaaagccgcggtgaagcgggcccaagtaataggctgtccttctggctgcgtagcctggaagtggtccaccctagagatgcgggccctgcagttggtgagcggcaaagatgactttctcctcatcattgcactgcacggtatccaactttttccccacggcatgcaaccaatccaacgcatcaacggggttattggaactagagaaggtaggcggacagatgcggaggaactcggcgagtttagagtgttgtgggggtggtggtggaggtggagcattatgctgtggcggattttggatgtgatggaggaaagcagccatcatgttggcctgctgggcgaggatttgggtgaggatggagttggtgtctggtggtggtggtggaggtgggggaggaggtggaggtgggctgccttggatgttggggttgctaccttcgggttggttgtcatcaccggtagcagcacttctcctggttgtcaccatctgaaatatcccatacagaaccagccaagagagagaacagactattaaagctaatcacccacgactaccaaaattattgaacttattactgatataaaatgggttcattaaggttcaagttgcttaagccaataaaataaagacaggctccgacacagttataccgcacaccggtataaccatgccccacacgactctagcagaaaaacaaacgagaagaacacacgcgcaagcctactaactgctcgtctacttctgcgacgggccagggcggaaggtgagcagtagcgcatcctccatgctgccaacgccagaggctccctcctcctgaggaaccacgggcgcgggctcggcacgaggggtctcgacaaaacaggtccatgccaaggactgacgaacaagctcaggcctggaggtactcttgcgggcggtgatcttcaggctgcggtagacgcggcggcgcttggggcgacagacctctccctgggcgatcttgagctgacacagctgcgcctccactacgtctaggtccttcttcagctgcagattctcctgacgcagctccaggatcttcatgttgttctcgaccaacccgcggcgcaccatctggtggaagtcgatacgggccgcgtcatacgtgtccaccatgcgcgccaggtgcatgatggtagcgtcatcctccgagctagcatccctgaaggtggcgtagtcgtgggctcctccgcgacgagggtggtagcggtagggcgagtgctgcaactcgtccgggtagcgctggtgaagagtgccgatggcgaggggtgcggcgttctggcaagcggcggagaaagaatctccacccgcggtgactgccaacgaggtcctctcgggtgagccagtgaggatcactacagtgacctcccaagcagcgtggggctctgcatcgtcaccctcttgctccgggagttgcttgccctggtagtccactccatgcggataccccaagacaacgcacatgccccgcagtcaggtccagaccacgacggttgatgctgccggccatctacaaacaaaaacaaaagagaaaagcaacattttaaaggttagattttgacgataaatgaagcagcaggacagagagagactagaggattttcacaaataagaaacgatttttattttgaaaatattgctaaggcttgggatctaaggctcgtcctagggtcaaggggctctgataccaacttgtcacgaccggaaataacccaacgggcgttccttacgtgcgtgcattattccttgtcctaggaggcaaggtacaccaaaagttgatacaattcagagtttaacaagtggaagcgtaattaattaatttattacataggcggcgaagacccagcacacaagaagacaaacgaaaaacagcggaagactagggcgacgaccacaggcacttgacggcaggcacgagctagacaccaaagccttcatcatctaggggcttctcttctgggtttggaaaaattgagcaagactgagtacaaccaccgtactcaacaagacacacccacaagtgcagaataaatgcaagggagtacaagggggttataatatagggggttagggtttgcagtaaacagcattaaaagacacttagttgctcaaaactattttgtaaatacgattctagagctatacaatattattaattaaggccgtgaacccacacgaacctgccttaacccaaggcctacgatgatttagaccgaactggcaacccgactctgggtcccagctca

SEQ ID NO: 46991 - DNA, 2853 bp, Oryza sativa
acggcggtgcggcgaagccggaggaggcgacgtcggggcgggagacggtcccggcgagcggagaagcccggccgaaggtcgtcggcgacggaggagagagagggcgacggcgcgagctcgattccggcgggaagacggtgcggcaaggggcggaaacgggcgagggaggcgcggggagggtttaaatagggttggaagggggagagagcggccggaggggaaggaaaccggcacgggaggtccggccgccatcaatggcgccggcgagatttgcgggggcaaatccgcccgtttgaacgcgagagagagagggaaaaatggggggaaagggagaggggatcacggggagtgattccccccactttattgcacgcgtggacggcgggaggcggcgggattcgcggcggcggcggcgctagggcgcgggggaggcggcgggagcggcggaaggaaggggatgacgggtgggccccacccgtcagcgaggttggcgggcgggcccgtccgtcagcggcgcgcgcgcggggagagaggccgaatgggccgcggggagaggagagagagagggggggaaggagagatgggccgggccagcccaagggagggaagggggacttttagggtttttctttttataaaatcattttaactttgtttatttcttaataattattatttgtgctctgaaaattccactaaaatttatttacgcattttaggcttttaggaaatttacaaaaatcctctaagccttatttggcttttaactttgcacattttaattgttggaggctttcacatggattttaattattctaggcatcatttaagggatatattttagagtcgttttgggacgtgacacacggctggcctattatgccaccgttgttaggcgtctacgtcttcaccgtcggctgccttcgccgccgccgactggtatctccgcctgcacggctggcctattatgccgccgttgttttgggcgtctacgtcttcaccgtcggctgccttcgccgccgccaactggtatctccacctgcacggctggcctattatgccgccgttgtttggcgtctacgtcttcaccgccggctcaccttggccgccgtcaactggtgtctccgcctgcacggctggtttattatgtcaccgttgtaggacgtctacatcttcatcgaccggccgcctcgtatgacgccaactggtgctatcgtcttcccggctggccacgtcaccgccaccgcaaataggcgtcatcaccatcaacgcaagctgtctacgtctgctaccgattggtttcttcacttccatggctgcatgattctgccagtgttgattggccttatcgtctttaccaccggtcatctcgtctgctgttgactagcatcctcgcctctacgtctggtttatacagctaccactactaatggacatcatcgtcttccgtcgccgacaggttatgccgccgccaactggttcttttatcttcacaactgcgcgtcttcactaccggtttgcttctgttgctgccgactcgtgttcacttcatcacggctatgcaattttgtcaccatggtggagcaacttcatttttattatcttcggcatcggcaaactctattgcctctacttcaccaaccatgacgactacaagagtttcgacaccttggcatacgtcaccaaatatgatgccgtgttattttattacaacaagtggtgttccaatcttcaatatttatcttcactcaagcaatgactactcgacaacaagaagttacagttctcaactctatgttcagttgtttcccaactaaccaaagagtcgggggctacacaaatacatggctcaaaattcgataggttttatgtcaagatgaagcaatcaacaaatcagccaatgagttctatggaacctacttcgggagtcatcagtttcatcttcgcttcagagcagacgttctacttcagcaactcttattatttcaccggcaatttttggtttctccacgccgctacaatctactccaaatttctcaattatcaagtttaagatttaatctacatgtttgggagtttagaattatcaaccaatcagctcagtttcgacgagttcgacaacaacatctacattcttacaagtggagcatctgcaacagctataacaccaagttctactaacatctttataaatcaaggagctttgcatcaatcttcgttatacacacgctaacgtcaaggaaattattcgagcttcgatatcttctcaatagtttgatggattattgtcattgacttcatcaccagcacctctacctcatcggccctgacatctctgccgttgctaatggatgattacgtcttctcctccggttgcttccgtcattgctgacttgttatttcgccctcacggttgacctactttgcaaacgctgatgagcgtcttcgtcattatcatcagttgctacactgctattgactggatcaccgacatcgtcatcttcatcaatatcctgtcaagcctcttcaacatagccctattctactgctgtttgatggctgcctcgtctgtcaccgactgattatttcgctgccatggctacacaactttatcgctgggcgccttcatcttcattgctggctgacctgactgctgccgaccggtttcttcgcctccacagttgtgcaacttcatcacttttgattggtatcactatcttcactaccatcaatatttttgccacttctggtgggcaatattatatctatattggtcatcctgtctctatgccaactacgtcagctactatcaatggaccattgtaactacgacagaaggacaagctatatgat

SEQ ID NO: 46992 - DNA, 4396 bp, Oryza sativa
agtagagcatttttttgtctaggcttgtagggtcagtatctaacaccgtgctctctcattgattattcatttggagaagggggaatccttctcattgataaatcaacctttctgtataatgtttcaacacttggtgcatttgtgttcaatcaatgtgcacgtatgtatatactgtaatccaatgacatgtgatatcagatgtgactaggttaggtagtggtagggcactaggtgcgtggaaatgggatatgtgaaacaatgttgcatgatgttttgttgaaatgttgtattagtttatgttgttgtaacctcaacagtccttttatttcttcaatgagtagaatttttttgtgaaatttggccacacttccagtggagatttcccttgcaaggtgcagatagcagtttgagtaactatttgtagctgaaataataccatcaatgattcatgtggtggaaccttgaggtcatttgagactgatatagaggctgttcagattgtagccaaaataaaccttaccaaattttggtaaattgacaatattgtcaagttggcaggattccttatgcatttactaaagtttgataaaaaaaactttatttagcaattttaccaaaaaatggtatggtttaaaatgttattaatctgaacaaccccatagtttacaattcagatgattcagttcttcaattgcagttgcttcagcgtagaaatactttaaatgtgttgctcctgtcaacaacctgagctgataatcagaatccttttattcttcactgggctatgtgtgtgacgcttcaggaaatattcctcggcatagacacagatctgataagcaaaataggttaagaggttatacatttcataaggctatgcattgcattctgttgctagtttaaaaggcaggcagtgaatacatgttcagatacatacttgaccagtagattttgtgctgataaactgtgcaactctaggccagtcctgaccaaatctgcagagccccagaaacatgattgaataaacgtttttttcaccaatactaaagtacttccatagaatgcgatgcaatctgaatatacaaatttgcagtgatctgctagtcagaaagctgaaatctggagattaataggacaatccaggtgatctacattgggtgtgtctagttcagctatctgctagtcacaaacctcaagttttctgaatattagcaaagatttgtgcgaacatttgtttttcataccttccaattgcgatcctgaaattgacacgctctctgatgctccagccttcttgaggaggccgtgcagcggcggtgtacaatggtggcatcctgcgtttttgctggctattcttcttgctccgcaatggcggtaaacggcgtttccccattgtttccctttatcctctcattcagaccaatctcgcattttgagtgcctaaaacatcaaagcaaatatataatgccttgtgctgaaaaacaagggatgtatgaggagtatcgtacaaatggtaagatgaagaagaaaaaagaagttcagtaaaagttggctgatcttttgcatgctggttatgtactaagtaaaaacacactagtgcttgtggaatatttttttccagtttaattcgtattgccttgttagtacatatgtctgataaataaggtactgttttcatcctcctagtatgtactgtcagttcagtcatgtttaggggatggtatggaaggggaaaacagtgtgataattgcaaacgcctctctcttcttcgagtctttttttttttgtcatacttggctccattctcttcttaatataatgatggatagctctccagcgtgttcggaaaaaaaaaaacaactacgaacacctcatttcaggaatttgggtccccctccctcaaataggatactatttcgcccaaaattttcaaaaaactattttaaatttggtaaaatgtttttcacgtttttaattattccggacattctaaaccacgtttaaaattttttgacagttttttttgtgatttccttaatatagaatagaaccctgctcatatagtttatgaccagtcaatttcgtgcctgttttttttttttttgttaatttcatgctaggtagcataaagactctgacatactttttttttatcaccataggtctgtattagctcatcaaatcaaaggctaatccaccccttgtcacaagaacattctgtagcaaaacaaccggagcacctagattcgttttacaagttgcagttctttaccggcatcgcttactttgttaatgtaaattaatgatctcactgttcatactattaccttattactctgattaatactcgcaataataataaaacaacactatacaaatacgaacacatctaaaaagcttttggagaaccgcacaataatcttccggctagctccacaaaatgatgggctagacaaattatatcactccctactattcgcattttcttaataaagcttcttgcgcgataagttgatggcatgaaccaccctgtgcaaagacgcaaatacccctggacctattggctacacacaccgcatccgtgtccaaatgtccatgggcataacagtcattttcccctcctcctccacgaacatcgtcttcttcccctctcgcaagctaaagctgtgccgttctcttccagaagcttccgccgccgccgccaaccgagccgctccgatcctccccccctcgactcggccgcgggcgtacgtagagggggaccgaccagatggtggcggcgtcgcgcctcctcgcgcgggcgtcgaggcaatgcgtcgccgcggtggcggcgtcggccgcgaggcggcggcggtgcccggcggcggcgctgtcgctgcccgtggtgaccgcggcgaaggcggcggctgcggagccgtggctcggggtgagaatccttctatgcttcctctcgtggtgcttgttgtgaagttttaatgtgctcttcttcgccacctctgcgcacgccgagatgtcacaagggggattgggagggttttaggatgtgccgtttcaggtggcttgcgctgtggaaaatttgtctatagatgtttttgtggagggttttagagttctattcgtattattttataatggtgatggagaaatttgaagagaatccgcccttaagtcgcaggggtggcagattattatgttcagtaaactagtaattgtcagaaattatagtttaatggagatcaagtatttgtttgtatgaatagtttgcttctgtaacatgatcgataatacatcgtaggaatgactacgccatactcaattttatttcataagtgtatctttgttgcaatgctgcaccagctctgatacaagcaggagtgggaagttggacgatacctcattttttttagtaattacgattattattcaagaagaagacttgagtgtattttatatactatgaatggttggtacaccattgtatcatagccattcagttaacatacacttccactatgcaacactgagtccactaaatattttggggattcaacctgaacttactactcatgcttgcatatatgtaaacacaaataccggcgcatctttgaggactcctcatcactaacttcagcagtcattgccatgataaaagaataaatagttagttggaagcaggtggatagccatcagcaactggatcaacttgttctggatgtatcactttcttgaatcacacctgcacctttgtatttttatgctcttgtagcaaagaattagcagagctcatgctttttatttttaaaaataaagttactttctcatcgtttattttgtgaggttccctgcccccaacccacacacaatataacttgaacggtgtcagttataactggaagacattgtcatatcctttatattcttaatttggttacgtacttttttgacaagcaggtcccatatatgttgaatcagcccttgagatactcaaccaccatttttcaacgttttggattttcatccacttccccggaactaagtgataaggaggaaaaccaacgcaaggaccaggagaattccacaaatgtgtcaaatgaaggtagttcatgttcaattgagaaaacatgacaagataggttcacagaactccatgtcccatggcataagcctataagaagtgaggttctaaatgaactgcatttcctgattcaggcactgaagacgttgatttgtcaaaggaggatctggtgcagctagttcttgagaaggatggattgttgaagtcaaaagatgaagaaatcaatgatatgaaggacaaggttttgcgaagttatgcagaaatggaaaatgtcatagctaggacaaagcgtgaatctgagaactcaaaaaagtatgctgtgca

SEQ ID NO: 46993 - DNA, 23822 bp, Oryza sativa
  unsure (1)..(23822): unsure at all n locations
tttgcaagtgatgctgcagcaaagtgtttttttttaacttgtatatgcaagtgcgtatttgtatttcgacgtcatgtcagctacagcagagcatgcttgcttaaacggaacatttattacaacctactccctccctctaataaaaaaacttcttactacgaacttatgtctatgtccagattcataatcagaagttgattttttttttatgagacggagggagtattgtgataattataagttttcacatgagattcatgttctccaaacatgctctggccaagcaaaccatctttcagaacataactagatgcacaactctattatacaaaaaaatggaaaaaatgcagctcataaaaaggaaacatggaaaagccaaatgcaatcaccaaaggcaaaccattactaatactagcaggctagcaagataacacttgtgcaaaggctgctatttgcaccaggttacaaaccctatttccaatctgacaagttcatgcattaacacttggtgtaataacatgttgctacatcatcagctcatggaagggggcatattggcataagatgctaataagactacaactggctaatgcattgttctggactacaatacacaattgctaatgcctaacacaagctaagagctaggagatagatgctaataagattacatgagtggcctcgcatgaccacgtacgttctcatcatcaaaggactgggcggttaaaaggcttttctcttcagtctgttgtctgagcgttggttacttccactgtcacgttgctcttctgcgctcagatcagcatcgctgtcgtcatctggatcttccaacccaaggttcaaattcagctcggtgctgccgctcttcttggtagaattttgtgccacgcctgaagcctgaaagaggatacataaatatatgagttgcatggcttttcagaaagaaaatttacatggaaaatttgaaaaattctttgacatagcaggggtaaactgatagtccctgaaaacaaaggaattaaaagaacatgagaaactgaatatactgttgagtgggaggggaataatgttcagaagcatatattgatttaattggtcacaacagatcctgtattagttatttcaacactaaggagaagaggcgaccactgaccacataacatatgtaagtgtaactattatatacaaatagttggatagttacagctcaggaatcaggatgggattacatgaaattgttccgcgataagaaattattaaaatttagagactattcaattatatgaacagaagagggagcacttctgttgtacggtttgctgagatggcatccagtcaggaatggtctgtggctctgtgctgcctacatggacaaatttagccacagtgattcaattataaaatcccataactaataggcccagcatgtcagcttccaacattttcctcttgctcccatttcctttcctctatcctccctttgtttctatgctttagcagaggaattggatagagtggggaataaacagacagtttttctctttgcctgaatctatattttccactcttaaaccattttcgtgggcttcaaggatgcttattttattagatctaatttggctagtttcagcttttgcttcctacagtagtaccgatgctgctcctctgtttaggcaatccgttcagctcatacatgttgccatcgaagatatgataggatgatgtaccaggaaaccaaatcttccataaaatactggtaggtccatggtcacgagctcaaggccgcagcaactcctgctgggattgcttctcactctgttcctggatgggaaggcagaggggaaaattttgacctggtaggagatctgtacgcagcaatggatgatgagattttctggagggagacgggaggaagagggagatatcctaatgataactgagggtgtgttgaggtttaggaactagactgaaacaatagctgaaggggataaatagatttatctactccttagtagcaggcactttttttccatgtacacaaatatctgatattccaaatttgagtgctctagtagctctgatctagatgtaacatgaacagaaacatcattggcaaccaactaaggaaagacaaataaaactaagccctattgaataaatgagtgctttcataattatatcatattacagatcagagtagaacgcatgaactaggcatccagccagtagccccgcgactaagataatgggatggtattcatgctaatatcagcccaatgaagcaatgattatattcagagatgtcatgaaccttttacattcctaactacatggccaagattagacccctgaggattcagaccatgaaattgcatagccaactatcactaaattaaactagcactagccccaaggaaaggaagaggaagaaacccctagaagattataagaaaagaattacaccactataaaccctagtaaaacccaagttgatgaccaaaccctagctgcctagcacattaaccaacagattttcataagaccagcttctcgaatctaattgcgcagattaagtgtaaaatgttcatccaatcacaaactggaattatccctccccaccctagtttttttttaaccaaaatcgaaatcctaagaaatggagaaaacctaaatgccaagcaaatcggacccaaacacaaacaatgcagcgagccaatctacggagccaagaagaagcctcaccggaacgaagcgccgcctggtggccgccaccgctgccgactcgtcgccgtcgccgctgccaccgccacccccggccgcgccgccgttcaccggcgcccacctgaacagcaccaccttgttccccctggagacacccatggggcccatcatcccggcgtaccccgccccgccggcggcgatggggacccaggccttgcgccacttcctgacgggcccgctgaaggaggaggcggtgttcccgacggggccgtaccgcgtcgacgagcggctcaggcgggcgcccacggtgtccatcggcctgccggacgggaagctcgccgcagcgacggcggcggcgacgtcggcgatggcggcggcgaggcgggtgaagtggaggcggcggtgcgggaaatgactcggagggaggagatgagaagaggattttttttttcgccgagagaatgacaagtggggcccacaagaacaaaaaggagagatccgcactacacgagatggaacgcgagcacaaatgaggaattataatatctttaatttaattaaataaaataaaaatgcagacaggagtataacccattgacaaatttgaattatatatcttaatttatatttattttaaaaatttcacagttttgcaccagaaaacaaaactatatacaatctctttttttcgcttaatcatgtatcatgcatacaagccgtggagcaaaacagtttaaactacaactctactttatttgaggatctagagatttaagaattgttaaattctagaagctaagaacatagatgctagaaactctcgcaaaaagatcttactagattatttcaagtaaccttaactgggtattttttttctaagaaagcacgatcatgcgaaaacctagcctgttcaaggccaacaatgatgatactttagggtgccacgacactctttggtgatgttgttgtgaaaacatttctctttgatggaatctttaggtgaaaatcacatcctggctttccaggatgagcagtggcaaagccagaatgaaaattactaagggccattatgctcatctgactcataaagcaacattctcagatgtccaatttaacttggttgggatgttccacatggtatatatactgtcacgtccggaaattcactagtaatttccaaacttatttgtgcataaaaccctcgtccaggaatcagccgaggtacacaaactgacaatttaatatacaaatctatcataataataacgttacatacttacaaaagaaaagaaaacagcagcggaattaacggtctagcgatggcttcagctccactcccacaggcagctcaactggggtataagccaaacgtcttctccttctggatcctttttcttcaactgagatttgattgattattgcaagaatgagcatatgacatactcaacaagccacacagcaaatatgcaagtgcacaagtataccaaaggatggcataatatagggttcattcgcgaaagcagcatttagcaaagagttgagaatttgtaaaatagtaaagtaattaatcatcaatattaatcaacactgaacagcacacccaggctgcataggcccaaccaaacctgaacaaccaaccccggtcatacagatcaaacctccaaaccaggaattatccattccaaaccaggagtcaaattaattatcacattattaccattaatgagtagtgtgagactaatcacgaaaaacattgttatacccgcccataaccgcgggcacggctattcgaatagttttactctggccagagatgtaccactgtacccacaagacacagcctcaacatcatgtctaccatgcgtcgcgataccggaaagtacccgaatagaggctgtgacaataccccctgcacaacacaactcaccacagtgcaccattcctggatcataatctataaatataactagaggcatagactccccaacgacccccacggacttctcgccgcttctcagtctggtgccccgtaatgaatcatgctatacaaaaggtaaagccgttgcctacgctggcttgtggttggcacagttaatgtttcacaacagtagctcgcgaaccggtccttaattgccatgagcacgaccttcaaaaccatgtgctcacaacccaccttaaacaggttttaattctcaattaattaacattacacgattaaccatcgtgagctaccattaaatataaccataattaataatgtaagatgatttatgatttatcccattaattagctaatgtttctaagcatggctaagcaattatatatatatatatatatatatcatttagctgaaccaaaccaatatataaggttctagctaatcaaattataacccatagaaaaataaagtcatcttcggccattaattaatttgggaaagtctcaaccacccgatgacattcgaaaataatgcataagttgaaataaaacattagctttaaataggttcaacatgctcaaagggttgtttgggatctgtgtgacttgccttgaacttccgcaaacacttccgaaccttcctcaacgaaaacgctctcctccggaacatcggaaaactaaagcaaatgaacaaaatcaacaaaacagttaaaaaaaaagcataaacagtacatgtggatatttttaacatgtagatattgattttagaaaaatttagcaacttgaaccactcgaatccgagttacgatgatttagttatgaatttccgaagtttaatcgattttcatctaaaaagaaaaccgagaaaaaagggaatatgacgtcatgatgacatcatcaacgtcggctcgacataggcgacgacctcgccggcgctaggagactcggccggacttttggagggcacctacgcgtagaggacgacgacgcgatctcaacgatactcaccaacgcgacgaacgacggatgacggccggcggcgagcttgtgcggcggcggcggttcggtctacggcggcgacgggtctccggcgaccagcgacagcggggagagggcggccgaggttcctcacctccgtgcgcacctaacggcggcgaggggaagcggcggcgacgacggaatcgacggcgcggcgcggctgggcgtcggccggcgacggcggcggcttgctcggcgtggcggcggcgctacggagcacgagagaactcgggagatgggacaaacgaaagagggcgactagggggtcctttttatagccttggattagagagatcggactccaaacgagaggatttgagccggaaaatccgagggttagttggagagataaactcgaaaacgaattcgattccgcgttgatttcttcgggataaagtccgattgttgggggaaaggatagaggaggataaaggaaatatttcccctcaactaattttaggaaaacacaagagaaaaggtcggatttggaggggaaaaaccgagcccactcggtctcagttcggctgctagaggtagaagatgaacagtgtcgagggaggcaaattagactttttaggttggctgagaacagaacagagcaacttgacttgggccggcttgggctgcacagcacgcgcgcgagggagagagatgttgggctgaaatcagcccaacggcttaggagaagatttaaaaaccttttccaattaaaataatcactgaaatgatctttgaattgttaaaaatacttccaatgctcaaataatttcaagaaaagtcctgaaaatacttggacactcaaagtacttaaaaaaattataatcataccatttaatgattaatttaatatgcggataattactgaaatgttctttatatgattaaaattaggaattgagctccgaaaaatccgagaaaattccagagagtataattaaccatggagaatttaataaaaattaaatccatccatgctttatatttagaaaattttattttccacatttaacttcacttgtaaattaatgaacatttaatataaattctaataataatttattaaataatttataaatcctaaaacgaaaattaggatgtgacaaatacatagcttatatctgtaaagaaattttttaccggtgtccaaggacccttgttggccttaataggtatgcccctgaggatgggtgacagcagcgttctcgacgtcttaaccttcatggaggagccgtttgaagatctgttcaattttagcctttccttaagaactttgtcctcttccggcggtgccctgatataacaagttgaccacgttgatggaccgatcagagaaaagtgattctatcttttttcttaaccgttccctctacagccaacccaaagacatccatggagttttggttttttgggggccttgttcccgtttgcttctcagcaattggttttaggcatgtgacatgactacttttttttttctgacttagtctcccaaggctattaaaaatattattcaaaaaatttgcccatagatcatcacatagcccttgtaaaaagaagaagaagagcccttattgtcacagtagatggcattttgacaatctacgattcgcaactaccattccatttgaacgctgagcttttataagtagctactctatccgtttcatatttttttataagcagcttagcttacacagataaaggaacaaacagaaacacaagaaccattctaccatcacatactggcatttcctagcaggaatggatatgcattcttcggacagtttgtacaaatgccaactacaaaacttcctgcatttgcattctgacaacaataaatactcaggcacagcatttgcatatcattctccagcacaggatttcctagggggcaaacgggctagcaacaaaattttacatcatggaccaacgcacacccatggaatcaaaggagtggcctcatctacaccactcccttcacaggggcattttctcaagctcaaatgtgagccactctcttggcttacaaatgataggactggggacataaaatcaatttatacatctcgaaagcactcctggcttaagagtcttgtaaagcatgagctcagctcatctcagaaaatgggagctcgcaagacttaatccgccggtgcttgtttgcaggatacgctgtacccactgctgaatctgcggcctcacagaaagtaatctggcgctggcctctttgcaggaacacctcttgattcctgaatgcacatatgggcaaatttagatgctaatcaataatgtgttcaagaggtaatgataaaggtcgttaacacatacatgtggggcagcttcaaatacacggaactgcttattcaaattctcatcaagctctaggattgcagcaacattgccacacctgacaatttcaaagggttaagaacactgtgaggggattaaaatacaagaatcacagatctgcaaaagcatagcccacacaaaggttatttttagcaacccaaacataataatatacaaaaagatcagaacagtagaaaccataaatagctttgttcgagatattaatagaacaatagaccatcttatgttatcgatctttttattttttcacacaatcagtatacccccatctgatcctcattgcctgcaagccaatccattcccaacccattttgggtagtactagtgatcaaaacaaacatggaccatctgatcattgtcaacagataaaatatacaggattgatcacttcaaaaataattataatgttagctgaataataaggtacctgtagcagtagttaggagcagaccatacagtgacaatcttgttattgaacatccacttaaacccttccatgactagttgatgagcacggcaaatatagtctatgttgtttgtgtggttaaaagaagaaacaacatttccaccaaataggaatcctgcacctcgtggacttaatccccaaccatctacagcatcctctggatcagaccaaagaaggtcacacatggccccatcatgaggtacttcttgcttgcgatctattactcttatctgttggagggtacatgatatgtcaataacagaaatagaatgcataaattaaaaataaaaatggagaataacttgcctgatcaagagttgtaatattaggagaaaggcctccatggacactaaatattttgttctcaatgagtgcagacaaactgaagggagaaataagctgcaatcagtttttgtatattttaaactaaagaagcaaaattcttaattcataacaaaaaaagtaagaaagttgccttaaatagtcgaatatatctgtgcaatatctccagacattcactgagccgtatttacgaagacactcatcatagaaaccatagacctgcagagaatgcataagctcaatgacaagatattttttttcataacattagtgtagtatgagcttaaaaggattccttacttgtgtaatctgtctgctctcatggtttcctcgtattaaagttatacgatctgggtatctaacctgtatgcatatttaccacagcagttaggatgggtaactaaataacatgaacttgaaacttcaaacagaacaactgtttaggatatcaattgtttatgttagtttttcatccttccagggttttctagcaaatcaggttagttctagatacattcttttttattttcttgttgatgactgaattatagtttcatttatatcacttatttttttagctttttcatgaatagaaatggctagtgggtggctgagtttgtagttaacatttaacaaccttacagttatacattcaatacataaatcaggtgcaaatgacattactaaaatattcgccccaattcaagctaggcattattgcaaataatagtcaacatatactctgcaaatctattctagcaaaagaagttatctataattagagatattataattaactcatgttattccacaatatagaggtttcatggaatcagcataaatttgtatgttacgatttcaatctggccatcagccattgttccaaaaacaggtttctacttaactaggtcatatacccagctatacatgaggagcattgtgaccattttccttaatttatctgtataaacactaaaagcatggtaattgcatgtgtactccttacaatttctttggagaatagcatcaacatatattgcaagatacaaacaagtagatacaccaaaaattcttaaaagtgtcaacagcatacctttaaggccaacagaagcaaaaatgtttcaacagaataaaatcctcgatcaacaaaatccccaaggaacaagtagtttgtctttgggcagtcacccccaactttgaatagttctttcatgtcatagaattgtccatgaatatctccacatatctgagtgcagcagaaaaatattacttagcgcaataacattttttctgaacttatggagaaataactaatgaaatatccagtagtaagatatttgctgtatcatacccccattaacactaggataatgacccaggaagaatgttccaattacatgatgcaagtatgctttgcaactaagcttggcattaactggttattttgggttattaggttgtgttcagtcaataaaattctaccatgaggttgggagactggattaccctacctatgtgggactgatatgctattgtgcaagtccaaaactcctctattttacaatataaatcatttcaggactctagctttgtttgataataaaagttgcttttacattaatttaccatccttccatccaatacatatcatttaaccgcaattcgtgcctaatcaatgctttcttgtgcgccaatacaacaaaaataagattagatcatgtttcatataatgcttttgcaaagagctagaatgatttaacttatgaaatcaagtagaaaaatggcagctgtatctaatcttcagaatattaagttaattcagtttgacactatttcaagagaaagaacgactgccaggctatggagcttgtcttttggaaaaatgatggagcccactgtagctttatcccagctttacaagaattccaagagaaatgtgtttacaagaattaatggaagctgtagctttaagttaaccaagtagaaaatggcagctgtatcaacataattttcagaataaaatacaaccagacagagaaagtcattacaaaaagacagcgtaaaaataacaacactactctagctttattctgcaagcaaatgctgctgcaaacaaaattgtagattcaagatttcaagttagtggaacaatctatctatatacttatcatctgcatataaactcacgcagctgtgcagtgtttaatggttggaatgttggataaacacatgtatgctggagtgaatagttgttgcatgtattcactgaaccaagttaccagttcctcatagaaataagtctccaattcctaaatttaactccaggaattgggtctgaagtggagttgtggagctgcccaaacccagctccacctctctagttcattttatgagagagcttcacccagctccactcccattttaggtagagctgaaactgtttggctgggctctagctccaagagaggtggagctggagctggagctgtgccaaacaggccctaaatcttccaaacaatgcagatacaatcaggtcggctgcaattctaaaagaagttgatttcaaggatttaatcgagtagaagttacagcctttcatgttccaataattgctgtcagatcaaacaattaggtaaacaaataaatacaacaaactaagttactaaaacatgcaagaatccaaatcgcaaaatgtggaaaaatcctcagcacttgagatctctagggtacttacacacttccatgaaccatttcaaatcatggaaagtgtgaccaattcaactagtacaccagcaatcaagcacaaaaatgcactaaatacccaaaccaccacattgctgcacacacaataccagcaattttcaccaaagccctggaactgaacaggaaaaaagaatatagatatgcctcccaataaatcgggacattacataagcataaccatcgagctaagcatacacattacagcagcattctccccaacgacgcagcaagaaagtctaacattttcctcgcaaaaccacaatcctaaggacgatgatacaagcatatccagtggatacaggcaaaccctagaaccgtaatccaagcacgagctcatcacaatcacaggggagttacgcccacaaatccagctaccgaaaccagtagaatcgaattcttcttactcctcatcagcaaagctcatcgtaatcgcccaaaaatcgtcagaagcgaatcgaacgaaactgagatggaaggggaagggtgggggaaggggggcggtcaccgtgacgggggcgtcgacgcgctggacgttgctctcctcgacgaggatctccatggccttgaggcagagcgccttgacctccgcctccgtcagcggctcgcaccgcttcagctgctcgatctgccggtccagatccgacgtccccatcctcccacccacccacctcttcccccctccccgagagcttccagaaggttccggagggcggggtggcgcgcacctggagcttccacgccgccttggccgccgcttctggaaggttctagggcgcggaggcggaggaagggaggaggcgggaggtgcgcgcgtgcggggaggggcgggtcgggtgggggacaagggtttcgggcgcggtaaggttaccaccattctgcccctttttttcttttttggggttagctttttttttttctggcccaagctagaggcggtgagcttaccagaatgctgctggttgcttactaatagtatgggagtttcacttaaaatggaagcggagctgggtgaagctctcttgcaaaatgaactagagaggtagagctaggtttagacagcttcacaacttcactctagactcaacccttataagtaagagtctatttggttctctatcctaccaattcaattgtagtgccaaaatataggcaaattttagtactaccaattttttgatagggtagagttcatataatatgtgtttggtttgctaccatttgctaccaatatgctttttatagtgaagaaaattctagagtgctaccaaatcaagtatgggcattgccaatgctttggctctaatccaaaccaatcaaactactatttgaattgccaaacaattggtatcaaaaatggccctaaatttaggagttggaggtctactaaacaaggcctatatagttgtattttcttgtgttgggagcaacttattagcacatgattaattaagtatcagtttattttttttaaaaaagattaatatgatttttaaagcaactttcttatagaattttttttgcaaataacgcaccgtttaaccgtttataaaacatgtctgtggaaaacaaggaaagttagttgggaaaggaagggaagaacacagccatacctcaaagttctcaaactcatctctctcgttttccacgcgcacgtttcacaaactattaaacgatacgtgttttttttggcaaaacatttctatacaaaaattgctattaaaaaatcatattaacatatttttaattattttagctaatatttaattaattatgcgttaattcgttaattcgtcgttcagttttgcatgtgaagggacccctccaaattaacacaaccataggatagatggagtcgtcgcagcattattcttttcttctcatatgaaagttgaaatatagcaggagaaaaggagatgtaggaatagcatatgagggctagtttgtttttttttttacctagcattctctccttgtgttttgtgaaccatatataatatcctaaatcaaacattttaatctgttcaccatttttcatcaccacctaccatattgctgtatatattgttaaaaaaaatctgaataatttctaaaaaataatgtcgactctgacaaaaacagttgtgccgaagagtaaaaacagatgctctcaaagagtataacatgtaggattattttcgtccgtttcaaattagtcacctttgtaggtttgtcataactcgaacttgttaaattatatgagtttataaaattgatggtaacagattaaaatgtttgatttaggatattatagatcgagtgaaaccaggggagcagcataagtcctacgaactgttctatagactttaaattatatagagcttatgcattttctttattttgattatcatgtttcaccttgatttgagatattttagaattaggtaagtggttttgaaatgcatgcgctgcttttttaataaaaaatggatgaaatagattgaggcctcctttggattgcagaattttcgtaggatttttgggaatactgttcaaaagatgttctttaccaaattttaccacaggacacaatatggtccttgctgaaggacatcataagaatatgaattttctcagggacactcaaaaaaagtgataatttactataggacaccatgagcattaaaatataatatttactcatttgaggagagagaaaccacgtaaattgtctattttaccctctattccttcttcccaacctctacactcttcttcatcgccatacaccgcccgcgcacggggagggcatccctaccgtcgctaccattccgtcccggatggcagcgaccccgccgtcgcatgaccgcagtgctagagctccaacgcggccgtggcgccgagagagagtgcgtggcaggacgccgtcgatgcgtgtccgaggacgtggccgccgctcccctcgccctctatcttcccaacatcgtcatctcttgtcactctccaccccactgccaaggaactgaagctgagagctacatatcatcctcctcgccatcctcctcatcgtcggccgccaagaaggaggagttgccataagtcgtcaagcagagctcgccatcatctcgatcttccctgttccttattcatatcatcatgccgaaggttttaccttatgacctcaccctctctcgtgcagtagatcgatgggaacaccgtcatgccgacgtgaccccggagcgtgctctctgcgctactgtcaagaccatctctgcgttccggccgccacggtgcatggccgggccatccaccgcgccatcgtcatcactgagaccctaggagcccttcgacccaagcaatcgagacgagataccgtgaatcatgagatcgccatcgttttccaaactctggccaacctccggcatcttcgattccgtcgtccttggtgagttagaagccgattcctcgtgaatgtagcgtctctaggtctctattaacatcttggtagcatcgaactatcagctccttggctcggccggactggaaccgtcgcccatgggcttttcgccgccaccgagctgctctacacgaacctgccgctgttcaagcatcaccagggcttgtgcacagcttggtgagtacactagagcctgaagaaaacacatgcatgcatcatctaggccggactgagcccgtaacttgttttgcaccgcagccttgaagccgctgccgccaccgctcgcgttgccgctggcgtcaattatggccacctccggctacaagacgaccatcgtcgggttcgcaagaagcctgcgcatctttctctttttggccgcatcatctgaggagtcgccgttcgccgtcggcatcgccgtgaaggagtttcagccggcaaggccatgcctcagctgctgctcgcaccagggacttgatttataaggaaaacaaaactctatgtactaattggtcccaggggcaaatatgtcattttgtgaaaattctctctccaagatagcataaaatcataaaataatgtgtattttgtctatcagcaaattaccacgttttttagtgtctctgagcaaattcacgttcttccgatgtccctcggtaaagaccacattttttgagtattctgtagcaaattttgccatgctctttgctctgcccatctttggatggttccaatcctcttatgtagcactcgctgcactcgctacgtcatagggatgtccggcgcagctgtggcattcattctgcatcggatggacacactagtgaggcgtccaaacaggctcgcgctcggcccagtcaccgaaataggacggcccgtttgaagaaagagctcgtttcctttgccaggaaaatcgggatcgctcccaattcctcgtggccatcagccgacagccggcggccgctcgtcatcccgtccggcagtctggctcaggtgcgaccagagaataaactccgtagtactccggcagtctggctcaggtccggcagtccgacagtctggctcagctatctttcgccattgcccattttgcaagcaagaaagtactccatagcatacaagtccctatgcatatatgccatgtatgtatgttcaatactgatctcaaattgcagaatcgaacattctcaaattgacaaattaatcagtctcgaaccaacgaaaacatccattcatcgcattcacatcaatttacaatctcaattgggcttctcaagcagctgtcgcctccctccagaaacccgtggtggtggtggtcgtcgtcgtggctgcggtgctgtgggcatatggcaacaaaggctgcccttcgtctcgtggcggcgcgacccctgtcactaccgccgtggaacccgtcgttgtcgaggcagatctccaggaatgaaacagggctctcgcgtgtcacgcccagaaattcacgaaccagaatttctaaactgaatgtatattaaaacccctgtccaggaccagccagagtacacaaatgacaattgctgaaatgcagatccacgtcttacgaaaatataaaagattacaaatgcacgaaaaagataaaaacgagctaagcttgaagatttgactcctgtagcgaggcgactccattccaaaggcatccttgatggcagcgacgaaacaacttccttgagacagctccactgggaagaacttcagctctggtgtggggaagagagatcaaaactgagtactaaacactgtactcagcaagtcatatcagaagggaagatatgatgtaagatatatccaaaggaggctaggggttatttgcataaagctagcatttaaaagaagtagttgaaagcagtaaaaccgttgtagtaattaatcatcactgttcaacgctataccacgttaaaacaggcccaacccaccacctgaactaactagttccattgagccatactattggtgagactaatcacggtgaatctggtcgaccgcccataaccgcggacacggctattcgaatagttttactctgatcaaagatgtacaactatacccacaagacacagccctacgacacgtttccgtgtgccgacatgccaccacggcataccggaaagaggccgtgataggacccttcgcataaccccctttaaccaatctcaccacacctcaggttttgcccccgtccccagcaggcaacgggcagccacccctcgtgccacgatgaatccgaaagccaatccaccgaacaccccagccgacccaactccatcacgctcaccctagcctgggtacgtcagctagaggaaagctacactacaagcccagccgttgtccacgctggcttgtggtaagtacgataagtttttctagggcatcccgcgaaccggtccttaatcgccatgggtgcaaccagcaaaaccatgcacccatagcccaccatttagtgtgttttaaaaatctaatactgtcatggtggcacatgtccaaagctatgctagtaaccaatgtctaagcattaatgtgattcccctttgtgtactagttgaactaagcagggctaagcaattacgaaaacaacatctaagcatattaaatcccaggttagcaaaggaatatgacatacaatttataaggcgagaacagtaggtaaatagcccatcccatgacattataaaacaatgcagtatttagagaaaagtagagtatttgcaatatgggagcaatatggtcaattaacaagcatgacttgccttgctcttgcactgatgagacctctgcaacatcttcaacgcaccacgaagcgacgaaacggccgaaaactacgtgacaaacaaagcacacaagcaaaacaggccataagtttactaaaacaggaaacaaaaccatttttaatggattatagggatttttatgaatttactaagacttgaatagacttaaacagagctcggatgaatttctatgaattttagaagattcactgtgtttttactataaaaataaaagccttaatggatttatcgcgcaatatatcccaggcgatgatgtcatagggggggcagtggcggcaagcgggccccgcttgtcaatgacacaaaggagcgagggggcgccagctggcgggccccaccaagcagccgcccaaagggcgccgatccaccgtggaccgagaccacgcgggtggtccaccgccggtccacgggaccaatggcccggattggccgagggctgatcggacggcgctagggagcggctgctaggctcagcacgaccggccatagcgatgcggcgacgaggggcgcggaaggtggcggcgcacggcgcgaagggcagcagcgcggctcggtgctaggagggagagaaaggggaaatgctcctcaccgtgggattcggccggcgtgcgggaagacgacagcgaatgacggcggcaagcggtggatggcggggtgcgcgggatggacaaggcggcccttgacctcccgaggccgacggcggcgacggagcggcgcggcgcggcagtggaactagcggtggctagcggcggatggaggcggcaataggtggcggtgcgtggggagagcggtacggcgacggcgcgcggcaagtgagcagcggccgagattgctattgcggcggcgaagctagcggctgggattgcgtggtgtggcagcggctgtagaagtggcggtgtggcagcggctgtagaagtggcggcgcgtggttgatgagtggcggcggcggctgagcttgggtgtgacggcgccggtgcgatagaggtcacgggagagggaggtggaaaggggaaaaatggagaggaggacgcagggaagctatataggggtttgggagaggcggacacggccgggaaagggcccgatttggctggcgacgtggggaggtgggggagagagagagggggggattcaaattgaatcctgcccctcacgggcgcacgcacgagcgggagaagcgggttagtgggcgggcgacgtgggcgtggggcactggtgtggagtggtggcgtggaggagagcgggaacggtggtggcgtgggcggtttcagcggcggttgctgcccggctagaggtaggggacgacttgacaggtgggccccacctatcggcgtcccagagaggagggatggggcgtgggccggcccagccgagcgggcagcgtaggagccaagtgggccgatggcccaagaagaggaaaaaggaggaaaagaaaaaagaggaaaaagaaaaggattttcctgggattagaatattgcggataattgatttttattggttaaaactatttatagggctatgaaaattctactaaaaatcccgttaatgaaatgtgacaagtggaacccaagaaaaatcccacaatgccatttccaattattgattgcatttattaattaaggaattagctctaggttaatcaaattatttcttgaggcaatttattaaacaaatttttaaagcaagaaaaagggggaaaacttcagggcgtgacatcgcgccacgtgaggagtcgagggatggtgaggagggcggcgacgaggggaggggctttgtccgagatcggctccaatagcgcctgagccggaggagacgatgagcggccgccggctgatgtcctggagaacttgggagcgacaccgatttttctggctaaggaaacgagccttctgttcaaatgagccgtcctatttcagtgacttggaccgagtttgagcccgtttggccgcctcactgcgtgcgttcatccgatgcggtatgaacgacgcagctgcgccggatgtccctctgacgtagcgagtgctacgtccgaggatctggaggagatggaacacaccagccgtacgaaaaatagaaggaaagattccttcgctactgatttcatgggaaggcatgggaaaaattttatccacttcaagctcttttttattttgcttcacaaaagaccaaagcaatcaaacaataagtaggtgtttttgaagaacacaatcggagacatcgagcaagagctttggataaggatgataaggaagatagaaaatacagggatcattgtaaacttcatacggccatacaaatgaacccatcatctatattcatgcgttttgaggtggaattggtgtgtgtgagagagagagagagagagaggaggaggaggaagagggatcacgaaagagaagagagggggaggtgaggaagagaatgggatgagccgatgaggtggaggctcttgataagggggtagctagcccgatgaaagctaaggtggtcggaggcaagggtgctgatggtggtcgacggttaactttagctctaggagctagtgcaaatctgtggtcacagccggctgttccaaaggaaacctggggagttgcgcagggagaggaagaggatgaaaggaactggtggtcggaggtgttggcagcaacgccatgccgcacttcgccggaagtttcgacttgggataagaaggggtgttctagaggcgggttttctgctccgacaaaatgctatgctgtcgaaccgttgtgtgtgcccaagccacttgcgctggggtcacgcttctgggctctgggtgatgagagctcggaggatgaagttgaccgtgaggagcatcgatcagaggaggaggtgcaaggtggttcggtgctgccggaagagagcttcgtcaagaaggccatcgatcaaggcttcaccgtggatgaaatactcaaggcgggtgaacatttactttgtatgagttcgccgccaaaggtaagttcgtgctccatgaattctgatttcgtcggcaacagaaaactggcaaagaaaatggttgaaaaggtggtgaatcaaaaaacaactacctgtaaaccttggaaagggccgttaccaaaggctagggtttcacagcctttaacctttggggacgtcataggagttgctttgaaaaaaaagaaacgagcgtctgtggcttcgccggcgaggttcacgacagtaaacggtgttaattcgccagttgctgaggagaaccttgatagggccaacaaatctctttcctctatgaggcttcctgttgcgcatacatgcagcataatggagaaggctgcggcggcgccgccggcggcggcggtgaggtctagtttggacgacaatgctaagacattgaagtttctgatgaacctcgacaaaagagaaaaagaaggaaggatagttttgatgagtccagggggacagtgcacgtcggatatcgaggcgtcaaagcggtcggtcgagttgttgtcgaagggcggcagtgaacataaatttgtttcgtttggagtaaggtcgaatttggtccaattcaaatgttgccaaggactgggccgactactctcgcgtgcgggccaacatatgtgggctacagagggagcaactaggcaaaaacgaagcgacgtgactgtagggcttcgcaccacacagttagtgcagacctctcaaactcgcgagcgcaagcaatcggtaggcgaacagagtggcggcgcccagggagagcgaagcaggcgagaagtcaccatggcatggagaggtgaaggcagcggtcgctcggatggccatggtagggagaggggagatggcttctgggaggaggaagaagagttttttggtgcaaggtttgatgctggccggctaggttttgagccgggatatggttttgggcagcagggaaatcatggttgggggcagcaaaggagtggtttcaggccaaggggatcacgtagctttggtccacgccaaggaggttttgccggccgacccggaaggggaggctgggaaaacaatcgcttctcgatgaagcgctttggcgagaggccattgttgaagaatgagggcaggccaggaggaggaattaacaaggcaggaggtggttctaaatttgcagctaagggggaggttggtggaggagtttcagggggaggcggtggtgcaagtgctgggaaagggaaggtgaaggtgggtgatatggaggtagtggtgaaccagatggatggggctgcggtggtgacggacgatccggagacaaattcagaattggctatcttggattgtgatccatctttgtttgttgatcaacatgttcgtgaggacattagcaaaactcaagcaaagttgaaggtgtgttctaggtgtacttagaaggggcacgtggctgcagattgttcgtcggagttgtattgtgatatttgtgatagtgttgagcatgtcaatcatcgttgcctagtattgaagcaatcaagacctgctgcacatgctgtgggttattcagttgatgggttaggattttatcacattcctcacccacctctacaaaaaagtaagaaagggtccaagacagctttggtcagaattgaggggggctgcctaattaaagagaaggcagtatcacaacttcagagaattatttcgacgaaatggaaatgggagccagttgaacacgaagagaattcttttgttgttcctttcccatcaaagatagagttacaacgagctattgcgtatggcggggcaaatgtgaaagaaaatggagttcttacaggggctcgtctgaagttcgaggagtggaatgagaaggaggaggggtttctgctgccacaaggtgtgggtacgggtttttggactgagaaagaaactaaggaagtaccttaatatttgggcggttggttctcttttaggcgccactcaaactatggacatgaaaatgacgagaaagaatgattttggaaggatctttgtggatgttttaaacccgaggattatcccaaaaaatttggatgtagtgattggcgatcatttttttgagctggaaatcgaggttgaaaagatgggttttgatgagaatgggaaggaggtagaaatagaacaacatgatagagatggtgatggtttggaggaaaataaggaagataagcatgatggtgatgggagggatggaagagtaactaaaagagcaaanaatgatgacatgttagtagatggaaaggagaatggtacaacagaaggaaagtatgatgcagccttgaatgggaaccaatgtcagcacaagatgaaagaaagtgagatctctgctatagctttaggaattttggatgttgcagttggcaaagtgatgaatgaggtttgtgatatggtgatggaggagacagagcagccaatagaggaggaggagttgcctcttgattcaaatctgggagatgaggagaaaggagagcaagagcaagagcaggagcaagaggagttaacattagtagagaataatatagaagaggctttcaaggagagggtggttcgagcagcaaacgttaaggagacagttatgacaccgaaacgttctagtgcaaggctgggttgcaacagtggagtgcactctgtggaaaaggcatggaagaatttagagctgcaacaaggtaacgaagttaattcgtttttgtctttttctaattcctccataacttctagtttacaaaatttaggagttcttctaggtgcctctagtgatgaaattacagattcagtttgtagccttaaaaagacagaggttgaaaggattaatagtagtttaagtctagtaagggataatttagaaaagttggatgatggggacagttcagaggaggaagatgatttgaattatcttgtccttggtcacttatgtggtgatctgatggatgaggttatggatgaggaaactagtcacct

SEQ ID NO: 46994 - DNA, 762 bp, Oryza sativa
ttgtactggaggatgtcatttagtaaaatcacctaatctggttgcatacgaaacatgctcctgcattgaggtccatttcctaatgtttgcatcatccattgttgccccgtcagtagtggcacacgacttggtgccctttgcggtcatacaagttgagctgcaaggaatccttcaatgtattattcaatatcatcttcggatatctcgcccatcgtaccttaggaatcgtcatcgctgctactattgctcatcccttcttatctgcacaaacatggcaaattcatagccacacataaataatccatttggaattgaagagggaacacatatataaaaaaggcaacgacggtccaaacagcatgacttagtaaatataaaatgcgattaacaacttgactcatcacatagaaaattgttacaacatgaaaaccattgcacaacgttcaggaatttacgaactacacaaatcgaacttaacgagaacaaatacgcattgtttatgaaataacaacagggttcacgaggagggaagaaagtaaacaatacgatacaatattaattgccttagcaaacagttctcatcctcttcggtcaaaatcctcaaggtccccctgcaccatcaacaccatctcctcgccctcctcccgtggacatcttcgtcgcctccattgcttgtcgttgtctctgttctaaccctgtggaatcggtcttctcagccatagagtgggcctgtccatgccgccggcaccgatgtgcatcgca

SEQ ID NO: 46995 - DNA, 898 bp, Oryza sativa
agcccttagataataataaaaaataaaattgatacaaacaaaagaaattgggtgaaagtttaaaagaaggtcgtaaactaatattaccttgagcacttagactagcactagcttgtccacagccaaaagtgctctaataaaaaatatgaacaatataacacataaacaaaataacaaaaaatagtctgctaaaaaatatttagcagttaattgctggaatcattaacattgccattaaaagtaaaaaaaacaaatatataattaaagggtactacaaagcatgtatacatatatataaggggacacttacaggagcaaaatcttcagttgacaatgggtggtttccaacagaatgttcagcatctgctcatgaataaatcataaagttgatattatgttacaacaataataaaaagaatgaatgaatcttaagtcacaaaaattaaaagtacaaaatccatacaacaatgctaaccaaaaaaggaacaaataacttacaagatttactgtgaggagttcgcttttcattaaattgaaatgagtgattgttaaatccaacatgttgcttatcagtttgaaatgaagcattggctgtagctgtgtgtgcaatattatgactgtcaagttgaactgtttcagatgaactagagtcatgcaacatctgtaaaatgctgagaataacatcttcacatgacagactatcagagacatgatttatagaacagtgactggtaagcttatcgcaaaatctttcaaactatcagacaaaaaattcccaatagctgaatcaagtttgtgatggaatgaaagcatttgttcctgtagtaggacagactgaaaaaagaagtggttaatatataagcagaaaagagatgagctgcactatatgaaaaataaa

SEQ ID NO: 46996 - DNA, 4185 bp, Oryza sativa
  unsure (1)..(4185): unsure at all n locations
gcccaaagaaaaacaaaattaaaagcactggcacgatatatgcaaaagaaggggccatagaaataaaactaacctaaaatgtcagtataactaaacatagattcagagcacatgcaaagcgaataaaaaatgggaataaaaataattagagcataacaagcaacatgaatacaataaaaaaatcatatatttagtatgaactgtatgaaccaaaaatcacattctaatttcaaagaaatcatttgcagcactgtgggtgtgtgtgggaagcggagtactagtagaatgaatcacacagcaatgttacatacagtacactagttatctgcctataatcaatttgcagagtctgcataatacatagttattctcaaaaataacaacaatgcatagttagtttttcatactacacatgtcaaatgtgaataaactacatacaaactgcagatcagcatcaaaactacatccaaaaaatggaaaataacacacatcagaaaaaaagcatttgatccaaaagcacttgatccaaaagcatatagtactctgcatcatatgtaaacttagttctctagcatcatattataaaacgtataaaggacctgtgaatctagcatacacaatatgctctaatttgcatcgggttgctactgcataaatcaaccacgctggttgcatctccaaaaaagcaaatagtcacatacaaagggtacaaaaaatgccacaaaatattaatcctgatgctactccctatattaaacacgggaagttgcaacatcccagcgacgctagccaagcacatatccgtagatgcaaaaaacatcagatccgttatagttaatactagatcgatagttaatccataggtccaacagactagatccaagcttccagcaacgctagcacataggattcaaaaacatgaacagaaaaaatcaaaaataaaaaagcacacacatatgaaccctaaaatacaaataaatcgttgctaaccacgtcagatctgtgatagttggaacaaaataaacaagttctgcactgcaaaccaaaaaggattcaaaatccccaaaaaaaactgagaaaaaatgcaacaaaaatacctagccatgaacgagatggatcaatctccagctgacagcgagagaaattcggtggagagcgctcacgaacaaatccggcgccgaagaagggaagcacgagagaaatcgcctcggcgaggtcgctggctacgcgtcgctcgaacgagagagagagaaaaggaaaaagtaaaacggaacaacccagcggcgcggaaaccgatatcaaatattgttcaaaattggacaacctaaacgggtaagagagaaattacgggatccgataccacaattattgggtcaaagcgggtccgcagacaaaaaaaactacacgaatcacggcgtctatccgacagtcagaacaggcgactgcaatcaaccacaatttatggcgccacaaatctagcaatttcgttttttttttctgcctcgattcgctattttcttaccgttgccgcgtttttttttcatgatcgcacgatgacgcggcattgcaggcatgatgacgcgagcgacgattttatgtgacgtgagcaacggagaaacagacaaaaaaaaaattaaggcttgtatttgatacgtactcaaggccatgaatcaatcggaaatttttttttgaatgaatcggcgaactgccaatttcattgaatagagaaggagtaaactttacaagtaagaaaaccaggcctaggaccttcggtcctactgagctaaaaataaaaagcaagccagctaccaagatgcctcacccccgcccgagaccatgttttggcctccnnntaattttggccaacagacttccggtagataactctttgtgctgaaaaattctacgatttctctcgtcccagatttcccagttgaccagaagtgttaacgtgcgaagtgctttcttcggggcttccttcaagttggcggtggcctcccaccactctgacaccgattgagctggttgccattgaccgggatttagttgaccacacctagtccaatcagataacgccgcctagattttcctagtgtatctgcattctgcgagaaggtggagagcagtttcttgggtgtgtctgcataaggggcagaaagaactgttctgccaacctctggttaccagtctgtcggaggtccaaactctattttggatgatcaaccaggcaaaggtcttgcacttgcgtggtgcccacggcttccatattaggatgttgaagttggtggctgtagtacctaggagctgcgctttgtaggccgacgtcatcgtatattcaccgtggctagtgagcttccacactatcttatcctcctcattttctgtgaaatgtacgttgtgtaccgcactcagacattgattagctggctgaccagctctgttgtccaacctgaggttggaggaaggtctagattgagcagccactggtctgtagttgaggcctgttgtagcgtggtgttctttttcttggaggccgcgttgatcaggggagttacatcctttagtcttctcccttccagccaagctgagtcccaaaagcttgctttcgctccatcccctattgttatggttgttgctgctgcaaaaagtaacctatccgtgtcatcacagggtgttcccgaccccacccatgctttttccggtgatctccactcgttccaaagccaccacagtcataaagctcttgcaaattcctccaagttcagaatgcctagtcctcctgaggctgtagggaggcaggtccgtgtccaatttattttgcacttgccccctgtcagagcttcaccgcttgtccataggaactttcttctctgcttgtcgatgacctctagggactcttttgaagctttcaggcccatcagaagaaaaaaaggttgtgaagtgagcaccgatttaaccagcgttgatcgccctgccaggccaatatgtcttcctcgccagctagctactctactcatcgatttgtcgtagagaggtagaaggtctactttgcgtagacagccagtggacagaggcaaccccagatacttcatcgggaagcttgccctagttgcaggcgtgccatgcaggatgtcgtcgaggtccagattattgcatctgatcggcgccacttgcgatttttgcaggttcgtgcatgatcctgataccttcccaaaacgatttagcagagcggcgaaggcactcacgtcctctttggtcggattaatgaagacggccgcatcatccgcgtacatagatgtgtggaagcgcacagctctgcctcacagcttacttagaactcctatgtcggtagccttgtctaataggcgctagagggggtctatagccaagatgaagaggaggggggatagggggccaccctgccgcaaacccttcctgtgtctgattgtttcgcccgggattccattcagggtgatctttgaggtggaagtggacagcagcccgaatatccagtcgcgccatttttacgggaaacccctattttggaggagcgcaagtaggtagtctcatctgatcgagtcaaaagccttggagatgtccaacttgaaaaggaggatcgggcgccgagtcctgtgatatcttctcaccatattcctcacatacatgattctaatgcgatgattggaatattagtaatctgttaattagttaagatatatatatatatatatatatatatatatatatatatatatatatatatatatatattataaagccatacgacaagcacataaaacgtacaaaattctaatgcgacgattggaaaattagtaatctgttaattggtttatatatatatatatatatatatatattatataaagccatacgacaagcacacaatgcaaggcccgcttttcccgtgaccacttatcacactgatcttgactagcctctatccattttctcccctttttgactcaaccatattgtgatttcttagcaagcaaagaaacagaagatatggcggcgagacaaggcatcccaagtgaccatttgtcgtatctgcaggttaattaggataaacatagttgggatacaagcagtaaaaattcatgaacagtgctaatatatacttcttccatttcacaatgtaagtcattttaacttttctcatgttca

SEQ ID NO: 46997 - DNA, 4659 bp, Oryza sativa
  unsure (1)..(4659): unsure at all n locations
ttcaaactgcatggataccaatcccatgttgacacaaaccagtacgccgccgacagccaccgcgagatttaatgcttaactgttgcctagaaatcaattagattttcatcaccttctgccctctcctcctcttctcaccttccaaccgatccaaaacccaggcagctcctctacctggcgaaggcagcaaccgtggcgcctagctcccccccccctccgtcacgtccacatgagtctctttgaggaaattcataatatgttttatatatgctacatactgccagtatattaatcataaagtcctctcaactattgtaggacaggggagtacaatgctagtcattatgtggtggctgcagatatgattaacaaaaaaaaaattatctacccaatcgagggaaggagacgttgaaacggtttataaaactgaaggaaaccggttgattttcccaaaagttactttcggatcgtctcgataacataaactacttggttttcaagtaaagttttaaaaaataaaactgaattttaattattttcaacaaaatttgatcagattttgttgggagtcagcggttacgttttttatataaaaaggagtaaatatcatagaaccctacctattatgattaaagttacacaaacacatgaattttggcacatgacacatactcaggtatttatggttatatataaagtttcacataacccgttaaccaaactaacatattcctatttcaaaattttaaaatgttttagttatgtcatgtaatattttcatgacgataaataacttataaatttgaagtgattataagactaaaaagtgcggtggatcacagttaaaatgattaatattttgtttgtccgaaactttgtaaacatggtaccggggggtaatgtatacaatttactttaagaaaagacaatgaccctagggttttggcttaccaacgattttatgaattaatttagatcgaatccaggggcggatccaacgtgggtgcgcggggggggggggggtggcgggggactcaagttaagtccccctacacccaccggaccatggataccccctgagtccccccttcaaatttttcgtcatagttgataagataggaggtgctaaaggtctcctaatagtattttagtatagtttaatactccctccatcctaaaatataaggtataacactcaaaacacaaagaccaagaaaatattttatcatcttcatggttggatcacttggatgcatgcaagcaatgtgattgggaggtttaatggtataagatttaaaacaaatcaattttatagggtcaagagatgctagttaatatatacatgcatacacgccttatattatgtgacatgagagaaaaaggttgtgccttatattttgggatggagggagtattgagattatgtttttatgtcgatgtactcggtatgttgagtcccccaactttctgtttctagatccgcctctgatcgaatctatgatgagtgtgggtaattaattaattacacagatgagtgagatgacgaggagctagatagctgaccttatacgtgtggggggaggggggggggggcttcgtcccttggacgtcggagctgtagagacgccgtggtggggtctccatgaggcagcggggagagaagctgagctcctcgagagcgcgcggaataatcggccgctgcagcagcgagcggccggtggatcggaggagcactagcgatgccgtcgccatccttttgcaaaaccctagctagcgagtagcgagcaatcgatggatcgcggtggacatctgtcggctctgtctgcagctattagcgtcgggaggacggccgctgggcactgactcgagtcggtacgtacgtaactccgtatctgtatccgtatcgagctgagatcgctagctattcgatttccctacctgcctttccgcggagatccaacgttttgtaagtcaggagtaaaaatatttgtgcgttacacaggtgagataattcactactaaaaatcgattnttacatgccgacaggtagcctgcaaacgcccaaaagtatgcaaaaatcagattttcgcacttaggcacttaagctgacctcatgcgaaaagaaaaatcaagaaaaaaaaaatccaaatcctctcatcatcgccactgctatcctcctcatcctcccatcactgccgccaccatcgttggcgtcgtcctcctgtcgctgctgccgccagatccaggcacggaagagccaccgccaccggatccacacgggggatggcttgccaccccgccacccgccgcagccgctcctcgcctccaccaccgggcgggggagggccgtcccctgcgcgttgacggctgggggaaggggcgcccgttgctgccgctcctctcctctgccaactgcccgttgctaccacccaccgtgcgcggccctcgccggctgccattcactcaggaggaaaaagagatcggagagaagtgaaataagacaggagtttgagagagagagagaggagtaatatgaggagaaggttgactcgaaaatttttttaaccgctgacagggaaagaggggcaagttagacttataggcggacttttagggggcccacatgcatgtgaaaatagactcattcttttgcatgcggcaacttatgagaaaaataattgtgagataaatttggaagagaagaaaaggataaaaatagagaaattagaagaaaagagaggatcaggatgataaaaaaggagaaaaaacgaaaaaaatgggagagagaaggtggctgattgggaaggggcgtgtgtggcaccgagtggagacacgtgggactggacaacggtatggtgtgggcctgttgggttgggttgggaggtggtgtataatagttactgtagtctcatgttgaattagatacaagcgacatacaaccaactcaaacattaatgacataccagaattttgacagaaacatcttcaatatttataatatagtagagattaggatcctaacgcctagtagataaaaataaagcagatactaatggataatgccagatacaggtacgaatagctcggataaaaaataaatataaattatctcgaatacagataaggaccgaatttgatcggacgcaaatactagaacaaatatttctctcaacatgaaaaccgcctaaacttctaatagaaacaaatatcgtcacacacataattagcttattttattaaaaagtttgatcataaactaaacaatactaattaaattcaacatgtatagcaatgttggtataaatacatgtcttactgatattatcatatataaaaatatattaataatttataaaaatatttatagtctacgtaacattaatagaagaaccatactgtttcacattctgaaacagctccacagcctcatgagtgctagcagctgaaaatctggtgcatacgatggctgccaagtaatcacctgccatggtatcccaattcccctataacattttgctactctcccctgcaggtgggctaaagccaagtttatccactgatcaacaggtgtaccagtaatttcataaaacttttcacactgcttcaatcagtcaacaagatcttcaccagcaaacaaaggaatttgcatgacacctccccaggccatttcattgcttttaattgtttggttgcctgtattctcccttttaccattctgatttatatggcactgggatagtcaaaatttcctgcattctagtatctcttacacacccagagattatttccctgtataaagactttgtggtgaaattccctgatttagtcaagctccaactcattacatccctttcttctgtaagtgtaacatcccttaagatctccaacaaaccattacattcatcaaggtcctcttctccatgagttccttgcagttctatattccactccccatttgtacaaatttgcttgaccgctgcccttggctccctacatatactatatatatatatatatatatatatatatatatatatatatgggaattgaatcttcaatggagtttctccaatccacacatcatcccagaaaaatacggatctcccactctcacttttgtatttactccctgctctcatccaatgtttgaactcatgcagcccccttccaaaattgtgaaacccctatgtcagtagattggaagaaacctcccttcgcacagtatttggttctgagaagtctacagcatgggtcatttcccctctgactcaatcttgaaaatccacttgcacaataaggcttcattcattaccttggtgtttatgaaatccaaaccccctaggtccttgggcctacataattctttccacctaatcatatgatattttattttgttttccaatcattccaaaaaaaatctagttctcaaattatccatcttatgatgtgttgtctttggaaggattgctcttcccccatacgacaaatggccacttttccatgttgctagccttttctcaatcttgtttgctgggatacttaaatcaaccgcaatcagcttcccccatacaacaaatggccacttttccatgttgtagcctttttctcaatcttgtttgctgggaacttaaatcaaccgcaatcagcttccttcactta

SEQ ID NO: 46998 - DNA, 1855 bp, Oryza sativa
  unsure (1)..(1855): unsure at all n locations
gtttgatgtagaatctgacacttgatgtaaataaagacaaacgactaataattgtaaataacaatataatccagaagaaaccaattggctaacaatgatatgatagaataagcactgatccgaaggttaaagaatatatcagctggaggtccgatgtcataaactccacaagattagataaatcaatgaaacctttgttatcatcggctaactccaacttatatatgcaatccttataagccgatgcaatgtccagataactcatcgcctgaaaccccgatgacacccttattggtagtcaacaagtagactagggattatggttctaagcatgacttagtagatcaaacttaactaatgtagcactaagtatgaaaagaaacataatatgtagacaatcaagcccttgactgatttttagagtggtagataccttagctaatctaatatagtaaaacaatttagccgataccgacagaaaccctaaagcgagagacaaccgatagacctaaattgagatactaaaactagattaactaagacatatgataaataggcaggcaaatatatcatccaaatcagagcaatccaagaggtcgaatgtactgatgcagccttgaacgacgccgacgtagacgatacaattgcctaggctggtggaacattggactttccctctcgccggagatcgaaaacagatgcagccccgcgtcaggttccatgttccgccggataataaaaagtagaaaacataaaaaggtggcgatgcgccaaattgtattgattgtggagagatctataacaatgaccccaggtgtacatatttatacccatggggagatactagtccttgtaggacaagaaagaaactttcctaaagataaaaggaaaacataaagtccttattggacactaacacactttcctaaagataaaaggaaactaacaaactcttcctaattaatagataaactgacatgacacatcctccttgaactctgtcactttgagataagcttcctttaacagattaatttccttaaccgaatatagcaggaatccgacnattggtgacgtgataattcacagcggccgatcccaggactcagaagccaatattgactccaggccgatgatgtcttcggggctcaccaaatttcaaaggggacgctactgtcctctccttttttagacgggcatttatctagccctctccaatcaatggcacatggaaattaggtgtttatacttgcagagaagaaaaccgcccgtcaaaaatctttacacatgtgcaaacagacattgttcactttaagatagtcgcctgcgaaatctcttttagcgggtagtttttatcagtatcttgaatatgagataccttatatttgtgtactatgcttggtgcgcccaccatataccaaattctctatggaatcaagcctcatacaaaaagtgttctagattaaaaaaaaacagccttttttttgacaaattgatctttttcaaaaagttatttcaaaactagaccgtgcaaaaaaaaacttcaaccaaaaataggccattagctcagtgccaaccgccttggcgctaaggttagccttcttagcgccagtcgcattggcactgaccccgctaaccttagcaccagccgcgttggcattaaggtagggtccttagtgcgccggcccggcattcctctcttctttccccacccaacgcggctaggattcctcctcctcacagcgccctctctcctcctcccccaaaatctcctcaaatctcccttgaatcaaaggttattttgtgggcattgctttgtagattgatttgtaaggtaaatcccctccaaaatccc

SEQ ID NO: 46999 - DNA, 2936 bp, Oryza sativa
  unsure (1)..(2936): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagattcgtaattttatatcatgaacaatcaattcagtacattatcaagctttgtaaaagtacaaactgcaggagaaaacagcagaaaactcgagaaaaataatccaagaccgcaaaatcttatctagtgtgtgatcttggttaatacctgttgtgttgctttgttttaaattgaagaatttcatctttcaggattacagagcattgaattttttaaaagaatatttttttttgcaggcccaaatgttatttattatgaagaaaaaaagtagaaaagctagacatgattcctatattgataggcaagacaaaaaaaaaatcatgtaattttttctttttttacaggaaaatttgctactaaatggaacacactaaataatgcttcatggtttgttaacgagaccttttgtccaatcagttcaagtgcagatgcaaaattctctagtcgagcagaccctagcctttctcgctgaagatattcctgcataaagttataaatatattaataacatgtggttttggatcaacaagactggtaatgatgatgaacagtgaaaatcttaccacaagatcaaactgagttcctttcacaaaagcaaccagcttagaaagctccttgccagacatcaaatagctagcatggttctccagaatattcatgacagaggcaatatgtgggctgagctctttcattgagttactgcacaaagaaagatttacagatgacatattttctaatagaaactctatagccttttaagttaacttcacaatgtaccttctcaaatcagaagattgtctcttgaatggtgaacgtaattgaaagtagctcagaaaccttggagaaagcttttcagagtctgtactggcattttcaaagtctctgccagatcttagcaagaagcgaacctaggtacatgaaggtatccccttactcatctgtggcattttattataggaaattaaaaagatatagcatgaatatcataccagctccccagcaagctcatagagagattcatcaagtgtagcctggatagtaacaagcactaaaaagtgagaactggaaatgtgaaacaagtaaacgtacagatcaaaaccagctgacagtgagaaggtaagagaatcacttgtagcaaacggagtgcacagtactgactgacagcagggccttccagcttcgcaatgacctgtaatagcaaagccattttcagcaatagttcttgcaggtattgatgaccctctgttgcatataactaggtttatcaaacttaatagatgaagaaattgtctgttcatgcaagcaataaatactggactttatagtatttaacgtctctagaagagtttaccgtaccagaatgtagcaagcagcagtcctataccatcgccgttggaagcattcctcaaacatcctagaacatgagggatcagttttactaaaagaattagcagaattattgtattgtattccaaatcttgatcaaattgagacactgttggtgggtaagttttgttttcactaaatttcattttgattctgatcatttccatgatacaaacactgtttgcaccatggtataaaagaagaatatgtgaggtactttggactttggagatgtttatagacagaatgaagaatcagatcttaaaaaataactgaaaaaaataaatcaaatgccacttctctccactcaaacaacaaggcagcacacttactctgtggatcgtccagctgcatggaaaagatctgcccagtgccgaccatcagttttcctagcaacactgactacaacatccatgtattctggaaagtttcgaagtaggtcacatgtcttgtctagaagagacttctttgcaggttcatttttctgcgaaagctggttttttgaagcactttggctgcaattggcaaaaaaagccaccagaaaataggatacagaataatatttcagcaaataacacaatagaatgaaatctagcaactcggtacacaaataatgcaagaatgctaccattaccaagttagaaccaatataccttgatatctctgcatcaaataccgtaaacaggagccattccaaacatctagagaagtgaggtttctctgcagacaagtttgccaaacgcagagcttcttcatgtttgtctctctggtttcaaaaattttacagaatgagagatgcatagggaaatgattattgccatatgagtttggcaaaccatgcatagttaatggtccataatacataaaatgatgcaagtagccaagtaaaggctccctgtaaacaggggatattcaaagtgaaaaaaaaatgtttttttttcccaaggctatggttcataatacatatggcttattctatgtgaaaactgtttcttttaatagaaatttcagaatataatatttcgatccctttacagaagtgattgatagaagagctaggtaagtgctagattcgcaacaaacaaaatgtcttgcagcacaactcggcaaaggaagatattacaatatagaaactatatgagaaactacatgacagtgcagtggtttgtaaattgttacaaaagaggatctcatataaacggactaaaccagaggaaagaacaagtatggccaacaacccataaaacctatactcttctcgtttcagcaatgagttctacggaatactaaaaagtgcagaga

SEQ ID NO: 47000 - DNA, 10071 bp, Oryza sativa
ttgataagaaatcaggtcattttctatttaaccatgacaataaacaggtttttcgcttggtttgcaccatcacataatccttagtgagaactcaatttcacgtgtaatattactaggagtcaaattttcttgactaaatgaagatttcatgatttaccactcttcttgcattaatgtcatatagttcctatatatagcatttctatataaaaagaattatgttttgatttacctgaaggagatgccgcagcaaacaatgcaatattgtttgggcttgaggagaaggttcaaagcatggaaactctgcagtcgagaaggacattctctgagaaataccaacaactacaccaacatttggaagaagaccaagcggatacacctcacggtcaaattcaagctccggatccagctgcagaaacaaatagcatgttctccattaactttgaatactaccaccaataagagttcaatgcaagaaagaaaacaacatatgaaactattatgattttgatcaagtttttccccaaaaaaaattgataaattcacagagtggatcgcaaaactcaaaagagatgtcaatactatcacaagatacaaaatctgtacctgcaagaaatcttcttgtttaaaaggattttctccatgggatgggtaccacacctgccaaaaaaaaagagaagggttggataaaaggatagcaagatgtggaaagatgttcgatctattaagagagacaagcataattccttaaaaataataaagaagaaaacaataaaactaacctgcatccccttatggccatagtcaagccatgaaacctctttgataagattacccttctcttcgtattgggaacaagtgacccaaaataattcaactgaattagtaagtgattgttcatgtccatcatccatgtccaacacagaaagttccccattcatccgcaagattaggcatctgaaatatatataacaaaacaaataaaaattaaggagaatagaaatcatttacaattttaacatttgaaaaaagtaccttgaaggttgttgggacaagtcagaagatccattagtatcatgtttcggctttccttcatcagttggttcaggaatgaagcgcatcgaaacaggtggactctttggactcatgattgaaagttctcggactgttgaaagctgctgacccaaagaaaacaacaaggtcaaatgaaatggacaacacattcggtgcagtggttgaaaatattttgcttcacctgtaaaacaggactactagcaggtgacaattctcctgatatcaccacatggaaaatatgcacatcaaatggactgtaggtaacaagtatgtagtcctggaagacatccatgacaattggtcgaccaagaagtgatttccggtaaagtaatgagctataatcaaggtgatatcttgggaaaaagagaagctcatacctaagacaagtgcaacaaacatgtcatataactaaatagatagcaagtcatgcccgcatattggtatttaaataggaataaaaagctaggagatacagaagatggctctctgatatattagcacactatgcatttcagctagtattctgtgagttcaagcaccatgagatttgtgcatgaaactctcagctcaaatgtaatgacaagtaaaaattgtcatgtgtctgttaagaaaatctcaggctgaagacaataaacagacagaaacagagaaagtgaggaagcaagactaacgtatttgatgattcaatgtagttgcatacaataactattttgccaagccacaacaagcctttgcattgaatcttttgctcttgagtaacatccccaaaaacacgccaccttttattgcgcaaatcatacagcactagcccatgagagcctgcaactgccaagtacataccatcattgcttgcaacaacatgaagaactggccaattctgtgaaatataggatgcctgcttccagaaaaaaaaactatattataacaagtcttgaaataagatgcattgaggcatttttgcctcctaaataagtttgatgaaatcaaacacttaactggaacattaagatgcaacatcttaagttcatcagtatcatccggttgtaccaataggattcgatcttcaccataaagaatctggcgagtatatgttgtgcccaaaagtcctctgtttaggcaacatttggcaaatgagaatgcaagaatcctttctgacaagttttcttcaactgcaaatagtttatatccataatcatcccactgaatgtgtgacgtccctcccattagaggctcaaattttaaagcactaggtttaaccattggagatgaggcagaatttgatccggtttgacgaattgtgcacatcaaacgacatccagatacagaccacacagtaagtcccctaaatttccatccaactgcaaaagcacaattgtcaggcgtccaagatatacaagtaacaggaccagtatcttccactgaatacctacaatttttcccaaaggaaaaagggacagttatatatcagctttaacggaataactgaaatgcattgcacagtaaatacacaaaatcacacatagtaatgaatcagagaccaaatattaactaattggtacgtctgcataagtggagcaatcaaacctaagtacataactggagaaaacaatatacagattaagtatttaatctaaaccaccaggcaatccaaatttgcattgaagatatgtaattaaatggaaagtaacctaatgttctgttactgtgcaagcaggatatccttctaaataagcacaaatttgcaactatccaccagaaaattaggcagtaacagctatccacagaactaacaaatagttgtgtgagacttacccccaatcatacaaagaaattgtgcggatatgccttgcattttcagctaggtcatataaatcaacaacacctctactgcacccaacagcaagaatctgctgatcagaagccacagaagtgcacatcgcgtcatcagtgttcaaccatctctctactctgatgctgctggtttgctttaatcccttcttaccaactgcacaaagtccaatctgacagcccgagtacaaagcaactagcaatcttagcttcactgacaactcaacatgaataatggtggaattccctgtgcagcagggtgcaggacttgcatcagaattttctcgcaaactaggcgggtcaaacaccaaagcatctccgacagtgggagttctgttggatgaacatgcggagcagccaagcttgaagctgtccgagaactgcaaacaaacaatacatggaacatactaagcatagcaagcacagatcaagcaaggagataactatttccccatctcatcaaacaataacatagagaaacagtagcagaatacatttccatgtacctcagcattccaggagatgacctgcaagtgcccattggacagtccaagcagcatactcttgctgtcgcacacgaaattgctcctgcagcatatgatatcacacttgcaaaagttagctcccccgcatgaattcggtatctcgtttttcggataataaagaagcgaagcgaataccatacgttatgaaagcgtcattggcgagaggaaccttctcgacgattatttgcgatatggaggcgaggcagagccccggttgtggcttgcctccgatgatcagcggcttccccgagaactgcagcttgtatatgtacaggtagaaggacgaggtctgcacgtacaaaccactcgatgagtctctgcgcgtagagagcgagcaggagcaaagcggggggagagcagtgtgggggtggctgaccaggacggcgacggtcttggcgtcggggctccagacggagtgggcgttgtcgccgtgggcggcgagggattccggggagcggtcgaggcgggcgaggcggaccttgtggtgggcggcggaccagaggtggagggaggccgggcagacggcgaggaggtagcggccgaggacgcggaggaggaccacgcggtcggagtcccccgggtcgagcgggatcgactgcggccagccatacgccatgtacatctcggcggcggcggcggcggcggcggggtcctcgtcgccgggcgcgcgcctcgccggtgaggttgttgggcgagatgcgcgaggggggaagagatctgggaacgagcaggtgggtgcgcgatgcgggagatgcagcagtttttcttttttactttttccttttcttttctttttcgcttttctttttttaaaaaaaaactgatcagatcagagcgtcacatattgccgtcagattgcttcccgtcgccgagtgaaatgaacaagtttagcgtcccaactgatgaaacgatccagttaagagtttttttttcctttttttctttttccaaccggaactaagctgcttgatctttcagtgaacgtcacgtattgccgtattggtacagtgtaataataataaatgtataatgactggagtacgatagctctatcaattttcagtgccacattttcgaagagtttggtgctgcctttcagctggcagcatttgcgggtattagcaatttagcataggcgatttggtacttttggcagaaagatggatgataaattgacgtaagattacaccaatcttctataccaagatgtaatgacagtaatcacgatgcataaaccacacaacgttagggctttacatagtgctagtatattctgtattggatctagtgccatggagttctataaaaaaagatctcaaaaaaaaatatagtgccatggtgaggcccactagtgatgcttgcagcgacttgtacagcaattgtttttttctgggatgactatatgatctggacttctggagtatgaagaaatgacaccgctcgtatgaaaggacaacgggcataaatgtgacgtagtattactcccagaaaacaattaaaccccacaactaagtactccccagttaaattagctcacctcgcaagtttctttttaaccccatctgagtagtacagaacagaacaaagccagagaggaactcgaactcattgacccacatgatagagtctcctggtgtactgttacatgacaacctggcctagtgccttttagaggttaccaacacgtcttcgcacgatgagcagtgcaacaccgtgcattctaacagagtaacaggcaacacgatcaggccaaggtaaatcacgaaattttaaggcgtcttcaagctacttctcgttcaaagctgccttatttccatttacctgaatcctggccagttttagagcctggcatgctggtcacagtttcaccacaacttcagcggattgacgacgacccgcgacaacttcagaactagaccaaagaattgcatttgcacaggtcgtcaaaacgggacatggcttagtttcaggctgccaacataattgccttgactcctgccaaatgtaacggcgttactcatactgtatggtatggtaaggatttcagcttctttttttttttacggcacggcacaagatgacatgcttccgtcctttttcagcaaaagagatggcacttactgcgcatgagctgcaagctgttgtgaatcagataaaaatgatcattccatatcagaagattcatcctcatcctcatcctcatcttcatcaaggatataaaccaaagcatgccgccgagatgaaaagacacaagccactcctcttgaggctgaaaacaacatccaggaaatgtgaactctggcatcacgtatcatgttaagtgagtagcaacttaaaactcttgtatggaagtaaacactcaaactcaccactgactgccagtggagtggacacggcgtgaggtatgctacgaacttttttcccatagtcggtgtccaactggagctcctgtgcctacattcattgcgttacggaaatgaagatattactttctgacagtaaaagtaaggtcgatttcaacaattatgtgtcatttaatcactacaattgatgagataatatatggccttggtcacgtagtaataagttgtgtttgtgataacacaatgatgaataggagacatgcagtaggttattgccaataccaggttaccgtttaattattagtgtaagaatgctatgaaataaagtggatgccaaaagaataaaagaggaacatttgcaaagatcttaccgacagctcttgtacactgtaaatatttgaagggaacatccttgagagaggcacaaaagagaagttctccatctgcagcattacaatataagaacttccaggaccatcagaatatgacctttcactgagtagtacaacaatctggctgtcctgttttaatataaccatttcttttgtgagctatgagaaataatgtataaaaggtgaattatcgccaagatgcagcagggagtactaccttgtaaagagatacatcaacgcactcatattcatcaggtatatgcaatagaaatcctgaagaagatggtccgctggcagaagagttagagaagtcctttatcacaccaatgcaattcttcaagttcaaggatccatcgggtatcttgaagcatatatagtcagtcaagctatatgaagacccactattctgagaatcttcatcctgctattttgaataatcatttaatattatgataagaatttaacacaaacaatatagataaggtgaagacaagtacaaaacagaaaaataaatatcacttttttattacattatatttgaagtcaactaagagctatgtcatttgctaaagatgagatgggcacccgaaccactcctaggaccatgggtgaagagattaaacatccttccccgagccagcctattgcctattgaagtgttctcatatgttcattttataatgatgctgtagtggaataagcagaagtcaccaaaaaaacatgaaccttatagaatgacactgatgtcagaatacaggttgatgacaagtcaaccgatgacgtgataggataaagaggaagcaattcttggcaatgtatttgtgaagaaatagtggtgaatggcatcgagaaagcctcctccaggctgaaacatatgatagacaaaaattgattacatttaagcaatgagcaatggatttaaaatggctatgtctatataaacagagaacacaaggatttgactgtcaaaactctgattcaactgtttccagataacaaattatgtagaaggagtaaaaaataactctaagataatcaaaaaataaagtagtaaactggaacctttcatccagctcattaaattgcttcattaaagtcttttccaaaaatgggtatctgtaaatccccccaaaactactagctgctcaagatgtcttacagtgtccctgaaaaggcaggtttaacacgattaagaaatgcagaaaaacacaataacacaaagagagaaactaaaatagtgatgaaaaaacacaacataagaacaggcaacagccctttgtaatttaatagcttttgactattttcactgctttggattcagggcacaagaagagtgtacacatcaagatattcaacgactggatttcatgtgaagcaatagtattgttttctttttgaaagcaatacagtacccaacaccaagagataaagtatatatacacaaaaaagactaaaaattatacatttgaaagttatgttcgtgttcggaggtactctcacacataaccatgcacttgtgtaacgtttaaatatactaaacaagttttgacatattatgcacattgcaaggtaacttgtcaacaaggattggtgaattactagcttgcaaacaggtaacatagatatgtgcagaacacaataccaaattgtacataggaaacaataaccaacaatcggcatgtttcattgttacttacaaatcacactcaaatctttgatttgcatcaagtaactgtttgattggatccttatcaagaaggaacttcagaaaaagcaccacgagttcactacaaaaaaaaagtgacacccaggtgattaatgacaaagtgtttgactcacaacttgagcatgaagggaataatagaaggggaaaagacaaaacctgttcgcagctggaacttgatcggttggttcacttaataaaatcttaacacactttaaaacccaactgaagaaattttggaactgaaaagtatatccataaatggaagttactacagaataacccttaaagtcgtagcacaatctataatcataacatcatgtaggaaagaatagagcatggaagcaaatatatcaaacaattatccccctagtaaacatgctcaacatggattaccttggtttgcttgaacttaatcttcagtctaatgatgttgtgcatgtagtttcagaatatgacatcttacctcagcagatactacatgcaccaagatgtcatattctgatactacatcaaaccaacagaatctagagtctagagtacagataataacattgaattcagaaaatgtaattggttgttttaacaatcagtgccaaattagcagacaaatgtgtgtccagtctatattgtctactaatacttcgagcacacaaaaggttctgtgcacttgaccagggaggggaatctcgggcagaaggcctaagttaaaacagaggttgagaattgagaacatggcaagaaaacaagcagagaagaatggtaccagataaagaacagtagccgcaacccttgaaaaacgctcaacttgaacaactagcattcctatcttctcagtcacaccataaataagcttttcatctaacccaacgttctgaaatcgtgagcgccatcttgcaaggcctcttagttccgcaagtctgaatgaaataatttcaactgcaggctgtaataagcaagtcattcagcgttcataacagactagctgatattccttgcttggatctcaaataaatgataccataaattgtagaaataaaactactcactcaaaatatgatagtaccatgtgtagcagaaaaagaaaaatatgaaattgcctagtttacaaagtacaaactctagaatacccattacccaaagcaacacaaaaaaaaaaggtagagactgtgacatcagctggaagtggctaacctgaagatgctcactgacaacaacacgaagttctcgtccagcactatcaacagccttagctattctcttgagagcctatccacataggaaacgacaagtttagacaggttctctcaaaaaaaaaaagagaagaggatagggaagaagtttttatggaagcgagaaataccgcttcaccaagtgagctgactaaaaattggtgaagtgctggacttgtacgtgtaccaaacaaaaggctcataaactcatcctcagagctagattccatccctgtattcaccaacagagacagaataaagggggcagacttcttgaggtgatggttatgacttgaaaatcgatcataccatgggcagctatcagagaaggcaaggcgctgaatttttcattaaataagttcatggcacttgaccattgtttggccatcatggatagggaagaacggacaacttcaaccagatcttgaatacttgatgcttgttgggagatctgatgtagctcatttttccttcacagcattgatgatacacaaacagattaaaaaaatttagtaggtaaagcactaaagtgatattaatatccttgcaaacctagtaaataaacacaggtgctatgtttttgaggaatcaaacaagaaagatgtttgcacctagctataaaacagaatgatggttctatgactaggtgagcttatcaaaattagtcatttcaggtgtcaatgagtgtgttgctctagcacttcatgtggaaatctccatcatgttttgaagttaccataaaacaccatgcaacaagataatggtttcttaacaacaacagaaagtagtcacaggcaatcaaactatcatgacattacctgttgaaaaagatagaagtgtccaaatgcagacaatgtaacccagtagaaatgtgattactatgagaaaggttgt

SEQ ID NO: 47001 - DNA, 26184 bp, Oryza sativa
ccacagtatcttttagtcattcttccaaaacgatatatttctaagaactctgcagctaagcaaaatcctcttctaacttaagaaatacaaattggggataaccctgggtgttcgcattaaattaatgcaaccggctttctggcagcttaggggttgggaaattttcactatgacactaactaagcgatagccttcagaatcaaaatgaagagtacctgttaacattctattgaattcaaattagaggagcactcaggtgttgtatctacttactatctttccaactgggaatattccaaagatactgaagcaaatgcaaccacctttatcaccactgcacagaatattaaaacgctggcaggaagcgcttgaaaattcctgaatggattcttcattctcatctgaaagaccagtgtctccagaactcagcccaccgatcctaggaatcacaggagcgggaggaaagaagcgtgcagtgcggtcttcataggataacaggccatccttgtcggtctgcggtcattagcaaagaattgtgatagtgaacttttacagtgaaaccctagactaagagtattgtaaaagtgaatgaattcatcatttgtcgctttatgtattgctgaataatgctttaaattgaatgatgtactctataactataatagtatgatgagacacatttttatttatacatcattacattatatatagagaaatagttggtgtttccaaaagatggaaaaggcaatggtatacccttgatagaagctcatcttctgcccagttcaaacatacaatggcaacatcatgggattttattcttcttagcattttcccattctgcaatcagcaccttcacttaaacatgcacaatgaggtaaagtgaaataaaagtaacaagtggacagaatcacaacataaaattggttctacaaacaaaacatttgataatgaccattcaattacaaaggaattgctataggttgaatgtattaaaaaatggtgctcaacaggaaaggaagtaattggaaatgttctttgtgtctagttcgagtgtcatttataaatctctaccaaagtaccaatagctccttggaactatttctcacaatggtccctacacagttcaaccaatctgctcataaaagctggtgagggtgaagatcaagatcaagagaaaataagcaggggatcaggtttgtatgatatatgagtaaatgtccaaatccaacacaaaacaaaaagggatcaacaagatttgaacatccatttcattaatatacacacctcaacatcatgcaaaagaaccaaaccatcttcggtaccaagtgctactattttaccatcggggctccaacaaatagatgtgatgcacttccctgaaaaataagcaagattttagtatagcgccaacatgattgtattgaaaatataagcatgatgggtgcagttagatagttcataaaatatgtgcttatatctagttctgtttcgtcagaagcagtatgtccagaaaatgctgtcagccaaaaaaaaaatgtaacaaacaaaagtagctgcaagggtggggcaatagcaagtggctacctggggagatagtccatagcctttgccaattgaatcgatgaaggacaaccttagagtcatcagtaaccatagcaagtagatccttctctggattccactctgccatttttatctgcaaatagtgactaacggattatgacagcatgaattaagaaatgacaacaaaatatcaaagggaatacagattccacttacactaaatctgaaaacagaaatacacatggaataaatggaaaatgaaattcagcaggaatatgaaatatgacaggttaattttgaattcactaatcaccatttcttgtgtgtcactactctttttttgaaaccgagacagcaaagctggtgttatgttaacaaagccatgcattgataagataaaaatagaaattgccagatcaaccgatcaagtatgacgacagaggtgtgaaatgcaaaacctgaaaccaaactcatcaacaagagctaatcgacaagctggtgtttaactgtttatagctccctatcagtacagaaaacataaaatggactgtttccattcaaagcagatgtcaaatgtatcctatacttggagaagcatacaaaagggtctcacagttttgcaaaatgggatgatatggagggtgggaaatggatcgaagattaacatctgggcggatccttggataccgaggggctggtcaaggaaacctataacacccagaggcgctaatctcgtgacaaaagtggaggaactgattgacccttatactggaacttgggatgataatatgctgtcacaaactttctgggaagaggatgtcgcagctatcaaatccattcctgtgcatgttgaaatggaggatgttttggcgtggcactttgatgcgagaggatgtttctcggtcaaatcagcttacaaggtgcaaagggagatggagagaagagctagcagaaacggatgccctggggtctcaaatggggagagtggggatgatgatttttggaagaagctttggaaactgggtgttccgggaaagatcaaacacttcttgtggagaatgtgccacaacacgttggcgttgcgagccaacctgcatcaccgagggatggatgtcgataccagatgtgtgatgtgtggccagtataatgaagatgcgggacatcttttgttcaagtgcaagccagtgaagaaggtatggcaagctttaaatctagaagagttgagaaccaggctagagtagcaaacctcaggaaagaatgtgttacaatcaatttgctgccgcccggaaaatgaacgaacaagtgccatagtttgcctttggcagtggtggaaagagaggaatgaagtaagagaaggaggaacaccaagaagcccagctaagctctcacacccgatcatgtcacgagctggagaattcgtcaggatgaacgcaaaggacaaaaatcccagaacaggagagtgtgcagtttggagatggccacctctgaactttgtgaaaatcaatactgacggaacgtacagaggtaacacaaagcagggaggatggggctttgtgatcagggatcgggctggctcaatccttcaggcaggagctggtccggcagctcatctacaagacgccttccatgctgaagttatcgcctgtgctgctgcaatcaaggctgcaagcgaaaggggtatgtccagaattgagctagaaacagactcaatgatgcttcggaatgcgatccaggataattcctttaacctatcatctctaggtggagtgattcttgagattaaacatgtaattttgagctgttttcattccttctctgttagctactcgcccaggagttgtaataaggtagcgcatgagctagccgcgtatggttgtaatctccagaccgtgtcttcctgggcaggctgcccgcctggtctggaacggctggtatccagcgattcagatggtttggtaatataaatctctcggtttctctcaaaaaaacaatgtgagagattagctgaacatatcgcccacccaaaaccagttacaacgctctcaatcacacgcactgatggtactatgaaccgatctaaccctgctaggaatttcaacaaacggttggcacgcaggtaaagggggctgcaacccctggacccgccccgcccacccgtgctctaccacgaagtaagcaagcaagcatgctctgctaggatcaactcgtaagcgcattaatcagtagcttctcgacacagaccggctcgattggacaagcaacaaaacgaactcggtatttggcaggtcagacgacgagcgattcagaggaggaaccagagacgatacctggaaggggatgggcttgtcgaactggagctggaacggcgtggccgccgcccccgccgtcgacgcctcctccatctgctcttccgccatgctcggtgtcaatcagggaggtcgggatttgggggagaacttttttgagcgggcaggcgggaatgaggagcagacggcggcagcggcggcgtgtgacgcatagggaagaagagcttcccaatttaggccccggtacacgtggcccatcactcaaaaaggcccgtctcgctggattgggccactctatgggcctcaccaccaaacggcgagaagtgcaaggcccatttgagagctttgcaacgaaagggaagcgttgcactgattgtctgaacggctcactgacgacagtccatagcacgtctgaatgacctcctatataaaataacctctattatagtagggttaatagggcttaatagttcgcgtgatatagattactggaaataagatgggaaatgtaggtgcaaaaatcaccttttacaatcctataggtagctatacttagggcaaatttgaatcgcagagattgctatattttgcgggagtacgtgagttctagcttgtcaaatctgattcagctttccacttcgaagaaagcaaactgcaactaagaaaactgagggaataacagtggttgtgactcagaaatgcgagcaaatgatacgaagaagatagatgctgtgaaacatgacaaatcaagcttacaagttccaaccctgactccatcataagtccatatgacataatataatagaagtggtgcatacattcgacatcaaaactacggagaacttccaggggttctcagggaacagcagttcaacttgcaaactcaacatgaatacggctcctttcaagacattttcagccagaagtaaaatctaagagagataagcaacatcctccacacttcaagagtctgcattggatgagaaactgttattaatttatcaaacaaaagacagcagcaatttggaaattgcacagccatttatgcttcacaatatatgcacaaaaattacaattagagaaacaacaaacagtactagaatgtttcagtaggatgccaaactgatagtttaacaaaaagacactctgttggtaaatcaaatactcggttctttatactaaataggatatgaagacgcgattgcattaagataaatttagcatgcaaccttgtgacaaacatggctgggaaacttttttacattgtaagtaaatgtgataaaaattcctcagatgtcaatcatttgtgtacataacgattacactacaaggacccaatataatgccaatttagtatctgcagttcaatagccataacaagttccactgacataataaagcctcttccaggtaactcctatgttatggacttactgttagatcaaaatattcagctttcaagctattcatattggaatggatttcaaagaaaccaggaaagcatcatggcacagaccatttacatgcccctctgaaccctcaaaagtagtggaagcatggtttatgacaatatgaaaataatgaagtgaattgagcaggtttgattgcaaatgtcaattcacaagcccagttaatcttcgcacacaattgccaaatgcaagaagttttaaaggatgtccaaaaacaaaatggctattcctcagtcagggactcagggatcaggcgtacaaccacatttgacatgctgcgaaaacagaatttcgtgcgtacaatgttcaattgtaatagtattacattatcaccctagcacagaaggcttgatggaaaaatctactgcatttctccatcgcccgtgcgataacatgttcaagcatgcaaagtaacactcactaagcatcctaccatggtcttaacaagcaactcaagatataataacaatccatacatgatatgttcgataaagaattgagcgatcatcataacagcagagtcgttcatcaatcatggctaattgcacaaatggagcgactgtttaatggtcattcttcaactgatgcttggagaaacaagcctaatctataacccgcaaacagctaactgaacaggatacaatccgcactaacctttagatgctgctcgggtacatgaagactctgaccttgcgcccctgcaacgatgcaaacatagcagaaaaatcagcacaagctcataaacaagaacaagaatcgcatagaatgggagcaacgcaccatggaagcggggggcaggttggacttgaacttggcgcggacgacgccggagttgccatgggggcgggtgaccttgccccagatgcagcggtagttcgtgccgccgctcttggtcttggccttgtacacgtacgccatcctcttcccgcagtaccacgccacctcctccttggtgttcaccccctcgatctgcaccagcgacgtgttctcgtactggttcgacttcgacctgcccaaattccaccaatcaaaatcgcggcgacagaatggaacacatacacacgcacacaaccctcggttgccggagacggcgagctcgcccctcacctcttgtatccgaggatggtgccgcggacgtagagccgcacgcgctgcccggtgcgtcccttcaccatctcgtcgtcgccgccgcttctgccgccggagagagactgggagctcgcggaggtgggggtttcggaggcgcggccacgaggggaagaagaaaccctagccagcggcgctggtagctcttatgtacccgtcagtagcagaaatgaacggcggcgatcttccggtgcagatttttctacggctgtgatttatccgagaggatcgtgtgttttggtgcgtcgtaggcctcattcccgtttcatagtgggccaatttgttggaaagcccatccaaataacctgaaattgaatggaataagtccattttacctcccttatctcttgcacatgtgtgaataacatccctcaaccggaaaaccgggtataacgcctccttcttctctgaaaaccaaagcaaatcatctccctcagtggtttcggaggcgtttttgtcctacgtggcagctgaatcagcttgtgggtctcacttgtcagcgactctcctctttctgttatcttttccatcccctgtggcagctggagacgagcgccgaatggaggacgccgcccgggggatctagcggcgtcatcccgtcggaactctactgcaagatttgtaggaacgtgatggccgacgcggtgctggcgagcaagtgctgcttcaacagcttctgcgacaggtgcatctaggaccacatcgccgccaagtccaagtgcgcgtgcggggcccaggcgcgcgccaacgacctgatccccaacccgacgctccgcaccactatcgccaacgttctcgccatcaccggcggcgcagcgagcgcttcaagtggaactgagaagccgaggagctccgtcggcagcaacgcggcagaggtggcgccgcagagcccggccgcttcgcaggcgagccacagcaacgtgtcttctaagaagagcgccacaatctcatcaggtgtcctcgaaccaagaaaggcgcgggagacagtggcgggcgaccaatccgcagaatatggagccctcgccgtcgacggcgatcaccacggcagctacggcttcccgttcggcctggcgccaggctacgtcgaccccttcttcggcgtcggcgtgccattcggagccgatccttacatgtactacgacggcgcaccttacggctagggtggtgctgcttacggctactacggcggcaaggatcaccgtgacatgaagaggacgtgcctgcgatgatcgcacgtcatcggccaattgttgcctgttgcccaacgcaagattggatggcgacactgccggtcgctgtcggcacagcgagaagagcgccgaatgttggatggaggacgtcggagcgtgggaaggtcgtggtggcggcgttctggctccgtccgcgtcagaccagcgacgcgtggtcgacaacccctgtgttgcatcctcccatgccaactttgcatgtctgtcggcgtccatcttcgccaggatgctggggagggagaagaagaggtggcggcgaggccgaggaggcgaggatagggatgaggtggcggaggaggggcgtgggaggggaggcagtagctcccgccgcccccgcggtttcgccgcccgtcactcctgccgctcccgccgcctcgccactccgtcgagctcccgccgccccgccattccgccgaccttccgccgccccgtcgctcccaccgagctcatgccgcctcgccactccgccaaagtcccgccgctccgccgagctcccaccgccccgtcgctcctgccgcccccgccgagctcccgctgccccgccgctccaccactccaccaagcacccgccgagctagctctctccatctcgcttgccgtgaggataaagaggaaggggaaatgtaactgacgcgtgggcccaatattttatttttattgttttactcactaacatgtgggtcccatttacatttatttttattttagtgccacgtaagcgccacgtcgatgccttatggaagtcaacccgccatgtaagtgccacgtaggacaaaaccgcctccgaaaccgccgaaggagttgatttgctctggttttcagagaagaaggaggcgttatacccggttttctggttgagggatgttattcacgcaagcgcaagagatgaggaaggcaaaatggacttattccaaattgaattgttcttttgggctgagagtggcccgaggggaatgtatgcactgcacatatcatacacgataactaacaaatgtcaccaaaaattctgaaaaaaaaagtgtacataaattttcaataatagtcttgtcttcgttcttttaactcttgtcgaacttgccggattatcctctgtacgataaggatagcttgatagctatagaggatccatgtcagcacagttcccacacagagagtgtgagaaaggaagagagtgtaattagtcgtagatttataatcagctatagcacatgaaagaagtgactagcctaagagaattataacatacagttatatatcgtgtataagttcaattatgctcttaattacgtagaggttttcaaacaaatcaatggcatgtttggagagattaagattttaataagcagctagtgagaagctaactgataataacatacagaagctatgaaaaccagcttttggcttctaatctgttttctatattctataactacatattctaaaaatctaggtaaaaaatctagattgtttgaaaagcttctagtagaaaaaaaaaaggtgcagctgacaaaaactcgccaaaaagaccccaagtggcaacacgcaaaacctgggcttccttcacagggccggcccttgcgcgggggggggggggggagcggtgccactgccaccgatctgggcccccagatcgcaggggcccccacacacctccctcccgcgtccctggcccgcagatcgagcgcatgcatgtgcggaagccggaaagcgaagcgccccgcggcgaaaagaaaacagaaacgcgcgtgattgccgccgcccacatcccctcttgtcctcttcacgcgcacgcgcttagcgatcggtgaccgggcgatagcgatttggcgaaaagccaaaaatcgaaactgcatcgcgtgtcgccagcggccggcgccgacgtaattcactccatggcaatcacagctgctcggcactgacgcaatctccctggttgctgctgccagctgctcagtgacgacgcaatctactgcgtcgctgctactcggcatctcctagcctccatcgcctgccttccctcggcaaggttagcaatcagcacaccaatacaccatctccgtagcccaattattaatttaattactgctgtccaatctctcgatatcaaaacataaacatatgtaggccatcccgacgcacggcgtcacgggcattagcgcttaattgtttgtttccgttcactcgatcgaatcgtcctcatgccctaagcatcgcatttagacgcttgcgatcaactaattggtaaaattttaaatttatatttgtaattttgtagtgtaacttatatgagttaaactatcataatagtgttaattcttttaattatcaagccatgtcatcaataacttcacatctagttgattattattttgtagtagtatgttaaggacccctacatttagttttgcaccggggcctgaaaactcaggatcgccctgttccttcacttcatatttctgcacgttcatccactttgccagtgccatctataaaagactaacagtcttaagagtttagtatataaaataccaaatcaagaccaggattgcccaataggtcggccgattctggtcaattattgattgatcgcagtatattttacagagcttagatctaaatcatttccgatctacgctatcttcgaggcaggggagttaatgctggcaattaaaagtagttaacgacccgtagatcatcagtacgtagactcgaattgtgaatgtaaaattaagcaagatcacttccatatatgagtgcacgcggccttggagctttccggaccaagaagttttaaaatcgtagcaaaagttacaagtgtcttcaccgggatcgatcgactgatcgagcatatatataataacagttctaaagtaaacgttcgattaattagtttactcacataattaaacaagtggcagttgttcatctaaattttggcaacaacttggcaagttaacgatgcactagcgacaaattaaatcagccagatgccagatcgagtgtgggagcatcggcagtctacttaaggactgacaaaagcacgaagcaacgtacttagcgttaagctagcgcaaagtgcacctcactaattaagctagcaacaatggcggcgaacttctctgcctgcctcgtccccgtcgccgtcctcgcgctcttctacctggtcatcttccccaacgacttgagccagctcaagtcggcgcttgccccatgcgacgccgccagcaagagcgtcgcggcggcggcggcggcggacgacgacgtcgacttccgcatgttcttcggcatcctcacccgccccgacttctacgagcggcgcgcgctgctccgcatggcgtacgcgctccagccgccgccgcggcgcgccgccatcgacgtccgcttcgtgatgtgcagcctggacaaggaggaggacgccgtgctggtggcgatggagatcatcacccacggcgacatcctcgtgctcaactgcaccgagaacatgaacgacggcaagacgtacgactacttctcggccctcccgcgcctgttccccgccggcgccgagccgcgctacgacttcgccggcaagatcgacgacgacacgtactaccgcctgggcgcgctcgccgacacgctgcgccgcaagccgcgccgcgacatgtaccacgggttcctgaacccgtgccacatcgacccggcgtggcagtacatgtccgggatggggtacatcgtgtcgtgggacgtggcggagtggatcgcggcgtcgccggagctgcggggccgggagatcgggtacgaggacgacgtgttcggccggtggttgcgcggggcaggcaaggggaagaacaggttcggcgaggagccgcggatgtacgactacctggacagggagatgtacggcgccgacgtcaactgcttccgccacgagctcatcgccgacacggtggccgtgcacaagctcaaggaccgcctcaagtgggcgcgcacgctccgcttcttcaacgccaccgatgggctcaagccttccaagatgtaccatgtagatctcacacctaggatctaagatctttagctgctttttcacggtgattaatttaattagctagtttttttagataatggaatatatttccagactttattcaacaagctacaaccaattattataccaaatcgcttaaaagcgtaattagctagttttttatagtttagtttttgcaagcatggctgcatacatgcttgcacttcttgcatgaaaaatgtagagaatggtcatacaaatggaagagagattcatctagcaccccttctttgaaattgctagtaaactttcgcaagttttttttctcttttatatcgacttttttataggggcgcgcgaaatcttgagtaacagtatagccgattcgattaagtgtttgggcaagtacaatgaggattaatcaacctactattagcccgtccaggtcatcacaatctgagctggagaaggacagagaaaggaagagagagaagaaagcgggtgcttgtttaatcgacagctcggcatgagcaacaagatggatggagtaggcgtggagacgatgcaggagccgatgccgtcgacaaagaacatgctttcttggccttttgcatcccatgctccatggctcatcccttctctgtatatttggcggtaaatccccatccgcgggaaaaaaatcgcactttacacgccaaattagttagtcgaagcgtcaaattcctactgaaataccccatccagttagtaatccctcaactcaatctgctgaaacaatgggtcgctcgaaacgagaggttgcgccaccgccgccgccatctccgtcgcaagcctcgccgggatccttcgcatctggcatgatgttgccgggatccttaggcagtggtgcctggcaaggttcggcgccaccgcagccgccgctccctttgctctacgcgtacgacgccgctgcttctgcttttcccatggcccaaatgaagcaaggattggatcatagtgccattgaattgtcagatctgcaagaacggtatgtacttttgatattgaatggttttggattgatgtgctccggaagttccgtgtacctccatgttgattagaaaattaatggtgttgactagctaagtttgattcttgccgtattctagttttccccttacgatctgatctgctgctagcagattagcatatcccctgctaatatgtcaaaagaatcaacgtgtacatctgtttctcatactaaagttaagtcttgctatattcagaaagggaaaaaaattgtggcaagagaataacttgatagtaagcaagggctacagatacatatagatttattttatagcaaaaactagtgtacataggtcagtgcatggccaaactttttgtactaatctacacatacactttgaataatcaagaactcttactacataggtagtgaacagacaaatcaacttatctacaaacacaaaaatagtaactttatatggcatgagaattattagtatcataggctgtgctttgtcaaattttaatgtactcatttacagatgaagagaaaaaagtgctaaggatgttatatggcaataattttggatctttgtctttttcttgcagtggtatggactttcatccgcctggtggtttcttaagttacttttaggatcaatcaattttacagaatcatcgaccttttgtgcctccaaattattatcctgctgaacaagtagcaccatgttcaaaattacgtacaggagcacaacaacctgtcaacattgatagtggtgatgaagaagcccccactgttaggactgagaagcggttgacatggtcaacagaggaggacataagactagtaagtaaataaggatgtaggcaatgaatcgtgttttctcattgactgttactttatttctagtataggactaatcatgttttgttttgattataggtgagtgcttggctaaacaactcgaatgattcgatcagtggtaattttaagaaaaatgatcgttattggggagatgttactgctgagtataatagcaccactcccaaaaacaggacaaggcaagaaaaacaaatcaaagaccgttttcataaaattaagaaaaatgttggtcgtttctgttgtgtttataaagaggttaaatccatatatgttagtggacaaaatgatatgcaactcagggaaaaggctgaagcaacatatcaagcagattacaaggaaggcccattttcatttctgcattgttggaacattcttcgtgaccaaccaaagtggcatgcttacttggaggaacttgagaagccaaacaaaccaaagatggatgatgaagtggaagtgatggagcaaatgtccactcctaacagtcctgaagatattaaacgtccaataggaacaaaaactgctaaggcgcaacgtaatggtaaaggcaaacgcaaaaggaaggcaaaggtttatctatcagatactgatgatgaaattgacaagcttaaagaagttcaggagatggcaaataaaggtcgtgatgaactactagagactcagaggcgtgttgctagtgataaccttgaatcaaaaaagttagcgcaccttgcagccatggagcacaaggaggctgttatgttggaaacatatcagtctctcatgttacaaaatacaaaagatatgcctgatgatgttagatccgagcatttgatggcattgaagtgtatgagggagaagttgtttccgtaatactaaggtatcttcactttccagtctctaattaaagcttgttgtattttttttacttgctgcaattgaacttcctgcaaacatatatatgtttcttgcacaattcaaagagttgcaaatattgatgtaatctaacttgtaatatagtcagcatgtagctattatttccagaaaaacatgtagtcaagtcagcagttgcaaaattaacatgcagtcaaatcaacaatgtgcagataaacatgcagtcttgaattctcaatagtctagttaatagtaatccaaatgaacatgctctgtgtatgcattcccaataatctaattaagggtaattcaaataaacatgctactagctagtatgcattcccaacagtatatatatatatatatatatatattggtctaatggtgctaactatccatccctctgtcattcctttcaacacttctttcccattccttgcaccccttgtctccaccatgtctccagatgattctggtgaattagatccttccaaaattatagaccaatacattgttgagcagaacctcatagattcttttgcaagaagggtcatggaaaagatcaagaccaagcttagaattggaaaaatcagaaggaagagtgcgacaaggaagacaatcaagagggatcacacagcagcacatcatcgtctcatagctgactacttcagtgaagaccctctttaccttgagagcatgttctgtacaagatttcgtatgggaagacccatttttcttcgcatagtgagtgcccttggaaggtgtctccttactttacactaaaggtagattgcagtggtcgccaagggctctcacctttacagaagtgcacagctgcaatgcgcatgctagcgtatggcagccctgctgatagcctagatgagtaccttaagattggcaagagcacgtccttgcagtgcttggatatgttcgcacgaggggtgattgaggtatttggttcagagtatttgcgacgtcccacatatgaggatgtggagcgtatgcttcaagttaatgagtctaggggctttcctgggatgctaggcagtattgattgcatgcattggaggtgggaaaaatgcccaacaacatggagagggcagtttacccgcggtgactatggagtgccaacaattatcctcgaagcggttgctactcgtgacctccgcatatggcatgctttcttcggtgtcgcggggtcaaataatgacatcaatgtgctgaaccaatccctactatttcttgatgtgctgaaaggggaagctcctagagtaaagtttttgtcaatggtaatgagtataacataggatactaccttgctgatggaatatatctagaatgggctacctttgtgaagtcaatagctgctccacaaacagagaataacaagctatatgcacagtatcaagaaggggcaaaaaaagacgtggagtgtgcatttggggtcctgagtcccgtttcaatattgtgcgccgcccagcacggtcgtggaaacggaagagtgttgggagaatcatgaaagcttgtattattctccataatatgatagttgaaaatgagagggggggttaaaattcctattgatctgaatgtggaccctggagcatcggttgctcttcctcctgaagtaactactgggcacaatccatgctttgatcaggtgctgcgtaggaaagctgcaatacgtgctcgtgcaccacattcccaactaaaaaaagatctggttgaacatatttggcaaaagtttagcaatacccatcgtacttagttgtggtaggacattaagcatcttgttttcacattttcaattacaattgcaagcatcttaattcatttatcatttttatttatttatttcagggacaatggaaaactttggtgctagctttttggtgctttctgctatggttttgggaggtatgtacatgtctacttgcactgtacagtccaaagaacaacataatcaaataagtcctttaatagtccttttgtttctacttaaaatagtagtactacttccttctagttgttttgccatccagattatatgctacaattgttctataatcatcagcctcctattttctatggaaataatgttgctttaatgacaggtagtgaagatgctcaatttggtaggctggcagcttgttttggttctgcttgagaaagataatctagttataaagtaatttttagtaattcgctggtgtcatgtaagaacacttgtgttgttaccatctattggcagtatggatcgttgtaatggcctaatttcttttgtcgaatgttgatgtatggatcattgcaacagactaagttattttgtcggtctatgaattagttatttgtcaatctgtgaacattctttcgatcaagtaacaatctgaatcactattgtactgtttagttcgaatgaattagttcgaatgaattatgaatattacaccattgttgttgataaatccgtctgctttgtgataaatcatatgatttatttttttattgattgaacatagtcttccgtctatggttgacatataagtggctactcaagtgatgtttacagttgatcctacgtaacttgaaagatacaattagagaattaaatgcagcttgctttgctagagacggcttagagacagcatgtactatcttattgtaaatatcgtctgttaaaccatctatagatgatgtggaggatactaatagtaatagtaagatgtttactctattattgcccttgcccttacaaaaagtatttgacatggtccctcagctcactccatccgatgatagtccgatcagtgtcttggatcaagaaagacggaggattgtcaatgtcaacgccgtatcgccgtcaaaaaatgctcgcctcacgtgttctgaacttggtaagccttcatggtccgaatttgggcagttggtagcatggccttatgggccctttagatgactaacacgggttaggatttccttcaaacttagcactacatgggccacaaaattctacgagaagatgggacttgtgactttgagtgcatcattgcagattgcttgtacaatcagtctactttatgtttacatgaactccaatttcaaacttgtacttagtttagaacggactaattattggcccaccaaattttgtcctaggccggtgatattgatcagtggagaaatcactgcaaatttcagaaatgtgccgcacgtatcaaggaccttaagctacaaagttctcccatatcctcattccttttttttctcatggaagaagctaatcaatcgtacaacgaaccacgatgtgacaagctaaaaactatcgacatgatcataatctataagaaaaaaggtttatttcagacaaggccatgatcgataccgtagagtgcaactatatcttctgtccaaaaaaaaaaaattccaaaccgccgagatttttttttggttgacagggagtaaaacactccaggtcatccataggaactttccttgataatagataaaaggcataattctggcattgtagaaagtcgatatgtataaccaaaagccctccaaaacaattgaaggattagctagcttgctccgtaacttaacagcaagagagcaacacaattcaatagcatctagtagaatctaattcaaccagttgcccacaagtaaataaaaggttaaaaactgaagctacattcagaaaaatcagcgggcttgtccgtcctcagttcctcgtctcttccgatctacgcaatgttttgcatggacttccctaaagctcccccagaaagtatgcgtacgatcaaaacagttgaccaacgagacatttccttcggaggagtcagaggatacagcctacctgcatatgcatgttggtcattgttaatctcgatatgcatgcatttctataatttccttgctaaaaacagaaaaatcatactgcccatggaaatttgtaatgcctctttttctcacatttgtgtgtacatcaaggtatgtctacaactttggtaccctcttggatataagaaaatggactcgattgcttggcatctattggtgcatgttcgcagggcatggctgaccttgaactagaccttcgaacactgccttcttatattaagccattttaagtgcagtgaagagcttagcatcgcaaggtaattagccgtaatttgcaggattgattgggcgattatgatggccatgaagaagtcgttttctctactgtttttcctacctttccttctcctcgccatcatctacttcgttatcttccccaacgaattcaggctccaatcctcgctcgcggcgtgcggcgacagcgcgccggcgacggcggccgacgcggtggcgaaggcggccccggacatccgcgtgctcctcggcgtgctcacccgcgccgacaagtacgagcggcgcgcgctggtccgcctcgcctacgcgctccagccggcgcccgcccgcgccgtggtccacgtccggttcgtcgtgtgcaacctcaccgccgaggaggacgcggcgctggtggggctggagatcgccgcgtacggcgacatcatcgtgctcgactgcacggagaacatggacaacggcaagacgtacacctacttctcggccgtcccgcggctgttcgccggcgagccctacgactacgtcggcaagacggacgacgacacctactaccgcctgggcgcgctcgccgacgcgctccgggacaagccgcggcgcgacgcgtactacgggttcctgacgccgtgccacgccgacccgaggacgcagtacatgtccggcatggggtacgtcgtgtcgtgggacgtggcggcgtgggtggcggcgacgccggagctccagaacgacctgaaggggccggaggacaagctgttcggccgttggctgcggtggggtggcagggggaggaacgtgttcggcgcggagccgcggatgtacgactacctcgacggcgggatgcggcacgggccgacgtgcttccgccacctgctccaggcggacacggtcgccgtccacaagctcaaggacaacctgaaatgggcgcgaacgctcaacttcttcaacgccaccgagggccacaaggcttccccgctgttccatgtggaccactaagacttgtgattctttcaaattcatttctttttgttaggcaacgaattttcacagatttaattactaacttgttcagctctccaagagcaagttcaatggtagcaactgcctataactattgccacatcatttacagctaaatttattagcctaatacaataatttgctgtatatacatagagatgaagaaagtctcgtatacatatttagggtaattttattagtcttgataaaatatcggaagatatcacattttctaatataaaatttgataccttcaggtactgaagtgtcttgaggtatcaatttttttaatgtaaaatttagttacctcaagatattttttaagtaccgtaaaatttctcacatattagaccattaatgactctatggctcatatctttctctcataaagtttgtcatagcctatatgcagttgctacaaaatatacaactcacttcccttttctctcctccaagtcagcatgaattaaatataacaagtttatagcatgtgttatattatcttattacttattctaacctttctttagtgttttgttctgaagttatatttgttaaaatctttcaaactaaaaggcacaaatgtgtggtcgactcaaagaaacatacaaaatctgagctgaatcaatcgagcctgaattggcagtcagatcagtgacgcggaggcactactataaaaatggtttttcaggcggccaaaaataaacttttcaggtggaggaacgatccgcctgcatgccaatgatgattttcgcaggcggcccagtcacccgcttgttaaaatcatctcgacgaaaaaaaaaaaccaccgccacccccacccatgtccctacccacctccgccgccgaccccgccgcctcactgttgccgccgtcaaccccgccgcctcgccgttgccgccaccgacctcgcacctcgccgccgctgacccggcgcctcgccgtcgccggtttccgccgcccccgtcgtctgtcgttgagggatctgagggataggagaacaggagaggtgaggaagaggagagctgtgatacttagaaaaaattgatgtgttgtggtgtctatttatatccatgtcaattttcgcaggtggaccacttaagcggtccgcctgcaaaaataataaagggtatttttgtaggcatgccgcttaagcggtcacaacgagtttcaaccgggtttgtatttttgtaggtggccatttggctccaatgatcatatccgtttgcgaaaaaaataccccacgtctgtaaaaatgtttttttttctagtagtgaggatgatatcggagagtccgagtggtcgccatggtcttggaaacacggaatcagtttagcgtggagagccggagtcatcaactgctgagaggaggatgcacgggcggcgatgcgcttgatcgatgaagtgaaggtgcattttaatttgatgacgtcaaccattttaatcaccatggcgagtatatttgttcggatttatctcgaattcagcatatgtatagatagataaacaccggtggagaaaccatcttttgtcggtcggccgatttccacaatagtcccggatgcaataaaaaccggggctaaagatgatctttagtcccggttcaaaagggaaacgggtatatttgatctttagtcccggtttgtgttaccaaccgggactaaagatcatctttagtcccggttcgaatgttgtcaggacctgtcaggcccccccgggatctttagtcccggttggtatcttaactttagtcccggttgatattaccaaccgggactaaagatcccggtgatctttagccccggttggtgctaccaaccgggattaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattatatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcctataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaagaggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacagtaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacaaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaataatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctatacgagagctcaagacatgaagagcacgaaccaaaacagcgttgttcgtgttgatgccatgggacacgatggaacaactgccatgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagtctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacatgatgtaaactattttggatgtattgattatccatataaatcaactgatgtatggcatatgttaattacgcacgattattagaggtttcaacaagtttaaatcatgtatatgctagttatatgtgatacttacaatttttaaaagttttaaatcacataggtggcaatttcatatgtatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacctaatttattacagccaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccggaagtacatat

SEQ ID NO: 47002 - DNA, 13408 bp, Oryza sativa
gagaaagagaacgatcgaacgaacgagagcgagaacgagaacgatcgaacgaagacaagcgagaacgagggaacgaacgtgaatgagaacgagcgaacgaacgtgaacgagttagggaacgtgaaagagcaaacgaacgaggacgatcgttaacgtgaaatgcaatatatatatatatatatgtatatatataggacactcatatggggcaccatggtgcccgggcaccatggtatcaaatacacaatgtatatatatatatatatatatatatatatatatatatatatatatgtatatatatatatatatgtatatatatatatatatgttacttcgcatttatcctaatacatttttttgtatcttgcagaaaagacgtgttgtcggagtcatccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaatgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagtgagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcgacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggttttaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatagccatcccaacggaccctttaggtacttaccactgcaggccgattccagcaggatactccaaggtcgaagttgagttggtcgaaggcgcgtacgagtacctcgagctggattaccctacaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccaccgcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggtgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgttcatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaagtcttgttatgttaattgctactacgaatcatagctttaaactccatgtagggcttggtatcggttccgtcatttggtccgcggcaaatggagagaaagacttaggcggaagtttaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattctcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatatatatatatatatatacatatatatatgtatgcatatatatgtattgaaacatatatatgcatggtttatatatatatatatatatatatatatatatatatatatatatatatatatatatatatataaatataaaccatgcagcaacaggggcatgcaaaaaaaaaaaggtcagctcgatctttagtcccggttggtgttaccaaccgggactaaagatcgatctttactcccggttatttcacccgggactaaagatagcgatctttagtcccggattggtactcccggtttgaaaaccgggactaaaggggggttacgaaccgggactacaaagggtttctccaccagtgaaactagaaaaactaaaacataatcccaacctatatacgtggatggattgggattaggacctaaccagaggcacgatggaggtgtgagttcagtaaatgccaatgaaagcacattttttgctcagatatactctctccgttttataaagagtacttttatcctttttttattttaattactgccaggacttttgtcttgtagtgcaattttcattaaatggaaaaatataatcacagagagagcactgttagatttataaatagtactttaagatatccaaccattagtacttcattattcttcccgttttctctttgtattaatgaagggcatgttagtgccgattgctcgatctgctttaactttcaaaaacaacacttcttttatggagggagtaatcatctactcatgttgctgaaagctgaaagctgaaagtgtgagctcactaatcccattcctctaaaattttttaactatattggttggcctttctcagacaagagaattcttataattctctctatacagtacattgaacgtagtatatttttctgcattttgtttggacgcgactagcggttatacgtcttatcctagccaaaatgttaaatgccgggtacccctccgtcaaaaaaaaattccaatcctagtacgaacctggacatatgtgtgctcatgttcgtagctagggtttgtctctttttttttacggagtagtagtgctttattactcgtcaaaaaattatttttgatgtttttaaaaattttctcaactagatgtgacatttaagaagtaccaattataatattaaaagcaatattgccaatcgccttcaagacggtggaagacaccgtgcacataccttcaaggaggcattacatattactccctccatctacttttgattggcatatttccaaatataaaaaatttatttttgataggcatatttcaatccaacaacctatccttttaatgactttttcagatttaatgtgtgactctccattcattcacacataattggctacatgagcatcgagaaatgtaaatattaatgaatcgcttgtttacgagaaataactaatagcatgtttaaatggattataagtagaattaattatccttatcctcgttaggtataccaagatgaaatatcactatcaaaaatagatgaagagagtatgtgcaagtacagcatttgattaaaagagggtgaaacactcaaatacaaaaaggtgcaacaagataaagcataatacaatgttttgaaaaaaaaatacaagaagagcctatcgtccgggccgatggctgctcgtgtcgatgacctctggcctcgtggcctcagcctcttccattaagtggcatagttattactcacatttgggattaaaactatataaaaatcattgtgtataacttggtgtcaatcgtatcctacgttatcaaatattatagtcgggtataatccattaatatgtaattttttcaaagacgagtaatcatagttgaagtataaataatgtctagcgataagtatgtcgaaagagagggattataaaaaggagcatttacaaatttgtcactattttttaaaaattttacaaagatgccactcgaacgataattttattggcatttttgtaattttctagtagcagacttgtaataacgattcaaaatagtagtaaatttgcaattgcactttataaaaatacagtatatcttagagataatcttgttgggctttatctttagaaattaataaataactatatttaattggcagcagcaataaataacattcttccaaggaatcatacctgtcaaccatgaagcagccttcaaacactgcctacttaaggcagttttacatttacactgtacaccgttcagccatgagcctagctaagcatctcaccagctaattagccgttcttctcccctgattcgggtaattggcttgataatatgatggccatgaagaggctttctttctccttgttcctcctcccgttcttgctcctcgcgttcgtctactccctcttcttccccggctacttcagtatcctgccatctctcgccgccaggtgcagcaacagcgtggcggcgacgccggcgaacgcgacggggccggcggtggatctgcgcgtgctcctcggcgtggtcacccgggccgagatgtacgagcggcgcgcgctgctccgcctggcgtacgcgctccagccggcgcccgcgcgcgccgtcgtcgacgtccggttcttcgtgtgcagcctcgccagggaggaggacgccgtgctggtgtcgctcgagatcatcgcccacggcgacgtcgtggtgctcaactgcacggagaacatggacgacggcaagacgcactcctacttctcgtccctcccggcgctgttcgccgacgcgccgtacgactacgtcggcaagatcgacgacgactcgtactaccgcctggcgtcgctcgccgacacgctccgcgacaagccgcggcgcgacctgtaccacgggttcccggcgccgtgccacgccgacccgaggtcgcagttcatgtcgggcatggggtacatcgtgtcgtgggacgtggcggcgtgggtggcggcgacggaggcgctgcggggcgacgtgaaggggcccgaggacgaggtgttcggccggtggctgcgccgcggcggcaaggggagtaacaggtacggcgaggagacgcggatgtacgactacctcgacggcgggatgcgggagggggtgaactgcttccgccacgcgctcgtggcggacaccgtcgtcgtgcacaagctcaaggaccgcctcaagtgggcgcgcacgctcaaattcttcaacgccacacaggggcttaagccttccaagctgtaccatgtagacctgtgaaaattaaggggaaaaaaagggatcggattatttgtcagtattagctgttggcagtttcttcttcggtatgtgcatatcctctcttaaatgcacagtaagttataaagtgttcaaatttaaaacttgcatacataaatacataatcaacaaattacctgcatatatgcgctagtagaattgaagacacaatgactaatgaatgtgatcctagtatcctatcaggattgctattttagttccattttaggaggctaatatgacaaagtgtttagatgtctactactagtaaattaatttactcaatgattaaaaagaacagttggttgctatataggtagttttgccacacaaatggcgtgatttgatttgatacatggctaccactttatgttaaaagttgtttaaggctaagtctgcgcgtggtagacatcgagtcaagcttagtttctgttcaacagatccttatcaggatcttattgtcatcaagacatagatattggaaagagagtcaattaaaatataaagaccctttcctatatttttttataaacatttgtacaaacgcgacgcaatgctcacaacacgtacacactcaatcctatgaacacacatatgtacatcgtatccctatgagtatctccgaaaaactataccgacatatatcttaatattgacgaagtcactacggacgtctcgttattgacgggtacgtctcctatcaccaaaagaatagttatccgatttggcaaaaccattttattttgcattgtttagggcaaccataatatatgaaaaaaaatgatctatataattatttatgatctgctttacctatgtaagagtagttcatatatatagtagtccagatacccttatgcatatgaacatgtcataagtaataaaaaaatattaggggattctctttctcctgattcaggccactcatatgtcacgtgtctcattataaagtctacgcattatggaaccattttttagaccctgtctttaagcaataaaagggctgatttagcaatatacattgctcttaacctttaaggtgtataacatctgctttgttatgtttaaattaagtagactagcaatcatacttctattcttaggactaaacggtcatcttgttttttttttttgaaactttaacagtaggggaagcccctacggtatatattatgaaagagttgagagtacaaaaagactaaattacaaagaaattacaagggagacatccatgactgaataaaaagagtttggtcatctctaagtctaagtaaatgtagacttaggtcatctttaagagcagatttccagcttaaggtcgagggcatgatagaattgaagaccagattattcttgtgtttccaaatattccaagccgctaagaggaagatttccatgaaacacagagtcccaaaatttgctctctggtgaagaatcatatcatgaaaactgagattaaagttccaatggaaaccaatagaactccagcaacccgcactaaattgacaagagaagaacatatgttccatagtctctctttgattgctctgaaaagattgacaaatgatggaagcattgggaggcttgcagtgttttctatccaaaagatccattgtatttactctgtccatcagaaataaccaaccaaacaccttgattttcatcataactttgcttttccaaattaaaggtaaagttgctggggggagatgctccagaaaagcaatttgtagaacctgctggaagtatattgtgccgtgctccaaacataaaatccatacatcatggtttatcgaaaggtgaatggcagatagttcctgctcaaaaacctcatattcctggaaagcctgaactgagagagtaaggtgaaagttgtcatgcaggtctctagagaagtaggaaacaactgaatcaagtttattcttcgcaaaagagaacagtctaggatactgctgcgatctggtccttcctccccaattatcctcccaaaacaggactgaattgccattaccaccgatctggtcatcttgtttctccaccaccgatctaaacggtgctcttcttctctctatcttcaaatcatcccacaacctaataagagcaagtataataggatgttgtaagaatgctaaatactgaggtggatgagagaggagaggagagagaggagaagcgggtgtaagcttatagccggcttacgtacaggaaccaagaaaatatgtgagagagacaggtggaccatacatttatagttcatagctaaccacttatatgagttggctgagaggtagactataaagatttgtttgttgcatgatgagaggggagtaactatgaagaagatacagagatcccagaatcaagccagccatatgttagtaaagctcgtgttgatcatctctctgattcttgtagccaaatatctcacattctctgtaaggactctgttggttgagtaatatatctttgctcttcttcgtaaaaaaaattctatacagtaagcagctaattgtattattagtctttctctaaggtcatttctagtgcttcacatttgctagagtctatcacactatagcaggtcatgtaggataaaaggtaagatgatagtacaattaataaggagagagcagcaagacccgagtcttgtatgagatctagtttcaacacgaaatcctaccggaaagaatccacaaaaatagtattgaggcatactccctccattctaaaataaaccaacctcgtacatcgatgtgacatattctaatactacgaatctaaacatgaacacatacaaattcgtagtactacgatgttacatcaatatacgacggagggactaggatctgtttagtagagctccaactcctaaattgagttgggtctagagtggagttgtggaacagtctaaacccagctccacctctctagttcattctgtgagaacgctccacctagctttgctcccattttagatagagctgaaactgtttggctaagctcaaactccatttcttctaaaactggagctgtgccaaacagacccatacatattaaccgattgaaatgagggtttgatgccatggccctctggcctctctctcaagtgctccctttcccggcccatgggccatggtccatttcgctgtcttctcatcccacattgatttcttcctccccgtcgtgaaaaatcccgccgcccagcgttggtggcctgccgacggcaacaaggcaacaaaccatcacttctgttcgctgctgctcggcgtgctcacctgagccgacttgtactctcgtcggtgcctgcttggctgcttgcaccgtcatcttccccgtgtgcaacctcacccagtggaggatcggaggaggacgcggcaccggcggtgctcgagaacatcgcccacggcgtcgacggcgacatcgtcatcgcgctcaactgcacggggaacacatggacagcggcgagccggcgagacgcacgcacgcatgacgcacctgaaagatgcagagggacggagcagtctgagcaagtaggtgcaaactgatagatatatactgtagttcgctcctggcctcctgggtgctttatttcattcaagcaatcgaaattactactaactattatacaaaatcttctctagcctggttgacgttgcgttcgtgtaaatctatgtgcggcatgtgcattatacaaaattgattacaaatgcaatcatgttgtgctatgctagctgccgtcaagatttagcaaaggcactgattaagcttgttcaggttcaagatgccctgagtatcgcggcagtggtctctttgtcacgcaaggcgccattgagttgtcaaagtatcagtttggactttgaatcttgactcatatatacagccatctaactcctgcatatgccgcaagcaaattaaagaagcaaaaaaatgaaaaaaaatgtaccgatatagtgatatgccaatgtggatcataggtaaacgagcaacaaataattaaccctgtaaaatgccatcgctcacggtttactgaattcccaaatctcaaaattgaaatccaaaaacacacacctgatcagttaattagcctatacggtacctccaaacatttttcaacaaaaaatatatgagtatattagggattgaaaacgatacttgaggattgaacctcacactactttccactactctatcaagtgcatctccaaattaatccctcctgacgagttaataagctgtgtgatcctgtgaaacgccaactgcgtgaatccaaggacgaatccagtataggggcggtggggtctcgaacccccaccactggaacaagtactataggagcctccgtagctaaatcttttttgctacatgtagatatcaaggggctatatttttatctagtttattcatccgccgcagcgtgaatccatgcaatccgacgcgttcgttgtactgtaatctgtaggcgttgactacctcgcatgccacgcagtcccacgtacgcctctcgtgtccccaagatttacgcaaagggcgccattgccgtacaaaccaagctcccccgtcacgcacatggagctccatctcaaaccggccaaagcaccggcgatccgcctccgccttagcatcatatcactcgcgccacccaattgcacgcatttacaattcaattcacagcaatctctggatcacaaggagagcttcttgaatcgcagcagcaacgacgacgaagacgacgacgactgtgtcgagctcgagctcttgcctgccatgccgccggcgaagagctctaagcatggcttccccaagctgtcggcgtcaagcaaggcgctggtgctgctgccgctgctgctcctcgggttcatctacctcttcgtctaccccaaggagttcgagctgcaggcgctcatgatgagctcgtgcgggccgacgacggcggcgggggcgtacacggcggcgccgcgccgcctcgccggggagccaccggcgtcgcggaagcccgacttccgcctcctcatcggcgtgctcacccgcgccgacaactacgagcgccggcacctccttcgcatggtgtacggcctccagctcgccgcacggcgacctgaccgcgcacg

SEQ ID NO: 47003 - DNA, 4925 bp, Oryza sativa
  unsure (1)..(4925): unsure at all n locations
acggcggcaagacgtacgccttcttctccgcggcggcgcggctgtacgccgacgacccctacgactacgtgatgaaggccgacgacgacatcttcctccggctgccgcggctgctggcctccctgggcgcgatgccgcgggaggacgcgtactacggcgccaccatcccgtgcggcagcatggacccgttcagggagtacatgtccggcatggcgtacgcgctgtcgtgggacgtcgtcgagtgggtggcgacctccgacgtgccgcgcaaccgcaccgtggggccggaggacaggatgacggggcagtggctgcggctcggggggagagggaagaacaggttcaacgccaagccggccatgtacgactacccgctgccggcgccggtggacaagtgctcgcacgagtttatcccggacaccatcgccgtccaccgcctcaaggacaacccgcgctgggccgagacgctcaagtacttcaacttcaccaagggcctcgagccctcaaagttctacaagataaactagaaacagaggatccatcgattggaattggacatgcgttatacattgttggttaattttggggaatgaaatggtttctactatatatatttttttgggtattattcgacattttgcagaaattattttcctttttcctcctttaatccccatcagtttgtaatgaacacttgattcaaatacacagatgataactcaaaaggaaattgtagagtatgcaaatcatgaagttgagtagccatgataatgttgctgggacagttttggtttgatatgtcttaccaaattgttttgtgatcatctgatgttggtacggaaggacatttagatatgtttggattgccacgttgtcaaattttgataaggttgaaaattagtatagtaacaaactctgttttaaatgtttctaaatatacgaggcaactagcatggtggcccgcgcagattgcgtggctagtatcattatattttttttcatataatagcatacatgttttctcattatattattcaaatatattaaaatgacaacacaattttaaattttgcaataactttacaaaactactaatgtgtaatattcatattgtattttatatacatgttagttattaattatttttaatatcaaattttagttatttgtagattatatatattcctatatggactctagactcgtcttttaatatttcttttttttaattccgaattttctgtaaattgtatttctatatagactctaagctcttctttcaatattatttatttttatttctgaatttttattatttctaattgtgtttctatgtggactctaaactcatctttcaatattctttaatttttaatttcgaatttcatttacttctaaattgtattcctatattgactttaaactcttcttcccatgtttttcttaattttcaattttagttatttttaaattgtatttttatacggactctaaactctactttaaattttattatttttatttcaaattttagttagttttaaattttattatgtttattccaaattttagttagttttaaattcctatatgaactctatactctacttctaatatttcttattttttaattctgaatttctattttttttccttaattgtatttctatatgaactctatactctacttctaatattccttatttttaattccacatttctattgtttcctaattatatttctatatggactttatactctatttctaatattccttatttttaattccgaatttcagttatttcctaattgtatttctatatgaactctatactctacttataattttccttatttttaattccgaatttcagctatttgtaaattgtatttctatatggactctgctttttctttttgtcagattaatgtgagaatttctaggccatgagagcgaacgtggaggctcatttttctattcctttaataatataataatagattggtttttaaacatgagatcatttgttccattaaaaaaagatactatgcaagcattatttaattttctctaatatataatattttttaataaaacgagtagtcaaatgtcatatccaaaagttacaatagtaatgtgtttgcacaacattgagttaatatttttttaaactcgtgactatctttcaaaatacttactccatctgtttcaggttataaaatgttttaactttggttaaagtcaaactgtttcaagtttgaccaagtttatagaaaaaaataataatattttcgaccaagataaatttattattaaaatatatttaattattaattcaataaaactaatttgataatgtaaatattactatatttgtttataaatttagtcaaacttaaagcagtttgactttaactaacgtcaaaacatcttataacctcaaatggagggagcagctaaaaaggacacacaatgatatatatagatttatatatcttataaatactttcatggtctcataaaaccatcacattttttttccaaaatcgtataagatggtaaaatggcaaatataagttttgactggagggaatagtgcctttatacaaacaagtctactttttttttaaaaaaaaaactgaacaagactaaatttgatttacacggccgtgggaaaattgtaaaaagaattgttaattttcatttatttttccgttggttaactggataagagggcaggctggaagctgggcgcacagccagagtaccatcaccggagatcagagaaaggctcaaggcaaaaaatgagtcccgccaccgcagccacggccggatgccaccacctcctcctccccacggcgagccggccatgcggcgcgcctcctcgacggctagcacgaggcgccgcagcggcagcggcagcagccgggcacgtgtcggtggtgggtcggcggccgctggaggaggtatacaaggtgcgggtggagcgcggcgcggcggcgcgggagcgggcggaggcgctgcgggcgatggagacgtggtccacgtggcggacgggcgggcggtgccggatgccctgggactggcacgtggaccagctcgtctacatcgtctccggcgaggtccgcgtgctcccggccgaggccaccaccggcgaggagtacatgcacttcgtcgccggcgacctcgtccggtaccccaagtggttcgaggccgacctgtacttcgacgggccttacgaggagcgctaccgattcctcgcctatggggatgacaactgaatctaatcgcgttaatccatccatgattggaggggattggggattagtaccaagcttgctagtgtagtgtgttggtggcgcctagggatttatcttcttcgctttcatgttgagtaatttactgtattgtatttcagttaatcgattttgtccttgcaacacaattatgcatgtttgacactgcttgtgcttgtgcttgtgccgccttactttcagaacgttctattatgtacatttagacattctttaggattgctgaaaggatgaaaaatgagcatctgaaaaatacaccgaaatgatgctgatgatatattttaatttgttcaagtattattatttccttgttgcttcagatgctggtatcaaattgtgaatctacagaacaaaatgttgtaaaaggaaggctgcactccaatacctgttgcctatagctgataagtagattcatttccgtggcagtagttaatgctggtgtataacaaatcatcttacgctgaacttgttttttctgtataagctaacttgtttcaacaaatgaagtacctcaccaaagtactcctacaggcttgaaaaactattatctgctagcacaatttcacattttgtacctgtgggcttttgttttgtcacacccttgattcaagtggggtgcaatcatcagtcgagtcgattgaattgttggtggcatctttgtgtgtatgtaaacaattgggtacatttatctattcttattttccatcatagaagcaaatctcttttaagccagcaccatctcaaacctgcaaggtgaggtaagttactttagtcttatttacatgccatttatagtgctctaaatttgccattcatcattntctttccagttacatctgttacttagagttaccctattaaaattttaaatactccatccctattaaaattttacatacggtagaaaactctgaagtaccaaacttcatcactgaaagcttatgtctggatttttcattggccatgtgcattcatcttatgatgcagaggccgggcgctgcccattatctaaaaaatgtctggatttttctgtggcagtactgatattcgaatggcaattcaccctagagtttgggttttgagtttttgcctcaagactgtaaattaatgtcaaatctactgcaggatggttatcattgaacattacgtccagttgggcgttagatgggcttgatacaatccaatgtacttccaaggcattaataatgtccaatgagctcatgtgtttggaagaaatgttggttgtggtcactatgatgcaatggaaccagtcttgttttctagatttttagataatagtcttgttttcttgatgttaaaaagtttaaaagtactgaaaattttccctgagaattttggatatcttgcattatgtatgtggaaattatattttataatagttgcaggttaatttcttgattgtctttcttaccatattttctgtttaagcagaggcagttaggaagatttttgagaggctgagggagaccacatgaccatggaaatgcatatcaagcctatgcagaatgcctggagcagagaaaaactgcaaaactacagaaaggctttgaagagatggtggtctgtagggatgctcgtgctgttcact

SEQ ID NO: 47004 - DNA, 23025 bp, Oryza sativa
attgtgatttttgagtgtattgaattgtttgagtgaactgacattgaaaattcttctgttacagtcagattcagtactccatttatcagttgactcatctcgcggaaacggcatggctaattcttctccgatgtttggcgtttgccttcttctccgatgctgtggtgcggcaacctgattatggttcccatgtaagcaaatcatgttcagcattatcctcatacaaggttccttacttccttatgtccactgctgtatagttatcgtggtctgttcatgttgagcaacacctgccattttcttttcagggcatgcccagaacttgcaggtccatttcgtcagtgcaccggctccagtcagatggtccggacaataacctgacgaagagtcgaagattgcttctctttgtagctgtctgacactataatgcaatgaaaagattagcttagtttgatcccataatcgtcttgtcctggaatccttgttgctttcattgtctggattgtatcaaatttgaagaatttgaaacctgggagcttttgtgcaatatcatgtttacgtacactattcttttcctaagttctattctcctcccaggagtacccagtagcagtattccccgaaatcatgcagaggccttttcgaaaacgcacgaattttactgtatttccacatgtttaattcaaattccgacttggttccaaagaagacctaagctttgatcagttcgtttcggaatcgaacacgaaaaccaaactaaataaatcctaagctcagccctccaagacgaaaaaaaaaagcccattgccgcaacgagccaaggacacagaccaactctagacaggcctagaaagatttacaccgtccgatcagcatcgggcggcggagagggatccttgcggaggaggaaagaaaaaaaaggccaaataaaaagaaaaaaaaggaggagaaaataaactccccgcatccacgcgagcttctctcttctctcgcattcgcacccccaccttctctccacgactccacctgaagcgcctctcgccgccgccggagaagacgcgcagcggcagcagcggcggaagcggcggggagccatggcgccggagccggaagacgacatcatgaacgagaagaacccccgcccgctcgacgaggacgacatcgctctcctcaagacctacgtgagtgtccccccgctagatctccctgatctcttcccatctaggggtgctttctggtgatctggtcccatggtgggctcgggcctcgggctggggttagcttgtggttgggggtagttctagggtttcgatttgtgtgtgtgcctcttttgtcggcggttgaggctgatgttgttcagcggatggtttgggtttctcgcggaaggcgaaatgtttgtttctctcgttttcttcttcttcttcgccgtgaaaagctcggttttagtggagaggattaatactttgtttggtgctgcgtggtttctattaatgaagtttgctgattctggctgtctggttgttgttgcgcaggggcttgggccatactccacaagcattaagaaggtggagaaagaaataaaagaaatggctaagaagatcaatgacctttgtggtgagttaagaatttttcgtctaattcttggttggaactggagatgtagctcaatttgctaagtaattttcttttagttcagctgtgtactttcatgtgatagcatagtgagataaattttatcgaacacactgatgctttcctatttgctatagcacattttgattgtttagtgggtttggccattccccactgtaggaatgttttatatcatattgatcactctttgttcattgatgacaagagtacaattctggtgctctatgtgggcttatataatgtgcgatatacctccaaatttgttcttgtactagaactttgacgtcgtaatgtgcactgtatagcaaccttgtctcatgttcaaacaccctcttacctttcacatcattgttcagtttgtcagcttgtttagatgctaggagtttagcacatgttaattggtctatctgactgatatactctttcattaaatcccagggattaaggagtctgacactgggctggcaccacccagccaatgggatctagtatcagataagcagatgatgcaagaagagcaaccgctgcaagtatatcgcttaacctatttccccgcctaccttcttccttgttttaatagttttgtgcctagcatacttcatgcatgatgcctaaggacttagatttcctgctttagttttatgtcttctgtgattttactgacaagatattttcctccttttgaaggtggctaggtgtaccaagattataagtcctaatactgatgatgctaaatatgtgattaatgtaaaacaaattgcaaaggtattccatgcttatccaattttattgaaaccatatctttcatgaaaaaaaatgtgttgatccctttctcatactgtattttgtatcattcagtttgtggttggcctaggggataaagtttctccaactgacattgaggaagggatgagagtggggtaggtcactgctgtttttttggtctttgatgtatcatattattctccctgaattctatctcatgcaattcgatctgctgtttccacctttttttgatgcatttttgcgttagaccaaaacaagctctaatatattaacccaatagtatgcacacttcctcaatgcaatggtgttaattcattgacagcatatatggtgtcatggaaacaagagtagattatagttcaacaaaccttacatgtttgacatagaagagaatattgcttatttgaatccagggtataacatatacaaagtttggtagatatacttcactaattttctgttcctttgcgtttaccaatagtactagtagcaccatttgtccattcctgcgacagaagatgaactgtaacatgtaagctttagagatagcaaagctgattaagctaagaagaaaaaagcatctgatgcatgcatgcttttttctggacaagtcatatgccttctatatcatatatagtttgtatgtcattgttctaggtctgttgaaccactgtactcactgtataaattcatctcacgtttaatgcagtgttgatcggaacaagtaccagattcaaattcctttgccacccaaaattgacccaagtgttaccatgatgacagttgaggaaaaacctgatgtgacatataatgatgtgggtggttgcaaggaacagattgaaaaaatgcgggaggtatactaatcttttttcagttcatatcccttgtcgtgcaaacttgctcatccttgtgcatcaggctagttagttttggacttattttgctatttactgtttgctaattattgtttgttcataggttgttgagcttcccatgcttcacccagagaagtttgtcaagcttggtattgatcctccaaagggggtcctttgctatggccctcctggaactggcaaaacacttcttgctagagcagtggccaatcgtacagatgcttgttttatccgtgtaattggcagtgagttagttcaaaaatatgttggtgaaggggcacggatggtccgggaattatttcaggtatgtgcaacattgtgaaaactcacaagaacttatcaattttctgcacttaaagtgcttctgtttgacaagcatgtttctgaaaaaaaaaatgttgacttggtttagatggcccgctcgaagaaagcatgcattgtcttctttgatgaggttgatgctattggaggtgctcgcttcgatgatggggttgggggtgataatgaggttcagcgtaccatgttggaaattgtgaaccaactcgatgggtttgatgcgaggggaaacatcaaggttctgatggccacaaacaggtattgcatatcatactgtgtagctatttatctttaaacatctgcatgtgttcaggactatcgccacatgagtagagctgagaagctgaccacattttcttgttttgtcaggcctgataccttagatcctgcacttctacgtcctggtcgtttggacaggaaggtagaatttggcttacctgacctggagggccgtacccaaatattcaagatacatacacgcaccatgaactgtgagcgcgatatccgtttcgagctgctggctcgcctctgccccaactcaactggtaactggaagaactttgaaacttcgttctgggtggtttcttctagatttgtttgttatagtctccacctcaaaagcggataatgctaagctttgttctcacaaactcctgtttgctgttacaggagctgatataaggagtgtctgcacagaagctggcatgtatgcgattcgcgcccgacggaaaacagtgactgagaaggacttccttgatgctgtaaacaaggtcatcaaagggtatcagaagttcagcgcgactccaaaatacatggtgtataactaaaccgttgttgctcccatttactatggcccatgagattgtctctggctgtctgcaaagattgttgttgtttcttctcggaattgtgcatctttgtggcgaccatgtcatcttgtacaagttctattaaattttataagtagggttccttttgacggttaatgtgtcaacgacaacaatgtgcaaagatttccacgacggttgtggtcgggtggaacggtggagatgaagaattgaaggtgactccacgaacacccttgcctggttccgattgatggagtagcatatgcatgcatcctagtcctagcaaatcctgcatgacttacaatattcttggactcactagaaattttgttagtttcttgagagcaggaaagcccattttgttcctcgcttttcttttttagtggagctgattcagtgcttaggctgagttcggtaccaaatgttgggaaccaaatgctgagtttcagaatttagttatttctaatacatcttattttaaaataaaactatttctctacctatctcctcctctcaaccatttttccttttttttacctaccttttcatctcaaccaattataacatttctcaaattatctctatctactttttaatatatgtgaccatcttaaaaatacttatattttagaatagggctcgtagtgtaataccatgattcggagcattatttccgaaaatgtcgtacacaaataatatctttaaaaaaaatctgagctctgcttttagcaggacaaatctatagatactactatcccctttctaaagggggcgcctaatgcacgactaatcgcgtgcctggggccacgcgcgactgatgctagtaccttttactactactatttaatatattactactactagtctactattactactattagtactactactataaaaaatatatatatacattaaaaaacctaaaaaaacgtgtatataaactttatatatatgcatacaaactttatatacgtgtatacaaaatttgtatacgtatgtataaaaacctaaaaaaacatatgtacacaaactttatatatgtgtatataaactttgtatacatatatacaaaattgtatacgtacatataaaaacccaaaaagtacacgtatacaaagtttgcatacacatatacaacccttatatatgcgtacacaaagtttgcatacgtgtatacaaactttatatatgcgtatacaaagtttatatttttacgtatacaaagtttgcatacatacgtattaaaaacgaaaaaaatacggaaagaaaaaaagaaaaaaagaaaaacgaaaccgaaaaaatacgaaagaaaaacagaaaaaaaagagaaaccgaaaagaaaaaaaaacggaaaacacggagctcctcccgcgcggcgcgccgtccggcgcccctctccgcatgcgacacgtgtccagtcgcgcgcgcgcgcgaccggtcgccgaacagcagtttcgctttctaaaagcagaagaacgcctctgcccttccaggcccaggcccaggcccagcctcactttgcttctagaagcagaagaacgccaggcaggggcaacgaacataagtactcctactagtacagcgtcgcttggccacagctcccctccccttcccttcccttccatccaccaaccgccgaatcctccaaaccctctcctccacccctacccctcccggctcccatggagatggagccctcgcctgcgcctactatggcggatttgccggctgatttgctgcgggagatcttccgccatttgcgatgtgtcgcggaccgcgatgctgcggccgacgtctgcaggacatggcgcggcgcactcgccgagcccacgccgcctccctcgccgccgcgccctctcccttggttactcctcccatccgccggcgatgatttcatccacgtctactgcttctactgcgggatcgaccgctgcagtcttcaccaccgcctcagccccgcgcacggggcgcgctgcttcggctcgcatgagggagggtggctgttcgtcgccttcgagcacaatcgacttcacgccatgatcaacctccggtcacgcgaggattccaagagcagcttgattcctttccccgacctgctccgctcgtatcaggacgaggacgactaccagcgcgcacagaacatggttatactggcagcagcactctcctcttccccaggcggcacgagctgcattggcgcgggcatcgtcatgcgctgggatctcatcgccggctcgtgccgtctcgccttctggcgtatgggagatcgtgttgccgtcgaaggaacaatggcgcccgactcaacagtcagactcagagatgagatacaggatgtcatctatcaggatggcgccttccggttcgtgacgaggaggggattcctcgtcacctgtatccccatgttctacgcagatggtggcctccaaggcactacagagtctgttcagcgcatccggcaccgggagcgcttgcgcgaacatgtccatgcgcgctatctcgtggagtcccgggccaagcttctgatgattgtgagatttgcagctcggccacgttctcccacaagcctattcaaggtgttcgagatggttcaggagatggtgcaggactacaccggcgtggagaaaattgaggacacctggaccgaactggagtcgctggatgggcgtctattcttcgtcgggcgtggctgctccagatcgtatgaatcatctgcctatcctgagcttgggctgggactcaaggagggtgtctacttcctggatgactacgtttacgccgatgagggcatgcccttccgcgatgagggacatcgccgttatccctgcagcgacaacgggaggtggtgcgacgggcacgttcatcgctgtttctcggagcagcgcgcatcgtctgcccactcctctccgacttggttactcccgtgatactacaattgtgcgggtaaacgattttcatgctttcttgcatcgatcattgattttttgttgacttgactgcgttcctgagatgattgattttttgttggcatgactgcgttcctgagttaaacgattttcatgcttccttgcaaaaatcacgctgattttttgttgacttgactgcgttcctgagataattgattccagcgaattcagggtgtgaactcgtctgcatgagtctgcaggctgctggttatcatcttttcatctgaaggttgtttctgttctgttgccatagcatcaataataatggtggtgaggattgtggagtaccctgacactttgttttggttagtgagttgaacacttgaactctgctgattggataggagagtgtctgggatgtgttgttttgtttcaccttgctctcgccagtataatcaggttgctgattgtcccctggattagggaaaagtctaataatcatcccttatgggacggccctcatttttttcatgtcacttaaaatgtttttgaaagaattcatcacgatagatcaatatataacacttatgtagactcaaattcgatctatacaagtattaaaattctaatccctccgttttatactataagtcgtttgactttttttaataaaactttgttaagtttgaccaagtttatagaaaaatttagcaacatttaaaatatcaaattagtttcattaaatctaacattaaatatattttgataatatgtttgttttgtgttaaaaatattaatatatatttttataaatttagtcaaacctaaaaatgtttgactagggaaaaaatatcaaacacaacttataatatgaaaaagagtgagtactattttttttatcacacatctataacttggccttgcaccataaatttctacaatagaacttgctcttactagttcagctacttgaacggtctccgcgacttgaccttgagctccgcaccgcggaatgaattcccctctctgtgtgtatgtagagaaatcaactgcaaaaggatagttgcatgtcggtgactaaggccgagttctaactattttgattgatttttaaacaaacaagggaatgtctcagtgagggatcaaaacaattcccgttttttctagatttttgaaagtcatttgcattgaatttaagagaaaaattctacacaaggtttttttcctctgctgtaactaagaatagttatcccctccatccgcctggttatgggttcgaacatcctctcaaggaactagaatccattctccctccaatcatgacattcttaggagttgcatggcggtcattgatggattaagtttttccacaatgcacaaagaaatacacaaaaaattacacaaaaaaaattacacatcatattacaggagcaaatgaaagttttacacgacacgacatccgggcagccatcgcaaccagggtgaacaggatagaagaaaaacgaactaggaattactggctactctctctgtgaaaaaaactcaaatcctagggatgtctgtattcatacctagaatttaattttttatatgacaaagggagtaagtcgaaaggaagagattgcaaatcctagttaaaaagctactactccccaaaatgaatgcaaaaacaacagccgaaagctactactcccccaaatgaaccacactatcgagcaaccactggcgcccttccaatcggatgaggatgatgacggaggaaaccgaagacatagtcgaagaaacgcaagatctgcgagtcgagattccgacgtacgatgacgtttcgtcaaccgcatcctcaattaagcccaccatcttggatcaagcagccatggttggggtgcaatttccagcctccccgccatggacagcaattgaaaccaaacttaccgaggatatggtttaccgtctccaattcttgcgcatagaaaggacaggaggtaaggcagttgatgacttgattcctcgctgtcgaaacaaattttcggcaatatgaaaaggggtagcgtacgagacctgaaagtggatggatgcggagacaaaggatttagacaggttcagaccctctcgatgagaggtaataccctactcctgtttggggatttgaatccgccgggtgtatattgatctgacgatcagtttgtgtcatgccccctagagggcctcctgccccaccttatataggatgggagcaggattacaagatagaaaccttaaccaatacggtatcggtttcctaaatctattttacaatattatcaaatcaagactttaggccgctccataatataaaaggaaacgtaatacccaagtcatgatcggttacatattccatagatataagctatcctctatgactagtcggatagccatgccgtgtgggtatggggtacccataatctccacagtagccccggagaccttcacagtcggaaagataatcttctttcgaactagattactccaaaaccgagtgcttcaatcatctttgccatgatcccccgagtacttttaccaaatatgaagattgtggagggctgaaaaataaagtcaggtgcatcgaatagatgtacctaatagaggcaccaactgagtggttttgataattgtagtcaaccaagtgacttaatattaatatatagcatatgcggtgtgaatccttgaataacatgatccgagtgatataccgactgctttgtaaaatatgatgcgtgcaatctaaagctgactacatcattgaatacacatagcaaaacagctataaagaagcttgtatgttgtgaataaataaatttccaaagtattgggcatacaccatgcgcacactgctttaacagatgtgcttgagtccctaaaagacacatggtttcaccacacctggaaatatatggcatatgtggtataaaatccgagtaaataaactcataaggatttatcaatcatctggaaaatgaccaaaatatataatcagcctaagccataatattggtcaataaaaatgcacacttacgtggcaaaaagcaattatgttgtatccaatcaattgcttgataaacccaaacagtgccatgactatataaaaaagtcagcggggcagctatataaagctttactgtttgacaccttttaagatgcattgtaccaactcctaaaaagttgagtaactgcggtataaaaggactttaaggtattgggcactagatcacacgcactttggcctaagcaaaaagtgcctaagtccctaaaagaacgtgactggccacacctcaaaatatgggctgcagacatattaggcctaggccaaaaaatatgacttcgacaccctttaaaggatgacacatgtaacatgctcccaagtaataagtcttctaggtaatgtagaccaagtgtagctcatatgaatagcttctgatctgagtgattatcccttatgggatactccaaaatagatataataattaaatcccgactggcgcaagtattcagttgatagtccttacggggaatagtaattggtccagtctttgagcatagaaaataaactcatgactataaatccatgttgaatgtatccgaaacaagtccaaattgaaggtatgatacttgtgtttgagctagtaagcccctgagcatatagcttgtccttctgtcgtagtcacaattgtccattgatggtagctgacgcaattggcatagagacaagatgaccaatatagagagaatattgctcaccagaggtggaaaaaatattggtggtagtgaagatagtgataccaatcaaaagtgatgaagttgcacaaccgtgaaggcaaagaaaccagtcggcagcagtcagggcagccagcaatgaagatgaaggcgcccagcgataaagttgtgtagccatggcagtgaaataatcagtcgatgacagacaaggcagctggtgaagaagatgaagatgcccattagtggcgacataataagccatccatgaaggcgaggataccggtcggtggtgacgaaagcaagccaacggtgaagatgtagacacgcatcaaaggcgatgacgaaatccaccaatcatgaagatgaagaaaatagtcagcgatgacaaacgcaaccgacagtaatgatgataagcagcaatcatagataatcaaatataatgacgaagttgcccatcaatagcagtagagtgggctatgttgaataggcttgacaggatgttgatgaagataacgatgtcggtgatccagtcgatagcaaccgtgaaagtgaaataataagtcggcgaagacatagtcatccattagcaacagagttgatgtcagggccgatgaagcagaggtgctggtgatgatgtcagtgacaataatccatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgattaattgattgcttcagcttgtcgaattttgagagtcttgtatttgtgtagcccccgactctttggttagttgggaaacaactgaacatagagtcgagaactgtagcttgtcgtcaagtggccatcacttgagtgaagatacatgttaaagatgtccgagtagaaaccggtgccgaagacaatgaagatgaagtagctccaccatggtaacaaagttgcatagccgtgatgaagtgaacacgagtcggcggcaacggaagcaaaccggttgcgaagacgcgtagttgtgaagataaaaatatcagtcggcggcgacttaacaagtcggcgacggaagatgatgacgtccatcaatagtggtagcggtgtaaaccagacgtagaggcgagtgcactagtcagctgcagacgagatgaccgacggtgaagacgataaggccaatcaacactagcaaaatcatgcagccatggaagtgaagaaaccagtcggcagcagatgtagacagcttgtgttgaagatgatgacgcctattagcgatggtggcgacgtggccagccgtgaagacgatagcgccaattggcgtcatacgaagtggctggtcggtgaagatgtagacgtccaacaacggtggcataataggccagtcgtgcagcggagacaccagtcggcggcggataaggcggccggttggtgaaggtgtagacgcccaacaacagcggcatagtaggccagccgtgcaagcggagacaccagttggcggcggcgaaggtaagccggtcggtgaagacgtagatgcccaacaacggcggtgtgaccacctgaccgtataagcgagaacaccagtcggcggtggacaaggcggccggttggtgaaggtgtagacgcccaacaaaaacggtgtgaccacccaggcgatgacagcaagccgatggtgatgtgctgactgatccattcctggagcgtaagagataagcttatagccatgaatcccttttatgcatatctggatctggatcctgcagaacaaacatataggatgagtagtatctgatataaatataatactcgagaaaaattcaagtattttaaaatatttataaatatgtatttcttctcttgtcaattttgatttccccgagcagatgactcattacgtttaaacactctgcccgactagtcatagccaccatgcaccgggagtcagcctaagcacttcccaaacatgcatatgagtgacatgagttcgtcattaatggaacaaagtttcacgggtcggagtttactactcgggtacttttgcaattattaagagcagaaaataaattatcttatctctatgcttttgatttattccgaataatacttagcaccttgcgttattcgatccatccaacaagcccccgggtgctaggaatcagcccaaaggcaactatcaattagcaaaccaaacgaaaagcataggaagatggaactccataactcgataggcacttttgtactcagaatatgtcgcaagcaatcaagataaatattatgaaaattgtttaaaaaatatgatacacatctgtagcccccgactcactagtcaacggcgaaccagttgatgtagtgaggcaaaggaaaaggcaaaatatcatataaagaataaaataaatgacgacttagctttgtcgtattccctcggtgacagcaaaagtagccgatgtgggaacgaagcagtccatcaatggtgacaaaaacaccagtcggcgccagtggaaccaagccagtggtgtagatgatgaagcccattaacggcggcggagtccgctaaccgtataggcgaaaacaccagtcagtggcggcagaggcaggccggcggtgaagtcgtagatgctcaacagcggcagcataataggccagccgtgcaggcggaaacaccagtcggcggcggacgaggcggccggtcggtgaagacgtagacgcccaacaacagcggcataataggccagccgtgcaggcggaaacaccagtcggcagcggacgaggcggccgatcggtgaagacgtggacgcccatgaacggtggtgtgaccaaccaaccgtataggcgaggacaccggtcggcggcgacggaggcaggccggcggtgatgatgacggaggcaagccggcaacgatgaggtcagggaacggagaaacagcttcgcactcccgccggtctatccatgtggtagcatgcgacgtctgcccagctcgttggtttgactctgccgactcgtcctcctggcgacgtgtctctgtgcatttagatcaggcactcgtgtacagctcggacagaggtggattgatcaataccatccggtgattaaatcaagtagtagttgcatgaatcttaattactccatattagacaacgttgcctatgcatggcggcaaagtccaagctcccaaaacaaacaaatctgcctgggaataacgatagtatatatgctggtgcttcagtaattggagacacgtgctgcaaagtctgctaattatgattccagatcaatctgttgtcagtggactccgctacatgcatgtatattgtatacatggcgaaatcgcacacgattactattccgattggatagatgactgcctttcgtcgttctgcgtctggctaatcgcagctgagttgtgcgtctggctaatcgcagctgagttgaaattaggccgaacggataattggcgtgggactcgtcctggcaatgatcggattccgacggcggcagggcatgtgtatatggtatttgatcttaaactgaggtcttccatggaggtattgacggcggtggaaattgaatccatcgaacatgtcgagactgatcttcccggctagattggatccgagtcgaagagcaggagcatgttgaagtggtcggcgaaaaaactcccgaagcgaagatgaagccggtgactcatgaagttgattccatcgcacttgtcgacaggtaactcgacgcaacccctacctggcgcgccaactgtcgaaacaaattttcggcaatatgaaaagggggtagcgcacgagacctgaaagtggatggatgcggagacaaaggatttagacaggttcaggccctctcgatgagaggtaataccctactcctgtttggggatttgaatccgccgggtgtatattgatctgacgatcagtttgtgtcatgccccctagagggcctcctgccccaccttatataggatggggggcatgattacaatatagaaaccttaaccaatacggtatcggtttcctaaatctattttataatattatcaaatcaggactttaggccgctccataatataaaaggaaacgtaatacccaagtcatgatcggttacatattccatagatataagctatcctctatgactagtcggatagctatgccgtgtggatatgaggtacccataatctccacactcgctgaccaggacatctacgatccaacaacgtacagcgcctgcgccgtgagccacaaaaggaagaccttacatttcgcaggcagcaggccatgagcagaaccgatcttctaccgtggtacctaaaattttttaagtacccattagatttagaattggtactaattttttttaacggaaaacagcactagagtgacttttcattgaacggcactaggcaattatttttctttacagaactaattgttttttactaaagtgttttattttgacaatcactctaagagtgtgtagataaattgcgtcttacgaaagcaaatgaccctgagagcactgatctttactgatcttgtaaggatgcacacatcttactctaggagaggataacaaaatagaagtctataaagatctacaaattaaaagggatcatggttgactgaatgagagatatggaaaaaaggaagaagtgatgactgttgtttccataactcaatgtgttcattgtactgtagtggtgtcagtgtgttagttatttagattttgccagttacatgatactatatcaatatgtgttaatactgtgtattatcggtaccatgattgagaagcggtggaattgcttggaatattttatttatcctcaccttttttgtgtggatgcatattgtctcatatattggtattgaagtgattagataattgacgatcttgaattaatatttttaggcaatataattattgtactttgccttattatgcgacatagatcgaattaaagctcaattggatggataacaggtaaattatttttgctagcatgtaatccatcagaaaagattatgacaccttagtgttagcaggggcaaattaactagtttaataaggtgtaaaagtaatttacataaaccataaaagtaacttagcataaaatggaagtaagttgttacaacattagaagtaaattcgttgtagggaaaaaaatatgatctatctaaaaattaaatttaaagtccataaattataaaattgactaaaagcaataataaaaataatcaacttagagcattatgaaagtataagaagtaatttagtcaaatctaaaagtaatttatatatatgataaaagtaacttacgtatatattaaaagtaatttacaaacataaatatttttatcgtaatataatcatgtaagatttttttttgtgaagatttaattgtaacaaacgcaatagtgttaagtaataagaagggaaaaaaatatatgcatggcatgcatatattttttgttgtggaactttgatgcttctctcaaattttaatttcgtccggtttgacagtgtttggtgtcgaagttagagtttgaaaacttggatatatggtgtttttatatgtagaaactttgtgtacactaagactgataccgatctaaagtgaagacaaatcttccggaccttaaaatccaaaaggctcagctaccagaaaacatgagcaatggtaagcaacggttacatgtctcaacaagattcgcaagctgaataaccatcgcatagacaataaaagaagagcaatccaaaaggcagggtaccagaaaacagatctgagttactgaacaacggttctagtaatcgcatacagaacaaacgtaagcctctattactactcgctacttcatgaaagatagcttgttctccgttctgaagagctcgtcgagcaccccattccacctcatgtgatagccacacgtgaatagcctgtttaagcgcttcctgttccacaggtcagccagaggtaacatgcttctgagcacgaaaatgtcgcactcccgtgttctcccgctctcctcgtcctcaacctgtagaataatttctcgcttgcagagcatgtcatttttcatcaggtacctcgtttcctcctccaacggactccggggattgagcaggccaatggcaccttgcgcgcggcagagttcccggctatgtcctcgcttgtgcttctgatgaaacttgtccggcatgcaatacgagcatagcatcaacgagcagcatgatgttatccagtcagcaggccgatcgcaagaacagcacttcggagaggaaggcctcgctggctccaagagttcatccactctctccttgattatacctgaaaaaaaaacattttgaaccaaaagaaaataaatgagaaagaccagtagcgacagtattagccttcaattttgtaataaagagtcttttcacagagttccgttacgggcagttacctctgtggcacatatttggttcaaatgtcatttcttgacgcctaagatgggcttgcgcagtcaatccctccatatgacgagctagatatggtccatatctaccaaagatatgtacaatcactgttctcactgctggcggtggcaccttttgatcaactgagtggtctgcccctattcggccaaacaacagtttcttcactgcctccgagaagttattatcatcagaagaccatccgggaactatcacaataacagaagctgcagcaaaatgttaatttcaggtaagaatgaactgagtgaaaataatttataatctaactagttgggccatctgttctcaagtgacagtgatgagcattgatcaattcaatgtagcaaaagccctaggtaaccagaaacgtaaatagtcacacagacaccacaaattaaacagtatttaccaacatatgaaacatacggagggggcgtagtctcacaaatacaaactactagcaacaagtttgcatggcattttgaatacaacattgctaactgcaaaatcaaatcattttcacaaaaataaaaggaccttctgaattgtaacagatgcaccaaggtcaggcaaatggcgagtagaacactcaccatttttgtcctgagaaggtagcttagacacagcggtgggcagtggttcctggagattggaggtatccacacgacgggtgagtgcgccaccaggcaacggatgttgtgatggtgcaggtgtccccagcccgacgcggccttcctcactgctgctctccgctaaccaaccagaaccaagaagaacaacttcacaatggcacgaagaggggagttcaatcttggaaaaaagaagagggcaagaggcgcgctcgattaggtactcaccttggatgcgcaggggcctggatgcgcccacagagcgcttgctgtttcccagcaggggcattggttcttaagtgatagtgagaaacagaaggattactgaagttagtcgattatatacacagaaaaatgggactatcaattatgctgattgctgacaaagccactaggtgtaatgtagaagatatacaaaatactatcagaacagacagaacaagatacctaggtaatcagaaacgtaaatatccacatggcagtggcagattcaaaaaattttaagagctcgggtaaacctaacaaacaaaccaagaatatacaagtctatataattcatagatcattttaacatgagcatttgctttataagtttgtgttaagcatatgtgttgatgtggagttgcttcatacggcctagcagtgaactaagcaatgtaattagcaagctaattaagtgttaatctatggatgcacagctgcatgtgccaggcagagcctgggccattgcccgtggtagctgggccttggctccgccactgcacacggacgcaacaaattacacagtatttaccaacaaatgcagtatacagagggggcatagtctcacaaatacaaaaataaaagggccttctaaattgttaagtaggcatctgcttctattatcaagagtgagtgttacttgagagactgctcatgatcatgttcaagcaaacaaggcaaaagtcaagcagatttctaaagttgtggctttcagctatcatgctgtccatatgaggcgtgactaaagcagggtacaaattaattcattaatcaaaataaaatagaaaatgcatagtgtatttgctaggccgatgttatcaaaagcagattaaacagatatagaatgttttagaatcccacaacaaatacagcacaattagtcttactgacaatgcatgctaatcaggagcaattcacaaacaaaaccttctagagcaacaatattaatagcaaaaatatttttgaaggaaaatagtagaaatgtagataggtagttacatccattgaggacatataaaagggcacaaacaacaagaatacactaaatgccattttaagtggaagccaaagatgcagcaaagtgtgtgtcacggataacttgtcaagttaagatgggaaatgaaaaacacagttagcaaatatgaaaattcatccaaggttcaacttgtatcactgtgctaatgaaccaaatataaagtaacaacaatagagatgcctgaggtaattagctgcaacctcaggcattctttataaactggagagcatagaaattgaggaaaaagtccactttaatccactctcagcattcagagggggcagtctcacaaatagtagtactacaaactagtaataaatgttttgcatgacaatttgaatacaacattgctaggaacaaaatcaaaccattttcacatagataatatagccttttgaattgtaacatatgcaaccgggacaagtaaatggcgagtaggacactcagaacaaaagctgcttcacaggagtacgaagaagaaagaaagaacaggggtgcactcgatcttggaagaaagaacaaggcgcgctggattttcctttgttatctacctcagatgcgcaggggcccggacgcgcctgcggagcggttgccgtctaggcgactgggggtggccgaacgatccatccgtcctatagactccatcggcacagcggtcgtgctcggtgccgtccaggtgacgttccgtccatcggcaactgaaatccaagaaaaagtcgaatcaccaacacccaacgagaagtcatcaacggatgttcttgggcactcacctccgccgaactgggaaaaggaggagtcaccgggcgtgcccgtcgaggccttcttgacaggaggaccatgctagtcgctgtcaacggtcttgcgcttacggttcccgtccatctgggcagaacgtcgaacagctcgcgtgcgtctcaactctcaagaaccgcgaccaacagcgccacctaggggagatggcacggtcgggagggggccgtggaagagagctacgggactacgggagcgggggagggtggagagatggtgcgatcgggaggaaagggggacgtgcgaggagagacggtgggaggggaggggagcggcgccgacgaggacgggatgtctctcgctgcgcggcaggcaacgggacggggaatggatgggtccggacggattgagatgtgctgcagttaagaataggacatttatttggttctggttcttatataaaattaaaacgatacgatgaaaaagttagaactctacgtgtgtatgaaattttttgatgtgatggaaaaattgaaagtttgaagaaaaagtttaaaactaaactcggccctatttttacatcaagcgttcagatcttccgctacagtagtagcttgtctaggtaaaatcacagtaacttttttagccaaaaatgtttcagatgaccctgttacttaaaatcatatcaaacagacatgttgtgactgtttaagttgccatcgtactacaggctacagcggatccaggcgtatattgtggctttttagaatacaccctacaaatcttgaatttcatgtataaagaaatgatccaatttaaataaaaccactagtaattgacatcacagtattaaatttctaaggaaccaaatccccagcattatatattagacgtgcgtaatttatctccttcgtatcacgtgatcttttggcgttggatacggtcctttggaaaacataggaaataggattacaattttataggatttttttcaccgtttagatattattgaatcctataaaaaattctaaggaatgtctcgatccgcacaagtttcggagaagttttaacatgtgatccaggctcatggaaaatttcctttaaatctaccgatctctctcatccagtttatgtgtttttctcgtggtctaataaaaggataatttttcgtgctttttctatgttttccaattatttgtattgcacttgtattccttgaaaatcctatcatttttctattcccctgtttcttaatcttgtgatttaaagaacctaagattcacaacatttattttttttaaaaaaacaagatgaatctagttgttacgggcctcatcatttgcctaaagaaaaccagcagtgagaacggagaagccacaagtggtgtgggttgagggcggtgcggcactttggcaatctccctgcgaccctgccaaatatttcgcctatcgcctttactcccgcgatcttcaccgcgagttccggtatacacctcctctttaccgtagacccacacagctgagtagttggaggatagcgtgatgagagaaaaccgctaaaattgacttgtggagtgcttggtttggaggacatctaaaaatggtgtgtctgatggagactctgctggagtattattttctcgcctccatacaccaaacacataatggatggccagatagatgatctgctgggcatgctctaagcttatactccctccaccattgaataaaccaacctagtatacgatgtaaaggactagataaggatttgtgcatattcataatgctagaaatatcacatcatatattagattgtttattttaaaacacagggtatggtggctgttcgaaggcgctaggacaattataattggctgcacgctgcagccggtttgaactgctgcaggtaggctagccgaacatgtcctatagctgtgtttagttccacgtcaaaattagaagtatgaagaaattggaacgatgtgacagaaaagttgaaagtttgcatgtgtaaaaaaattcgatgcgacagaaaagttaaaagtttgaagaaaaaagttacaatctgtctatataaggtagatgcagttagctagacgttgagttgtgctagcacgagaagaggcgtgtaaatcgcctccttccacggtttgggaggtagtttcatccctattgaatcagcttacagccccacctgtcaataacctcttccatcctatcatcttcttcacatctcctctctctctttcctctacctcctctctcaccttacagcagcacgcgaggggcaaagtggacggccggcgcgcgcagggggagtcgccgcccggccagtcgctcactcttctcccccatcggtctcggccgccccaactcctcctcctaccgccgttggagcgtgtccccgtcctgccccaagcacaagtggcggatccccggctagcgcgcgccatcgtcgtcagggatggtggaggcggcgacgaagtgggcccggacagcctggccaaggacgaacctgcggttgtcgtcgtggggccagtcccatgttggcggcaacgtagagctagccaagccggcactgctgctcacggaccctgtaatggcgtgctcggcggagcggagatcgaagaagtagac

SEQ ID NO: 47005 - DNA, 6841 bp, Oryza sativa
gacggcgcagctggccggaccgtccaccaccatcacggccgcggataccagtaaccccggctgcggcggcggcggcacaggcaaggccaccggcgacagcaccggcacgacttggtacggcgactgcgggcagtacagctggtgcagaagcaaagaatgagaacggtgcaccgacagcagggtagaatgcgtgagctccggcgtcgagaagattggacgcggctccctgcataccgcccacgccgcttccacctccttcctccacgtccacggcagcatccagtcatccacccacgtacgtgcagaccgaatccaagaacccccgccggccggtcaccacgcatagaagagatcttctacgtcgcccccaaacctgaaggaagaatacaaggagaagggggatgacaggtagaccccacatgtggtaccacttttatttttaactcttttgatgactaggctgtcacgtcaatacatttagaccaagtcaacctgccacgtcggtgaaaaccgcttccaaaaccagtgaaggagttaatttgaactggtttttgaagttgggggagatgttatacccgtttttacagttgagggatgcgcttcaatcaagggctagagatgagggaggaaaaatagaattattccatgctcggttgaagcgcatggattcatgaaaaatagaattatttagagggcttctcttatgggcccaaaattgcaaatgcccaaaatagcttggagcccacgttgtcatttcaccaaaggcccacacagaaacgcagcccaacaacacggcgcggtgccgtgcctgtgccttgccttccccaatattttggcgggagaattcgcttccattttgcgcccactcgaaatccccaaaatccgcacgagaaaaaaggaaggggaaaatcgagctggagctggagccctagcggcggcgatggggcgcggcggcgggggacggtggaagaaggaggaggaggaggagctgaaggcggcgaagcgggggtaccgggaggcggtggcggaggggaaccgggaggaggaggcgcggtgggcgaacgtcatcggcgacatccacaagcggcggggggagtacgtggaggcgctccggtggctgcggatcgactacgaggtctctgtcaagtacctcccccagcgccacctcctcccctcctgccagtcgctcggcgaggtccacctccgcctcggcaactcctccgaggccctcacctaccaggttacgacgatccttccatttcgcatcacacgcatatgatcagatcacgttttctgatgcctgagtcgttataggcaggtgtaggttaagttgtagtagaatttccgcattgagttgtttggtctgccggcaaacaaatatttgctagtagtagtaccaatctgcattatggtttgtcccattttatagtgtatatgcaattatagtttgtttctgtgtgagttagtgctaaggtatgctgtagaagccactgtatcagagaattttgctcatctcaacgcccactatgctttgggccatttggtgttgcatctgtatataaatggtttagtcaagtatttgaatgtttagctgaatatcagattaagctgcatatactttgtgttagatttaattgggtaattgatccatttaaatcaattaaatcaaataaattctaaggctcattatgctaggaattcatgtgtattcattcttttatgggatatcaatgggatgaagagttttgagaattaatccatttgattagggaattggtaacttatatcaattagtcctaattgatggatggttgatggttgtgtagtggaggatggttcatggctagttgatgacaattagttgctctattcctcttcctattccattggtaacttacatcaattactcctaattgattgttggttgatggttgtgtagtggaggatggttcatggctagttgatgacaattagttgctctattcctcttcctattccatgactcttactcttcatcttccatttctcttataaaatgagaatggatttgatctcccgcaagaatagtgagacacactttcatccattttccaacgctgttgctgctacggtaatcccatcccgacgagtgtgtgcacacgcgttgggagagtaggcctccgaaaccacgtgctgctgcgacgtttgtacggacgggcgggcgatcatgtttttgggaagcgcaaggcgcgactactcactgttcgtcaacatctacttcaccttcaccaatatgtcgaacactggagacaacggcaacactggatacaaggagaaggaggctcccgtcaacaccaatggaggcaatactgcctcaaactccagcggaggaccattcttggggtataaccttcttacattatttcaattagaagttttactgttaatgttcatcgcaatgtcaacattgtgttattatgtgattgttgatgcttattctacattaagcatgctcatgttgattacattcaccactttcactggatcaaatcccattgtaaatatcatgtttattatcttgttattttggattaaaatatgccgaattatgaccaaatttccaacactttgatattatgctttactttgtcaaacttaaggtggactttgcttgtagaaatgtacacaaatggttggatcatttgctggactatacattttatattgttatggattcgggtatggccagtgttgagatgtatattttttctgctgtttatttgtgtggtattaccaaaatgagaaaaaaaatgtgaatcttgcactcactgtctgcatgtttggttagttggtgatcttattcaatctggctcaggttcgcctatgggttttgacccatatggttggtttagtcggatcaaatttgcatgtaaacctttgaggtgccaaccatgtgaatcagatacccttttatgtgaagtgagggggaatgcctaattgttagcatgtgttgtgtgtactcaggcctgttatagacttacgagtacccctgttcaaatctgatcatttggagtattttgttcactcaactcatggtattaagtgctgatctcctgtttcatgtcgtctgttggctatttttctaacactcaacataattctcttgttaacccaaagtagatgtatgttctttctattacatgaatccatatttctatttttcattgatgttttgattcttcacagaagaagcacttacaacttgccaaggaggctgatgaccttgttgagcagcagagaggtagcacccagcttggcagaacttactatgagatccttctaagatctgagaatgatcacagtgccattcggaatgccaagaaatatttcaaatcatccatgaagctagcaagggttctaaaggagaatccatcgtctcagaagtctctcttcctaaaggagcttattgatgcgtacaataatatgggcatgcttgaactggaactggataattatgaagaagctgagaaattacttgttcagggtctgaagatatgtgatgaggaagaggtacaccagtatgacgatgctcgcagtaggctccatcacaatctaggtaatgtttatattgaactacgcaactggaacagagccaagggccatattgagaaggacatagagatatgtagaaaaatacgccatactcaaggcgaggcaaagggatttataaatctgggggaggtccattcccgtgttcaaaagtatgaagatgcaaagctttgttacaataaagctcttcaaataacaaagtgcttggaagatgaggatgcactaatggaccaaatccatcagaatattgaaactgttaccaaagcagccaaagtacttgaggaaatgaagatatacgagcagaagctgaaaaagcttgccagagacacttctaatgctcgtggaacatctaaagagaggaagctcctccttgagcagtatgcttggctggctaatcttatggagaaggcaaggatgataactgcatggccaaaagtaagtgaggggtaactaactatgtgatctttagccacaaatattaactttaaagttggatctattttctgtttatgatcttattttattactgtttttgttagaaaaagaacctgattgcgttattccattagttaatgcgtaaagttgacttcctcagtcttttattgtgggggattgttctgtggttcagggaatagtgtcttgttgctttgcctgatggaagtatcgatgttttctgaagcttattgttggagttagaacttaatatgcattaactaataactatgtgtattcagtgcttgcattattgaagcttcaactctgctgaatttgttttgcactaactcctttacccatatgaaattatgtgctgactacatgtaggcttttgcctgcatttgcattatacttagtattaacatgaaatgctcagttgttatttatttatattccattgtagaacacaacacagtgttgtaattacacatgactgtctggttgagtttttctctacataattgcttacaagtcttacaaatatttcaatagtcatcttgattcccatgtgtcttgttggacaactgagattaaccataaacttaattaactatagcatcctaagtgagtccagctacgattagtagaatctatggaagagaaggaaatatgtaaagaaacaatagctcaattttgtagtgtttttagctatgtttaatgccaggttgttgaaaggaaaatgctttagtaaattatcttatttggtcagagttgttgatgacaagaaccaatattgaatgatcattgcaaaacttattacttatgtacacttgtacagtattggcaatgaatgatctttactttcctgtcacaccaacagtttgaaattggccatcattatcagagctagataaaactccacgatgcagagttctgtttggtgtattttatggtgttaggttttggaaaatgaattgttcacttcatgtacttcttgagttctgggattgagattatagaacacatgaaaatcaaaattaaaaaaagatcaggtcgaatatgaatatgcatacccccgataacgtagacaaggcactgaggtgtgattaaagaagaacacatgtctcattctcatgtaatctatttgtttcccacagctcaaggaattttcgaaaggacaaaagagggtagcaaatgaactccatgacaaggaaaaacagagcgactctcttttggttataggagaatcttaccaaaagcttagaaacttcagcaaagctcgtaaatggtgcatgaaaagctggaatatgtatcgatcaatcggaaacttggaggtgagcttacatgtccttaaattcatggacatgctgccatgtggcatgcttgctagttgctacctagtaataagactactttcctccttgcactcatttacttggagcttccagtttttgaatctctctcaccttggatatgtgcaattttagggtcaagcattagcaaaagtgaacattgggaatgttcttgattcttgtggtgactgggctggtgcgttgcaagcttatgaagaagcatacaggcaatgtctctataccttgctcttgtaattccatatcaatattgtcctttgcctgcattcgtgtgatctatctgataatagttccagacttctactgagtgtatacatctctccattggggcgttttaatgccacctttggattctgatacttgctttttaatggtattcagaattgctgtgaaaggtggcctttcaaacgtgcaactagatgcccttgaaaacatgcattacagtcacatggtcagatttgataacattgaagaagcgaagtaagccactgagcacatacactgcacaaataaagtacggaatatacttattaaaacctgttctaaaatatattctataacttcagaaaactgcagcaagaaatagacaacctgaagagaatgtctgatcaacatgaagcaagggatacagttagtgactattgctcagaaactgaaagtgaagatggcaatgtatctgataatatcctcaatacagaggataatgatgggaatattgcaaataatagttctgaggaatttgatgatgatgttgttcttgcctcacttgttcataaaagtaggtcttctaagaccaaagcatctaagatgcatagtagtacaaagaatgttgatgggtcatgtggcatggatgagagccctgaagaagatgtaagtaaatcatttagcaaccattatggtagaaagcgtgttcgagttgtaatatcagatgatgaagctgaagaagctcctgaaattgatcagtcaaaaagaacacttactggtcgagcagatagtctgtctacctcaggtgtgcctcttgacttatgagtacaccatactttcagtagttgccgttggaatacaaaatatttttcttctaattgtgcgatacattttttctgtgtccaacagagcgaattgcaaatacagcaaacagaaacagaaatcaggttatacaatacataatcccttaaaactttgttattggaaggaatttaagatattcattatttgcattgcatcaattgttctcatttgttccattagatattgacaagaacttactgttacaaaacactggaaactgataatcagtgttcatctgcagcatacctctcatcccattgagaccagagaagtagacagtgtctgcactccctgccctgctgaggaaagtatttgttcattcaaatctggtagtcctgtttgtcatggtaatgatggcccagatttaggagcttctagca

SEQ ID NO: 47006 - DNA, 22665 bp, Oryza sativa
  unsure (1)..(22665): unsure at all n locations
ccatgctcatgaaaagcaggcatcaactattctttcccattgcttttgttcctactaaaacactcctttagagaatcctttatgaattccttggctgttaactttaaatgttcacgaagatgctaaaatacattagaagagatgaatatgttaactgaacattttctgttctgatatctaacattaattctgggaaggcatatttcttttttgttgtgacatgggccagaggtttggaccaaataaaccttaggataagctaccatgtgtagctgaagctcactaacaaataccggcaaagaaatcaaccgctggtagatcgttgacatgtggacctaccatcaaaagatactgctaccaccctttatgtgtatcacttctaccatgttggatggaccccacatgtcaaaacctctatcaagttcttttggagttagcttcatacaatgctcatatcatatttgagtcaagtagtcaacctaggattaatgttcacctaaatgtttcctttctctcaatattgaagttatgtttcaaatgatttatccagggttttagtcacattatcattgattatgacaactgttccagttattgaaatatgattgatcctaacgtgcagaagttctgggtgttcaaaattggtgaacatttggtttacttggacgcaaatgcatgtacacgtgagggtgcctttagcattgagtctcttaaagttgaagtggcatgcgtgtactatcttcagattcctgatgataagaggtccaaaggtttgtctccttagtttcagtaaattacatggtgtgtccatttaataactgtgaactactttttatcattagaaatgggatcaaatttgcaattcggtgattttgctgttgctgttctcatcagtgaaatagaacatagtttcttcattttaatttaaattgtggtaggtggagggttgtaaaacttatttgaagctgtttccatgtcattgtagttactgtacagtcttaattgttgaaagaatgtagaatgccaatcatgtgtcattgccttttttcaataacttttatgagttatgtttatgggttttactccatgattacttcagctatgtctataaatcatgcatgcctagtgtgatgcaggagacagttgtgctggcttagtttctacgttacttgcagttccatattattcgggaacaacttcctttttcttttctgttggaacttacatttatcttgctttgctaggtttgttgcctattattggggaactcaagtgttgtgggaaggtactagatgacacagactcacgagattatattgatcaacttgcctctgaacagaagtccattgatgttgttattgatggtatggttgcctgtagtcatctgtgttgataaaactgctattgttgcatcaatgctagtattggtaatcactgtgatttttccttctttattgatgacatgtaatatgctgttatgcattgaaggacatcaagtcattgattgaactgagtacagtacaatatcagtgtggtttgttcttcatgctactaacctactacagtgggtttcattttttttaaggaagtcacaaaaagatttgtgtatcattgcattaaggagaaaagttactacattgggattcagaagagattgcccaataaacgaatagcagaaatctctggcaaactactgtttatcttaacttcagaatccttcctatcctatcattacataaaatgattattactagtaaaaaggggataaatcatgctggtttactgtcattattaaatattagtataatattaatatctaatttttgcatcaaatcttctccaaaccaagcttctcatatgaactcactaattgaggctttcagcttctctgctcaaaatcaagtattggagtacccgcttttttttttntgcattatgtatgtgttttanaatgttgatggtgtgcatatgtttgtcacatggtgatccattttaggtctgtatatggcactaaactccatgtataggtgtttggtttcatgggtaaactttctattgcattccaatgcgtcgcactgaaatgtaatgtacatatttcctatagttatacctcatctgatataccatgtttataatgaagattgggtgccaaagcggctgatgaaattgtatgttgatttctgcacaaagttatcagaagcgccaaacaagaagctcttaaagaaattatataatcttgaagtaagtttgttagatttgtatcattcatatttgattgacaatgttataaagtggcttattatttttgaagagtcaaagtgttcatgcctttctattttttgacaggtctctgaagatgaagttattgtgtctgattgtggactccaagacctgtcgatcacaccttttcttgatgctctaaaattacataaaacaatagctgtgttggatctttcccataatatgctaggtatgctttttccagtatatctgtttcttctcctagtttgtcttatgtaatctatgcaccaatgatttggcgacatcacagaaagccagttcaagctaaatgtgtgtgtatcatattaattcctctatgctcttacaatgactaaagtttatgttcacgaactgcaggaaaccaaacaattgagaggcttcaacaaatattttcttcatcaagccaaacatatggtggcttgacactggatttacattgtaatcgatttggtccaactgctttatttcaggtctttttactatccctaaacttgtttatcaaagtgaaactacaggttatttctgcttttgaaagctcaaaaaaattgcacattaaaatggactggatcctcttctacaataaaaggaaaacttgactcttggggagagatgttccataagacttttaacaaggccgagaaaggcccgaactacaggcagtccttatgtctactaattctttgggagaattcctgttgaaaaccaatttaacttttgcgatatctctctttagtcttactgtttgagaaatttagatcactaaaagctatactccattacttactttagactcaactgggaatgtgctataacaagtactggttgattttctgcattgagattggatgtccctcttagtcgcaaatctcaatgatcctgttaaaaccaactgaaaccatttggatggttctaattccatactctgatgaaactggagggttgacccctttatcagaacaaactattctttcactgcctatcagaccaaaataagctgtcttgctttcaggcacatgttcattttaggaacagaattctgaaatcatttgctccttatttactaatacagatatgtgagtgtgctgttatgactaatcgattagaagtacttaatctgtctgggaatcgcctcacagatgcatgcggttcttaccttttcacagtcctacagaagtgcaaaggtaggtactgtttttggcactttctgtgttttcgccagccttctttttctttgatggcaccagcttttaattacctcttatagaatgtgtcttctgtttacatatcgtaacagcactgtacagcttgaatgtcgagcaatgttctatcacatcaagaacagttcagaagatggcagatgcactgcatgaagggtctgtcctttcacatctctccttaggtacttttattactcctgctctgcataattgaaactatcagatatgtttcataaacattcttatgtttcaaactttcatatttttgacaggaaacaacaatccaatttctggaaatacaatgcttagccttctctccaaacttgcctctctgaaaaggttcgctaacatttgttcaattactgttgatacctattgggaatagatgtgcagtgaaataatggatagccatcatcactgcaggttttcggaactaagcctgactggtataaaactgaataagttaatggctgataagctgtgtctacttgcacaatcctcatgcttatcaggatttctgctaggtggaactaacattggatcagtgagtctgcttcccacgcatggttaagtattttcagattgtccccacaaaaaaaaaagtattttcagattgtacaaacaacattcttcttatctatgaagcttttttttttttttttttttttttttttttttttttttgtagggaggggcaactaagcttactgaggcactctcctgtgcatcacaagaattgctgagattggatttatccaactgtgggcttacaactcctgatttctcacaactctagaaatctttctaaaattaatattattgacttgaaccttggaggaaattcttttaccctagaggtttccttcctattctcgaatgccttgatatacttatacaaattctggtaaccccaatggtttgacttacgccgtacggtgcagggatgtgaagctattggggtattgctttcgaatccccaatgcagtctcagatctctcacccttgatagatgcaatcttgggcttgctggcatcgtgggcattattcaagcactagcaggtgaggaacgaccactacataaaaattaacaaatatgaaaagtttctgcctcaacctcaaagtctcgtgctactttcaggaaatgaccgattggaggaactacgcattgctgagaacacaaacctggcactacagagaacattgcagtacgatgaagacgcgcaggatgtatcaccaggtactgaccaaaaccaacgtaccaatgctgaagcgaacgatcgcatagaccctgataagatggaggtgccggatagcgaagacgaagaggcagtctacgaggatacccgtgcagcgaccggctcagatggaagctgtgcaagttcatgccagagaaactcctcttctggttgccatgccatccaagaactcgctgatgccatcatttctgcaaagcaactgaaggtgctcgatctcagtcggaacgggttgtcggaagaggatatccagtcactgtattctgcttgggcttctggccctagaggtgatggaatggctcgcagacatgttgccaaggaggtggtacattttgcggtggatgggatgaattgctgcggcctgaagccctgctgcagaagagacttgcagatgtagtatgcctggtcgacatccccaaacaccaggttagagttgctctctggaaatattattattaccacagtaaattaactagggctcgtcagtgtaattcaatcagctgataataatataatataacaataacataatacaatataaaccaatcggctagcaatgatatgatagaataagcattgatccgaaggtcaaaacatacatcggctggaggtccgatgtcataaaatccacagattagattaaacagtgaaacctttgttgtcatcggctaaatccaacatgtatacaatccttataagccgatgcaacgtccagataactcatcggctgaaaccccgatgaaacccttattggcagtcaagaagcaggctagatattatggttctaagcacgacttagtagatcaaacttaactgatgcagcactaagtatgaaaagaaacataatatctagacaatcaagctgttgactgagttttcagggtggtagatgtctaagctaatctaatctagcaaggcgatttagccgataccggcataaaccctaaaacgagaagcagccgatagagctaaattgatatgctaagactagattaacagagacatgataaataggtaggcaaatatatcatccaaaccagagcaatctaagaggtcgaatgtactgatgcagccttgaacaacgccggcgcagacgatacaattgcctgggccgacggaacattggacttaccccttcgccggagatcgaacaccgatgcagccccgcgtcaggtgccaagtcccgccggacgataaaataaagtagaaaaggtaaaagggtggcgatgcaccgaattgtattgatcgtagagatagattacatagaccccgggtgtacatatttatacccatagggagatacaagtccttgtcggacaagaaagaaactaaaaaggaaccagtctttgtcggacaagaaagaaactaaaaaggaaaatataaagtccttatcggacactaaacacactttcctaaagataaaatgaaactaacaaactatgcctaattaatagataaactgtcatgtcgcatcggtcttgaactcggactcttctagataagcttcctttgattgatccgactccaccatgaacacgacatcgtggcgacttgactcccatcggctgattctagaactttgaagctgatactgactctaagccgatggtaactttgggcttaccaaatttcactgttaacacatgccccccagttttggagtatgagaactcatgcttcaaaatttcttgtcttgataactccaaaaccgatcttcctttgcttcgtgcaatcggctttcatgagccgatattgtttgcattagatgagctagactgtcaaactcgtggcaaaagaatctatctccgataggtgctgacaatccttggaatgcaagatctactagctgttcattgcttaggctcaaactataacatcggctgcggacattacgaaatctctgaatatattccatagccgattctcctttttgctgctcaactgatattaagtctgaaagcttcaactcgctgaatccagcaaagaagtagtcatgaaattgcttctcaagatcggcccatcctctgatagaatttgatggtaatgatgaaaaccaagtgaaagccgatccagtcaaagacaatggaaaaaacctaactttcagagcctcttcagtcgatgcttcaccacattgcagtaagaatcggctgatgtgttcaagtatagatgtatcatcttgccctgaaaacatggagaaatctggaatcttgtatcagtgtggaagtggaactctatcgaaccattcaggatatggctgccgatacatatggatccgttccttaggtctaattccaaactgctcctctactaattttgcaattctatcggcccaatcttctatattctgatatctttgagattcttctggccgatactgttgatatagctcatcatgctgacattgatgtgtctgccccccgagccgatgctgttgttgttcttcaatctgctccctgagctggcttttctgaataactcatcaactgttactttgatcaaattttgtaatgtatccgccaaaactccagattgattaaacaatgcgcgatgaactgcgtcatcaactgtatcttgaagtatttcaactatcggcttgggaaattgagtcttctgagttggcccttctggtgtcatgatgaaacattgaagacaacgcatttgaaaatcagctacaaactgcttcatctgttgcctttgttcctctgttaaattctacattgtgaccatgatcttgacattgacttcttcttcagacatgtggatataaaattcgtggtcccactaggcgtgccaatttgtgttgacgaaaaaaatcaaacacaccggtctgggagatctgcttaactccagtgcaggtccaaatatgatgagatgcgggcgtgccagtcagtttgatcttgcaactgacaagatatgcaaataataaacaaaacagccgatcggctgacaagccgatgctgcaatctcagccgatatcgataatagccgacgccgataccagccgatagcaatagggtttaagcgatcggctatatgtccaatatagatgatgatataaatgcaatcggctgataataatataatataacaataacataatccaatataaaccaatcggctagcaatgatatgatagaataagcattgatccgaaggtcaaagcatacatcggctggaggtccgatgtcataaaatccacagattagattaaacagtgaaacctttgttgtcatcggctaaatccaacatgtatacaatccttataagccgatgcaacgtccagataactcatcggctgaaaccccgatgaaacccttattggcagtcaagaagcaggctagatattatggttctaagcacgacttagtagatcaaacttaactgatgcaacactaagtatgaaaagaaacataatatctagacaatcaagctgttgactgagttttcagggtggtagatgtctaagctaatctaatctagcaaggcgatttagccgataccggcataaaccctaaaacgagaagcagccgatagagctaaattgatatgctaagactagattaacagagacatatgataaataggtaggcaaatatatcatccaaactagagcaatccaagaggtcgaatgtactgatgcagccttgaacaacgccggcgcagacgttgaccaagaaaagcgactcattgattgacgatctacgggaaacgttcgacaacctgcgacgatatcgcctcatgctcaacccagagaagtgcaccttcggagtaccgtcaggcaagctgcttagcttcctcgtctctagcagaggaatagaagcgaatcccgagaagatcaaggcaatcgagaacatgaagtcacccacaagacttaaggaagtacaaaagctaaccggatgcatggcagcactaagcaggttcgtagctaggatgggagaacgaggacaacccttcttcgctctgctaaagaagcaagataaatttgtatggacacaggaagccgaagaggcatttattgcactcaaacgctacctatcaaatccccctgtactcgtcgctccccaacctaatgaagaattattcctttatattgccgccacgccatactccgtcagcactggcattgttgtcgagagagaaagtccaacgaccagtctactatgtcagcgaagctctccatgacgcaaagaccagatatccacagatccaaaagctgctctacgcggtaatcatgacatcaagaaagctacgccactactttcaagcccacagagtcacagttgtctcctccttccctctcggtgaagtcgtgagaaacaaagacgttgtcggccgcattgcaaaaagggtagtcgagctaagtcagtttgatgtccactttgtaccacgaacagccatcaaatcccaggtactcgccgattttgtagccgattggactatgcctgataaccaatcagacaaccagatcgacaacgaaacgtggacaatggcgttcgatggtgcactcaacagccaaggagtaggggcaggattcgtcttgacatctccttccggagatcaattcaagcacgcaatccacctcaaattcagggcaaccaacaacacagccgagtacgaaggactactcgccgggataagagcagcagctgaacttggggtcaaacgactgatcgtgaaatgggactccgagctagtcgccaaccaggtatacaaagattataaatgctctaaccccgagttatccaagtacctcgcagaggtcaggaagctggagaaaaggttcgatgggatcgaggtccgacacgtataccgcaaggacaacatcgagccagacgacctagcatgacgtgcatccaggcaagaaccactcgagcccggcacctttttggacatcctgacaaagccatcagtgaaagaggccatcggcgagattaacacagccgcccccgacatcagctcggaggtcacagaggcggaacacgccatcgtcgatatcgagaccacagatgactggcgcaccccactgatcaagttcatcaacagcgaagagttgcctgaggacgacgcagaggccgagaaaataacccgtaaagcaaaaatctactgcatgatcggcaacgatctatacaagaaagcgccaaacggagtacttctcaaatgcgtctcatccgatgacggcagacacctcctcctcgatatacatgaaggaatctgtgggtcacatgccgccggtcacacattggtcgggaaagcttttcgacaagggtttttctggccaaccgccctcaaagacgcatgcgacatggtccagcggtgtgaagcctgtcaattccacagcaagcacacaaagctacctgcacaagcgctccagaccatccctcttacttggccgttctcgtgctgggggctagatatactcgagccattcccacgaggacaaggcggctacaggttcctattcgtggcgatcgacaaattcactaaatggatcgaagcggtacccacgggagaaatcaaggccgacaacgccatcatgttcatcaaggggatattttgcagatacggactactgcatcgcatcatcaccgacaatggctcccagttcatcagcaccgatttccaggattactacatcgggctgggagtcaaaatatgctttgcttcggtttctcatcctcaaagcaacggacaagtcgagagggcaaacggcatagtactacaagggattaagacccgcgtctacgacaggctcatgtcacacgacaagaaatgggttgaagaactcccattagtactatgggccatacgcaccacaccgacaacgtctaacaaggaaacacccttctttctcgtgtacggctccgaggccatgctcctcagcgagctatgacatcagagtacacgagcacagaagtattccgacgagtatcaggaggagcagcgaaacgacaatgtgaatctactcgaggaacatcgcgaacgagttgccgtccgagcagccggctaccaacaagccctccgccgttaccacgagaagcgcatccgagcacgcatactttcgatcggcgactacgtcctccgaagggttcaaaaccaagcaaggcgaaacaagttctcacctaaatgggaaggaccatacacgatcacacaagtcttgcggccaggcgcattcaaaattgcagacggtgatggccgcgagttggcaaactcatggaacttttaccaactacgtaaattctacgtatgagtcaataccacccatacctgtaagacaccttacagtatcaataaagcctattttcaggcgcatattacaatcacagtgttcctgcctgatgatccctcacccagatgacacttagcgttgaaacctatcctcatgtccctttatgccatgctgacaaggcctccaaggaacctaagggatcttcggctggggacgcccagagccgataaggccttgtcggattctgtggagacgaaagaccatgtcagacctggtcgtgtaagagttctccccgtgcgtattaaccaagtcgcataatcggaaatgaactttccaacttcgcggctgggggttaggatcagtgcttgttcaaccgaggcaggtcaaaggtccaagagccatgtcctccgagaagaatcctccgacgacaaggctagggtctagggagagtgtacaactcaaacgactggccaaagtcgggaactgaggaggcactcttacacactacatccagaataaggactcattaagatagatttcttttctatttcataagatacttcttacaatttcacacaagtccaaaaccatattacacttttccctaagacgtctatcacagggtacaaaggctaccaggaaggccaacaccagtccattgactggaaaactttctccgccagcggcgccatcgacttcgccaggccatctatctccgtaggagtcctccgagaacgtgaaaaaccttcgcggaggaactcgaggtgcagctgcggacggtgatctcgtatacaggccaacacgtgtccttcggcataccggcttgagcgacgacactcctgcttcaaggcctcgtcgatgcgttgaccaataccctcaagctgagcgcaggctccgttcagccacgagaaatatccggctgcggactcttcgggatccccacgaggtactcagagctctctgcagaccctcgacatggacgtgcaacaactcttcagatacgagtcgaaccacacctcgcggcctcggagtgcctctacggcctggtcctttctcacctccaacatggctctctcgagttccgcgacctcacacttcgtcttccaatactggatgcaacgattttggtcagcaagcctactctcgagatctgctcagcatggaaacaactaagtcaagctgctcttctcttccgagaacacagaaaatcaagtcactccggatagaagtataaaggagatgaaaacaaagatcaccaacttagggaagtcgtcgccatacccgtattcacgggcaaactatgacctacatcgtcctgggacacatatggttggagcgcaatcgccgggacgaccaccggtaactcgggctgcccacgctgctggacatcctcaacatcgacatccctacaaacgacaaccaaaaatattcaggaccaaagtgctaacggagaccaaggtgacggctgcacaagcaaaggcagttgaggccaacaaaggttttacaaggcataaccgattacaaaggaactgaggtcctactcttcaaaaagcgggagaacagactctcccagctcgccgatttcctccatcacgcccttacgcgcgtcgttggcggccccccaatccaagatctgccgaagatcgagttcggggtgtgccaaccttacacacgcaaggacgtgacaggccccggtatagatcccattggacacctcctccgcgatcctggccgcatgcttggagggtatcgcctccatcgccgttgccagttccgcgagtgaagacgtcagcgagaactcgtcggagttcgccgggatggttgtcgtaacaccacattcctcggcgagctagtgtaggccggtgtaggtgacccgcaacgagccacggatctccgacaagttgttcttgagttctgacatctggccctcgagtccccgccgttgtcgctcgttgctggccaccagctccctcattttctggaggtcctcgcgaacctccgccaggtcgtgctccagcttgtcggcacgctcgttcgctgacgacgctcctgctaccctcgcctccgcaatctcgcgacttatgccgcgaacaccagcctcgaggatgcgccccatctcggcttgaaactccccccaggtgaggacgtcggcagacgggccgcgagtaggcccgaggtcactggctggcctgctcggcgtcgcctcacggctcctcggcacgaccacgacatcggtcgaggccaccgcaggagatgcgctggagttccctccggacctgtcttgcgccgccttcgcctgtgtcgacctgcagaagatcatcatgtctggccctcgaaacaagtcgccagaaatcaaacaaggtaaaaatctcgattttcgtctacttacttctcgcccagcgtcaccagcttccgccatcgcgaaggtggcggagacgcagccacggcctaagtaaaccaagtacgaattgagggtgacatctttcgactatgcagttaacgaatcaagaaactcactgatggggaggacgctatccggcaactgccgagcacggaggtgaactttctccctatccttgggacacggctgccactagtcgtagcagcaacggccacatcggacgcctcctgagcgacgccctccttcaacgaggccgccgcctggtggtccacgagcagtccaatggcgtcagtcagagggagagcctgcatcgcataaagtcattatccgatccaggagcaaaaatgaaggggttgccgactacactcacgttgattgcggcttcgcgctcggtcgcctccttctcaaaaagaggaacggggacgtcgtttgccgttgtcgggccgctgatcatcaattggccaacgcggcgctccacggtggcgctatccaagcctgctgatcgagaacagaattcgataagttagggagaacatgcgcatgagggagtcaatttaactaaaaaggaaaataccccgaggagaaacccgggtcgcgtcctccggcccagaatagtcaaaggctgggtaggctcgggcctggagcggctgtatccgcctaccgacgaagttggtagcgacttcataccccgacaaacctcgtactcggaggtcgtcgatgccatcgatgaaggactggagggaaggggtcaaggcgggctttgcggtccaagacgaaatcttgtctggttgttcctcggggatgacaaagacaggatccgaattctctatctgaagatagaaccacctcgcccgccatttgctacgagaagaagggcactggaacgggatgtagcacgatttcaagccatcccgaagtcggaatccgacgcatccggacaccctggtggattccatccaacgcaactcatagtaaaagcggaagagatcgagaaaaggctctaccccaatgtaagcctcacaaaggtgcgcaaatatactgaggaaggcaatggaattggagttcaagtggagcaaagaaaggctgtagaagtgcagaaccaatagaagaaattcagaaggtggagggagaaaaccacaaagaatgtagtcctcgatcgcaaccatgcgacctaggacaggctggggttcagtaactcctacttctctctccatgactccacgactgggaagggcgtcctcttcctagagtttcttcagcgacgcgttggtggaagtagacttgccgagatccatcgccaactagagatcgtcggaggaaggacggagattaacaagcgagggtttttatgggagcggggaagacgagggacgcttggaggctggaaagttttctcacaaacaggcagacttcagaatgaatccccaaaattcccttaagtagacgcacttcgcacggcgcgaatttcaaggaaaggagagagatgcccgccggaaatttctgggtctgttacgcgcggcggtcttttagacttcagtttaaattcactcatgaccgttgggtttcacatggtgttctcgactatgtcctgtctctatggtttctacaccgagaacgacatcagcttcgacatgagaagtcgcgattggtcacacgagttcatttaagcagaagtcgggggctactgtcagggttacgggttaggtataccctttacccttcgatatacgtcacatatcaatatggcatgcccgcgcatgtagggacattctctatacgtgttaaggaaatccttcacggaattggcaaatggaaagagacctactcagacaagattgggttgtcaacgtatcgtgtgcggttcgacgtctccgagtcctgcttggagaccgcctggcctgcgatataaaagggacccgctgggaggacctgcgggatcgaatctcacagccaacgccaccaccacagcctacgaagtcggaccctacatgagccaaatcgctgggaggtctagtcgaatcaactcgattatgatctcgccggtttcatcgagttccatcgttccctttgtaacctgtgattcccatcatataattccataccaactggattagggctattacctgtcaaggggtctgaaccagtataatcttcgtcttctgtttgcttgatgtcgtactacatagacccttacatcaacgtaccccaataccctctatatccgggtatcacctgtcaacagatataatgaacgtttggttgaaagtttggttgaaattaaaacgatgtgatagaaaaattgaaaatttatgtgtgtagaaaagttttgatgtgatgaaaaagttaaaagtttaaagaaaaagtttagaactaaacaaggcctttagtagatataatccgtacaacctattggagttaatttcgtggcagtgtaatttggctttgcatagcagccacaggaaggcaaagccacacaaattttgataatttgacactttgaaaaaactaattttacaaatgaaccgtcgctaaaacttatttcaaaaatgatcttttttttccagcgccaaatcatgcgctgaccttagacacctcagcgccacgtcatctagcgctgaatgtcgtgccaccgcagatgggaggctaagtcagcgtgccaacgcacattcagcgtcacactatttggcgctgaggtgtttaaattcagtgccacacgatgtaacgctgaacaaaagggttatttttaaaataagttttgatcagttcatttataaaaatagtttttgcaaagagtcaaattgtcaaaatttgtggcaaagccaaacgggccagcacttgctcaccacgcagcgctcgtcggccgccagctcgcgcggtcgcgcccatgtctctttaatcaaaggagacagtgtagaaaagtttaaagcaactgcagatttttcttgaaaaaaaaatcttcctctctacataaaaatgtaaattagaaatcaaaatctcagaagcacatttccttttatttgtagaaactaaccatcaaccaaccaactgctacttaaagtcttgtactcatcatacccctccgtgctctaatataagagattttgatattttacttacactgtttaactatttgttttttttaaaaaaattttagaattattatttattttatttatgacttactttattattcaaagtattttaagcacaacttttatatttttatatttgcgtaaattttttgaataagatgagtgaccgaacagtgcaagtaatatgctaaaattccttatattaagaaaacagaggtagtataatagagccacaggtccatacaaaagcatgggatcaaccgatcgaatgcaatgcaaacggtcatagtagtagtgtagtagctagccacgttacgtaaagttacagcgcgcgtgcgcggcgccgcggcagcttcttttctccgcggcggccacgacaagcccgcgacgtgcgtgcagccggtgatgtcggcacagcgtggcgccgtggcgtgcgaacggtgaaccgttgctctagtctccgagattccacccagctaaccatggcccatctatcccgcgttagattttgtctatcgtctatctatggtcaatcgtcgtggtcgtcggccgctcgctgccgtacgtacgtttgtagtaagaaaatatgtagtgtccattgacgacgatgcatgcaattttcgtaattttgctgcgtttaaggcagccaaccacgatatcatattaaaatatataatattttatgttagatttatttatttttgatacgaaagaagtagctaatataactggctatgttattgtgtgccaatttatggtgctagccagtaagactttgaaattttcttacgtcgtacgtgtatatagcttttttttctttttttaaaaaaaaactagcgcacacaaatagtcttatattggttgtagaaaagcaagaaatataatatattagtggagaaacctttcatctcattagctatcttttacaatcgtacgtagtcgacattttgtctgtgtagtatagtatctacaatacattgaagtagcacgagatagaaaatgaaaaagaaaatattatatgtgttgagtgtgtacttcctggaatcaaccgtagtaaaaaaggctatgccctcttttaaaggcgcgacaaacaaattgaacgcatcactgcaactctatgcaagttgtcaaattaatatgagccctaaatataggagtatatgctactccctccatttcaggttagaagatgttttgattttggtcaaagtcaaattattttaaatttaaccaagtttgtagaaaaaaaatattttcaacccaagataaatttattatgaaaatatatttaattattgatttaatgaaactaatttagtctagaaaattaagataggagtattttcgctctcatggtctagaaaatcccacattaatcgaaataaaataagaaaaaagagaaaagagaatcatattaggactacaatatgtggaagcggacaagaaaaacaaagaaaaaaccaaagaaaattaggagtacatgcaaacggacaaggttttatttagaaacaggatgaaacaccaattttggaaactgtaagagatactaatagtaaccgtactcatgctatcatgcatggccgtgggaggcaatttatttgtccctttctaattgtacaatagtgcatgctaataaatacattacagataattacaagatgtcactaatagtctaaaagagtataaagatggagggaggaaacaaacaaatataccagatgatccattatatcacgtttgctctatagacataggaattactatattaattagaatatcgtagattggtcgatttggttcagcatggttacaatttcaatatttttctacaacaaaatatgaaagaatatatgttattacgtgaaaagattatagcaatgctaaccatgcaatctgtacgggccaccaagtctactctcatggcctagaaattctcatattaattgaaaaaaaataaaaatagagttcatatagaaatacaatttaaaaatagcaaaaattcagaattaaagtaaggaatattgaaagaggatattagagtccatacaagtatatagtttagaactaattaaaattcggaattaaaaattaggaaaattaaaaatagaagtcagagtccacatcaaaatataatttacaataactaaaattcaaattaagaaaagcaagattgggagaagagtatagagtccatataggaataaaatttataaataactaaaattcagaattaaaaaataagaaatattagacaaaaaaaatctagagtctatataggaatacaatttataaataactaaaattcaaaattaaaaaatacaaagtattgaaaaatgaagttagagtccatacataaatacaattagaaataatgtattgggaattagaaaaatagaaatattgaaataagagtctatagtacatagtacatataggaatatagaactaactgaaagtcagaattaaaaaataagaaaaattaaaagtagagttaagattccatatagaaatacaatatagaacaacaaaatacaaaatttaaaaaataagcaagattagaagaagagtctagcgtccatatagaaatgcaatttataaatatctgaaattcggaattaacaaataaggaatattgaaaaaatagtctagagtccatatagaataaaatttataaataactgaaatttaaaaaataagaaatattggaaacaaatatagagtccgtataggaatccaatttaacaataacggaaattcagaattataaaataaggaatgttgagagaagagtttagagtacatatagaaacacaatttacaaataactaaaattcggaattaagaaaattgaatatgtgaagaagtgtccagagttcatataggaataaaatttatcaataataaaattcggaattaaaaaattaaaaatattgaaagatgagtctagagtccatatagaaatacaatctataaataactaaaatttaaaattaaaataattaataactattacgtatatacaatacaatatgaatatcacacagttgttagtttgatcaagaatttaaattatgttgccattttaatgtatttaataaaatgtgaatatatttaagctattatatgagaaaaatataacggtgctagccgcgcaatcttcgcgggccaccatgctagttgtattaaaagtagataaatatggatggaaattaaatttattttaagacaaaggtaagctagctacacgatgaccgagctctgccaactgaattttgttggcaaaagaccatactacgcaacacaggcaaatttatatagcgctagctgtacgtggccaactggctatacatacgtgcttctcttcttcttcttcttcttcttctttttttgaaacgaaatatatacgtgcttctccctcctcggctcctcctactcgtgccccacgcgcgctgtaacgcagtcccgctcgctgccgtagtcgtgtgggcaagaaacacacgtacgagagtggctttcggccgtcgttttcgctcattttgtacgctgcagataggttgttgtcacgatcccgatcgatcggtacctaactccaaaatgtacacgctctctgcgccgacttttcttaccacctccgtccaaaataaaggtaactgtggatatcaatgcgtcgactttttcttaatacctctgtctaaaataaacttaactgtggatattagtgtctaacatttgatcttcaacgtttgatcatctgtcttatttaaaaatttataaattatttttaaaaatagtcacacataaaacacttttcatgttttattatctaataacaataaaaatactaatcataaaactttctcaaatacaatgaatggttaagtgttggatataaatagtgtaaatatatttgagacggagtaagtagttattacagcgtcgactttttctttagtacgtttctctttcaattgttcatgtgcactacgtacgtatactagctaaggaagagataagcaaagtgttttgccataactgagtgctcagattgcgtgtgatctggactggtccgagtccgactctccgacccaaatctagctggagtgcctatttgtagtggacgtccagcagatcacggctctcgcccgtctttgtactccttgcaaatccaacacgcctcgcatgttgcgtagattaatcgtatattatgtcgtaactcctacatctgtgcatgctacttcaaaacgtgacttaattggtttactccgtttcatattataatcggtacatatttttttttaagtcggtcaagtttatagttaaatatagtaacattttcaattcaaaacaaacattgcatcaaaatatattcaatgttaaatttaacgaaactaattttgctcatagatgttatttttttatataaaattagttaaattaaaaaattatgattaagaaaaaatcaaacgacttataatattaaatcttgtacgtactatactatttgactgatcactaacactcttcccgtttcataatataagggatcttggaggatgtgatctattctaataatacgaatctagaaaagtatcttgtttatagtactactatatgtcacattccttcagaatctctaaagacagagcgagtaattgattagtccaaaagaaaataatgcgtgatgtggtcatgttagctggctaaagcggctatgtttatccgctacgtcctctccacgttggtgataactgactagttgactaaaccctccgtttcacaatgtaagtcattctatcattttctatattgtctagatttattaacatcaatataaatgtggaaaatgctagaataacttacattatgaaacggaggaagtactaattaacgctttcgatcggttctggctgaagtcctgcacatttgcaaagttgatgcgtcgtctgagcaagggaagtacaaaaacgagcatacgagagactccaaaatgacaaaaatctacacgtcattttctcttttttttttcttttagaaaatggacacgtcatttcgtaggtgatcgatcgacctgtgcaacagtccattgatccccgtcatcatcatcgatcttctacctccagtgtttctgttcatcttttgcttttgtgctttgggagaaacgatacaaaagtctgaaagggagagacagagaagtaacgagcaaacactcgtagattagacgttggtatgtcgctgtatgttttgaactcgttcgccccatgattgccgtgaaacgtaccacagtacaccgaccacgacagatgggcacgcgcagctcgaaacgtgacggtactgtctgtgcatgttcgtctcatccatggctcaatcaaaacctcaaattttttttacatatttcaaattcgcgtacaccaaacatgcatggtccgcatctagagagactgagagtcacagccaattgaccttgcatagcactgtaccaaacacatgatttaaaaaaaataaacttcacagaagtatgaactgattcattatgaaattccgccatccatacgagcaaatcgcttcaaacgtcgtggtaaaaatcagtcaaccaagacaaaaagcactagcggtataaacggtggagtctcctaacttcatcagagtttaaattctggtgttcatatatatacgcatataagcgagcatcaaagatatactactggtgttcgtttctttaaacatgtgttaggagacgcttttgttaatgtattagtgtagcgttaccactggtggagaaatgctttttagtcccggttcataaccccctatagtcccggttttccaaccgggactacgaatctgggactaaagatcgctatctttagtcccggttcaaataaccgggactaaaaatcaatctttagtcccggttgatgttaccaaccgggactaaagatgggagaatctttagtcccggttgataacaccaaccgggactaaagatattttttctttttttttctgcttttaatattgaatattgatttcacaccatcccctcccatatccaaatcatcacatattacagaacatctccaaatcctcaaacaaatcatctccaaatacatcacaaactcttaaaaaaattacatcacagggttctaaaaaattcatcacagattcacatctgacacaaaaatacatcagggggatc

SEQ ID NO: 47007 - DNA, 3949 bp, Oryza sativa
actaaccgggactaaagatcatagggccctgacacagcctgacatggaatcaaccgggactaaaaatgaactttagtcccggttggagttaccaaccgggagtaaagatgatttttagtcccggttggtaacaacaaccgggactaaagatctttctcttattaaccgggactaaaaaatcatttttagtcccggtttttaatggaaccgggactattgtggatatgggttgaccgaccaaaaatggtttctctaccagtgtacgtgtgcgtctgccaatgttatttttttaataactttttttaaaaaaaactagtcaaacaatacaaacttttcaactggaaagtggaaattccgctgaggcgctgactcactggataaatccttcaccccctcatgcttggaaaggggggagaggacaaatttgccaactgttgccacgcccccgtacacggccacgctgcagcttcatattgccgtccccgtcctcgtcgccgtcgcctccactccgcccagaaccaactcctgtccaggtccaggtccagcgacgccgccttcctctcccgtggcgtcgtcggcccggcgtcgccatcccacggccagtggcgccgccgcagccgacgtgtccaaatcgcgcagttcttcttcttccgccttcctattttactagtacctccttggaaactggaagctggagcgcatccgttcctcgaatccctccggctgcgcctccactccgccgcctgctacgattccgtcgtcgtctccgttccgcggcaatccgaggtacgcgacgacgccatcaccaacctagccgagcttttttttttctttctttttttttctctgtgtgttttggggattcgcggcgcgggggagagaggggatttcccgagggtaggagacgatcgggacgacattcgcgaggattccgggtagctcggccggattgcggccgctgggggaggcggtggcgcggattcacgatcaggagcctctcgtgctccgcggcggtggcgtccatgcgcatttgcccgcggcgtgtgacacctgccaacgcttacgagttacgcgtcggtttcgcttagcgagagacgctgtgaacagaaggccagaaacaaagtgtgaggccagtaatagtatagcagcaaggagcctgtgaggaggtagcaatgcagcatatcatgatcaattattgatcatcatccctgccccaacgtacagggcatgggtgcgagtgaggtgcggagttgggggccgttgggccatttgtctccgaggtccggtccgtccggagattccatgaagaatcaacggttctgttttgtcaatcatgttggaaagatagtactggtatgagtattgttttcctcttggagtcattgattaggacctcagattccttggttgtcatcatcagaggctcagagtggagtagtggaccatggtgcacagtgagagactgtgagtctccacctatagacaaagggagatgtttagttcctctttctcgttacactattgcttttttattatttgattgatacttggcacatgacaacatgagtgtttaaacgaggggttccgtttaacaatggaacagttcgagagctcatctacttgatatttctttatctttttttaagaaacaaaaagaaactatttcccttcatatttaggtcatgttgatcaaacttcaaattaaatgtttggaaaataagataatttcagcaatagagtgtagtcttgacaagctggagaatttgagaagtagttggtgagtagccagctagtgagaatgtggaaaagctgggttttgcagcttatggcttataatcattttttagactctatagcttatgattcttagaatctgggtgaaaagctagactgtttcgggagttggagattctagaaaaagctgcaacttccagaagctctaaattgtgtttgtgtaaaatataattgcaactataatcatttgttgtaaatctccataccctgattggcatgcatttcattctcaggaattgtaaatagcaggttcttcactgtggcaccttaacagggcttctctatgggttctgcgggaaatgaagtatgttgcttggccctatcagacatcaaaccatgcagttttttgttcattcacattctaactgtatttattttcatccacagaacagtgacacattactaggcaatggagttgttgggattcttgccgagactgctaatatgtgggaaaggagagcaccattaaccccatcccattgtgctcgccttctgcttggaggaggcaagaggggaactggggtaaatcggattatcgtgcaaccaagtacaaagaggatccatcatgatgctcaatacgaggatgttgggtgtgagatttcaaaagacctgtcagagtgtggtcttattataggaatcaaacaaccaaaggttacattaccatcttcgatgctctaatcgactgtgcaccgtagcctgtaccagtatcgcgattatgaatttttcttatctatgttcctttatgcagctggagatgattcttccacatagagcatatggattcttttctcacacccataaggcccagaaagaaaatatgccactattagatgaggtagctaccatattcttatatccatgttttccgttaacagatacaatcattttttgtggaggtactaaacttctaggtcacattctcagatccttgaaaaaagagtatccctgtttgattatgagctaattgctggagatgatgggaaaagattgcttgcatttgggaaatttgctgggagagctggactgatagacttcttacacggtctcggacaacgtaagaatgctcgccttaatttctcagttcatgtactgacatgatatgaagaatgcttgccttaatttctcagttcatgtactgacatgatatgatattctagtgccacccaaatctgctatctgcacatactatcttaggtagcagtttttcgtcataagcaccatttagtcttcacaagtaattgtttggtgttgtggattattcaagcaggtcatttttcaccttaaatttcagggtacttgagccttggatactcgaccccatttctctctctagggcaatcacatatgtatccttcactcgctgcagccaaggctgcagtcattgccattggtgaagagatagcaacatttggacttccatctggaatttgcccaatagtatttgtattcactggaactggaaatggtaatttactgtaccttttttttttgcccatcatataagctcaagttgggaatatccgttgtttggatatattgtggtgctttgaagagacaaaagttcttagctgttgcccatttcgtaatcttactttctgggaaaaatagcatctctttagacctgtaattggtctcattgtaacattgtatccctcacatatatataacttcatgcacgacagtttctcagggtgcgcaagagatattcaagttactgccccatagctttgttgatgctgggaagcttccagagctttctgcggtattactccttctctgtcagaagttttagtgttaactatctaagcatcgtagttttcgtaagtttctcttttgacctgtttgaactgaatgtagtttctgccagcacctttttgtttgtgggaatgatagtatacatctagtttcactctgttttttttaaaaaaaaactaaatgataggatactttagctatttgattttatttgtaaacataagcattagtttcttaagacacctcattatgctttattgtttcatttttcaggctagaagtctgtctcaacatccacaatcaagcaagagagtattccagctgtatggttgtgttgtctcttctagagacatggtcactcccaaggatcccaccagatgcttcaacaaagtaatgcaca

SEQ ID NO: 47008 - DNA, 14050 bp, Oryza sativa
acagtaagataaaaactgaagtaggccttgtaaaaatttctaatctaatgaggcggtgtttgcagtatgtgtacctaagactttgcaaagaattattgcaggagtagataaatcagatacttgttgcaagaaattgcaaggtttaacctatatacaatatatatgctaatatttatatctggttttcaacagttaactgcatgtactgggagaggaggtttccacgattactgagcattgaccagttacaacaactgatgaagaatggttgccctttggttggtatttctgatataacttgtgacattggaggttccatagaatttgtgaacaagagtacttcaattgagagacctttcttcaggtaatgttctaactttctgctgtgtataatttacagttccgtaacaagttctcacatcatcctaagctgtgttgacgatacctaaatttctgttacaattatgtttggatgttcattatggatgcataacttgtttgtcattctctgatcttttgccggcatcggggtaaataaggggggagaggtgttgtcatggtagaaaagagaaatgactataaggaattttagttcattagaactatgtataatgatgaatgctaaagtgccctaaagaaagatacttgatgggtctctttcttatagttgtaattatctgcttcttttcagtagttgtggcttttgacaaattactgatacacatgtctaggtatgatccttgtactaattcatgccatgatgatatggaaggaaatggtgtgatctgcttagccgttgacattctccctacagaattttccaaagaggtgggctcttttatagaataagtaagggtatctttgttttaagcacaaaccttttccattgactgttgtcctactgaacttctatgctgtaggcctcccaacattttggagacatattatccaaattcgttgctagattggcctcagctaaggaactgttggagcttccttcacacttgagaaaagcttgcattgcgcatgctggcagactcacttctctgtatgagtatattcctcggatgagaaagactataatgtaagtttcaaaatccaagtctatgctctcctccttattgtcaccattgtactgctcttggatattctgtatttgtgtcctgatagtttagaaggacagaatgagctaaatagctaatcttgttaagatgcacatatatttcacataaaaaaggagatatattcgattgctcatgtcttatgcttttacccgtaattagtaaataaagcactgcagatttagttattaagcagaaacttagtggcacggttttcttcttctgctttgttcaaacaaatatagatgtaccaaactgtttgaagtgaacaggcaggggaagctagtaaacagtgctatatgtcaatgaatgtttttatggattatggcagtgatggattaatgagtatctaatgctagagacaaacaatattagcccttattatttttgtgagctcatggtaggctggtagcatatgagttccatcgtttcctgtttttatcattctacctggtgttctgtgatatagcttatcgctaagactatgatgctttaccagcttcaggcatgttttactggtcctaatgttcttctatatgttcatgtgcagagagttgccaccagctccaacaaatctattacctgataagaagtacaacagcctggttagactctagttttctagtattacagtacatttatgatctgtctgactattattggatgtatgcaattagggactaaattgttttttttttctctaaaaacttgttggttcatgaaacaggtgtctctcagtggccacctctttgataagttccttattaatgaagctctggatattattgaaacagccggaggttcttttcacttgattagatgcgatgttgggcaaagcattgatgatatgtcatactcagagcttgaagtaagaacacatgtttctttttgatgcacagttatttagaattaaaatcaatattatatggcgtctatagtttgggaattaattattgctatttttggaacaatctgctactcattgatggcatgtcaaattcagagcttgaagtaagaaatcattttcttttctatgcacacttattcaggataaaaaacaaaattacatggtgtttctagcttgggaaattaattgttcctgttcctaaaattatcaatctcctgctaccactcattaaaaaaaacaaattttgttactgccaagaaagctaaatagtctgagaactgaaacgttatgtcttttcttatggaaccttcttagcagtaatactgtatggtagctcttgatgatcctatatatttggatttacgaatttaaaagttgatataaagaacaaaaggagcaaatgacagaggttggaattacgtgctgggctcctgttccattcccatggtcccacccatctctatctctgctgcaaaaggcagagggagtatgactagtgcaaaagcagtcagatattttttcgaacggtcaggccgttgccgacgttttatattaagaagaagatatcctattgtaaggagaaaacgggaccaaaccttacaatgctcaattaattagggaaaactgggtgaaaaccacaactacaacaccacaccaacagctaacctaacctaagctaccacgacggagcccaacacaaggcatcggtcaagcttgccatagagacgacacgacaacacacatgttatcgttgccgagcttgtcacccaagtgacacagcagcttcgacttcattgtgatactaccccaacgccaaaatgaacaaacaaaagcgacgcccacgaaggacatcagcccaaaataccaagggaccactcctcctcacagctagcatcaacaatcctataaagacattgcaaagtgccatcattgccaagcttcgtcgcaccccaacaacaaagcagctccgactctacctaacaataaccaaataagagtgatgaacacccgccgtggagcaaagagcgaaaccaagtctgtgaaggcctcgtcaaacaccctaggcttgtagagcttcggagacgttgcaggaatccaccaatgactaccattgcacgtaaagggttcttggtgctaggaggggtcaacgccaaaacaacacctccaaggaggggaacggcgcctaaagacgtcgtcgtcgtcatgccggcccatggcctggcaaggctttcgccagcgattcccgaacaaagccccacacaaccatcccgcacaacgaccatcgccggaccaccacgctatctcttcaacgcccaagcacagcccacccgcccccgtagctcaagctgccaagtgagaagacctcggtgaccgcgtgcaccggtctcctcgcgcagcatcgccgcccacagcttcacgccgctggccatggccgcgctccggccaaagcctcgccgaccgccacctcgcagaccaccggccgccgccttgccttggcccgcggcctcgtcctcctccttcccgcccatcccgcacgcgtcgcgaactcacagcctaccggcgacgacggccgacgggagcacgggcagagcaagccggcgccgtcgggctctcagcaaatcagcgcggcgacaacacccgtgctgccgccggttccaggctgcctcgccgtcctctctcgcaccgctagccgcctgctccgcctctaccgccacgtcgcccaccgcgccggccggatccgcgggtgggggggccagatccggccacagaggtgccggatccgctgccccaagccgacccgccgtctccgcctccggccgtgtcatcgtcggccttgccccgtcctcctcgcgcaagggcggttccgccaagctgtttggcctcgccgccgccttcccggctcaccgccggctttgccgccggcgagctctggcggcggcgaggtggaggaagggaagagggtgtggcggcgcgggcagctagggtttcgccccccgagccgcccgcgtgagaggcgacgcgggggatgactacaaacaaatctctgaacctttccatgtcattacactaaaagcagtcagatataaaccctcagatattcttcatgcaattattggagaggttcactagttcatctccgttcccctttctgagtacaccacgctctgcctgctttctactccgactgatcatcaacctggatggacatccatgagtttgtgccttttcctttcatgcttcttctgaactctgttcttttcttcaattttgtgtatgaccttttttcgctctcaaggaagtatgactgttttggaacttgagttttgcagctgtgatgcagtgaacaagttacataaaactcagaatcttgcagccctatatgatgaactttaacaatcctacaatcaatttcaaaaatctttcttcaatgtgtaaatattccagcgggtctctctctctctgttttttttttttggggggggggggcattaatcaatacaggacaaattacaattgttctggattagaccatgccaaaaagttagattcaaaaccacgctagaagccagataatccttaacttctatctctcgtggctaattcatgactaatcccaatttggtcatggcgagttcaaaagccatttaccaacttgttgtagtttgattcttctttatttagaaaaaaaatggaagtcacccacacattacatcattacattatgctatatcaaataatgatgtaaatttaatactaggctaaatctgaaactctataaacccagatcacacaagacaaactgattttgtattatagcattcctgaacttcttttgttgtttgggtacatatccagtaactcatgccactttttttttttgtatttaccatgatattattgttttattattttcttggtaaacatgttactggtcttatcctccttggattgcattaagccaaacattttagtacaactttttttctgagttatatggtgcatgtccttttacaggtaggagcagatgatacagctacattggataagattattgattccttgacttctctagctaatgcacatggagatcctaatgccagaagagaaattgaattatctctaaagataggaaaagtcaatgagtgtggaactgatgacagcatggctaaagaagggtcaaaggttttaattcttggagctggaagagtctgtcgaccagctgctgagtttctggcttcttattcaaacatcttcagcagcagtgcctacgatcatgacattgaccaaattcatgttattgtggcgtccctgtaccaaaaagatgcagaagaggttattctcacagcacagtgcattcctggactaagcctttttatatatatacatattttttagttgcttgcatgagttactatcaacatgttctgtgtacatcaataagcaatggaaatagcagaatgctatcattttggtcaagatttgtaaggtaattttagaaaaatactacattttcttatgtatttttgtctctatatgcagacaattgatggcataagaaatgcaacagctgctcaactcgatgttgcagatattaaaaatctttccaatcttgtttctcaggtaatttcaattctggtattataatgaacatagtggggctgccaaatcacatgggaattaattttgacctgacttcaatcctcttttccattttttttctttctataatgagattttaacttggagttgcttttcaaacaaattacatttgcaactagcaaaatacccgtgcgttgcaatggattttgaaaatatgtttttaaatgtactaacttgccagcgattagagaatttagtgattacctcctcttgcaggttgaagtagtagttagcttgctgcctgccagttttcatgctgccatagcaagagtatgcatagaggtagtcttctatacttccttgtgttcccctggtgtatggatctgtgatgatttatgggaggcctcaaaccaccatcgttgtgatattcagtgattcctgtatgacagatgaagaagcacttggtcactgcaagctatgttgatgagtccatgtcaaagttggaacaatctgcagaaggtgctggtgtaactattctctgtgaaatgggcctggatcctggcataggtactttccttaatatcatggtcaaccatgtacatttgttatggtacatacgttcatcaaattattaggggatgtgatatgactaaacattatcactgcaacgagaaagaatgtaattttatcatagagtaattttgctagtccaaacaagttataatattgcttatggcacgcagatcatatgatgtcaatgaagatgattgacgaagcacattcacggaaggggaaaataaagtcatttacatccttttgtggaggacttccatctccagcttctgcaaacaatccacttgcttataagttcaggtaaactatgatgttcccatattggaaataacaatgccatgttgcatgcaacagattttacaagaaacaatcatggttgctttttcctcttttgtagttggagtccagctggtgccatccgtgcagggagaaaccctgctgtctacaaatttcatggagaaatcatccatgtagatggtaatatttgttaatatttgctaaggaaaaacagatgcatagtttatagtatgttttactgacaaaaacatacttcaccaaaaattgatgtgtacttgatccatgttctttgtgcctaaaaagcgatgtatgacacaggctagcattcgtttttacagcatggaacctaattagcttttaaactgctaaaaaattggtttattcagtgtatctttgtataactatcttagtattttaaaattgcatataaaaataagaaaaggagaatccatattatggaaagaagatacaactgtcatatatcaattggtgaatttacctataacttcaacaggtgataaattgtatgaatccgcaaagaggctcagattaccagaacttccagcttttgcactggaacacttgccaaaccggaattccttgatgtatggagacctgtatgggatctccaaagaagcatctactgtgtacagggctactcttcgttatgaaggcaagtgttgatgtaccgtttcgttttaactgagacattcattttccctggaaatatcatttatacaaataattttgttgcacttgtacaggatttagtgagataatggcaaccttcgcgaaaattgggttttttgatgctgcaagtcatccactgttgcaacaaactactcgccctacatacagggattttcttgttgaactcttcaatgcttgtaacatctccacaaccgccagaaaggaatatagtgaagtctctggaggacaagatggtgaactgatttccagactcttgagttttgggcattgcaaagataaggaaatagctgctaagacagtcaaaacaatcaagttagtttctgaaccctgtgctttctaacattgctcaccacatttaacctcttctagaaactgccatgaagatcacagctgtgtttacatctaatattatgcaataaatctctttgtgcaagtagtattttaggaacatattagaaataagcagtattattgttgaaattctttgttataagtcttccagaaaaaaggaattatttgttatctatactactataaaagacactagtggtgccaccaccactacttttgtactttttgcaaactagtcccttatattttctaatattatataattgtctaatatttgtttcaatcaagtgaatatcatgtattcaaataagcaaacatctctatgacatattattatatattttcttttacccatagcaaagcatggatattttgctggtaatttagaagtgacaatacatcatctcttggctaggttcttgggattatatgaggagacacagattccagagaactgttcaagtgcatttgatgtgatttgccagcgaatggagcagagaatggcttatatccacaatgagcaggtgaggattgatcatatcagcagtcctccttcgatctcatgtattttatataacagtacagaaaatttcatgaaattatcaaagtatactcttttttccacaatacaaaagtgaacttgagagactgagagagctgattttttttttacattgaacgggcaaggtctcagaatatattcactcttttattgtggactttaactaaaagaaacttgaaagagagctgaactttacatacaagtgcatttgttcctttttttattgctcacatggagtattatctctagtagattgctagcccagtgatctatccgaatttctgtttcagattgtgctttaccaccataattcacaagcttcttttccatcaaacttctaaggataaccattactgacacgctaaatgcttttgctttggtgatgtaattcaggatatggtactgctgcaccatgaggtggaggtggaataccctgatggccgaccaaccgaaaagcaccaagcaaccctacttgagtttggaaaggttgaaaatggcaggcctaccactgccatggctctcacggtcggaataccagcagcaataggagctctggtaagtagctctcttgaaccacattacacttgtcatacgcatacctgatcaaagaggaaacttgtactcattatactcgttttcatgtttcagctgttgctccagaacaagatccaaaagaaaggagtgatcaggcctctggaacctgaaatttacattccaggtaagtgcaaatcaaatcagacaccacttgttgcttatggttatcgaacccagcaacggcggtgggttgctgatacgtgcgtttgattttgtgaagcgttggagatcttggagtcatcgggtatcaagctggcggagagagtggagacctgagaatcggacccaatatgtataatgtagcatggtggtagcttctctatatatatgcttcagtgaataattgatttgccgttgtgtggtaattaagcaatgcccgctaataaattgtaccgtagaagtccttctatgtacatccgtatcaaaaaataaaaaaagcatcgattagcttgaataaaaaggtgagctagctcgttggagattaatcaggccgtcgctgttggcagcagaaagtttttagaacttaattacataaagatgatacaattaaaccgagtcactctcggcctctgcataaaatacacacagccagaaaaagaagaaagaaacaactagaacatctcccaagtacaacatctcccaagcacaaaagtttgacagaaacatatatcttagtggctatcaattcatagactagaccgtcacccagtcagaaaaagaagaaagaaacaactagaacatctcctaagcacaacatctcccaggcacaaaagtttgacagaaacatatatcttagtggctatcaatccatagactagaccgccacccatgctcctgggtaaaaaaaacttctgtgccacctggtccaaacatcgagataccaccgtaatagtatcccgcagtcccgattggtggaggatagcccaggtatgtagccaccgggtaactaaggtaataacctgcaaaggagaagacaccatcttgttatcaaaaattactccattcctgctcaaccaaatggaccaacacagagttgttgtacccatcaaaagcagattcatcatttctttggagacacatgatagccaactcccaaacatatgaccaacattgcgaggaggtttcagattagaagccaaatgaattacagaccacaccaagcgagataagcggcactgaaagaataaatgttggatagtttcatccttgtgacagaaacaacatatcttgctgcctttccaatttctcttagcaaggttgtccttggtgagaattacgccccgacgtaaataccaaaggaagattttaacttttaggggtactttcaccttccaaatccgttcttaatattcggacccggtatggttagagctagataatgagatttgactgagaagaccccattcggggtgaggttccattgaaactcatcttgctcctataccagaaccaaatcagctatgcgaggcaataagttatgccaagcagctagttttgcaccaattaaatcccgtcgccatgaaaagcacggaggattggtttggaaaatctgtgcgatagtcgactgtttatgcctaactatgttatagagacaaggatactgttctcttaacgaggcattacccaaccatttgtcttcccagaacctaacttgggagccgtccctaatcttgaaggatccaaaacggataaagtcctatttgacctttataagactagcccaaaaatgtgaatcccccgctttccaataggcttgagataaaggttgtgatcccaaatatttattgcgtggtagttgttgccatattccatcggtggtaagtagtttgtataaccacttactaattaacgctttattctttatctcgaggtcatgaattcctagccccccttgttctttgggacgacaaataatgtcccacttagcaagccggtatttcttcttatgtccatccccttgctaataaaacctagatcgaaggtagtcaagttttttaagtaccccactaggaattgcaaggaatgacatcatatacattaggaaactgctaagtactgagttaatcaaagtaagtcgtcttcccaacgaaagaagttttcctttccagctactcaatttctgctcagaacatgaagtcagtgcttctagctttcgaacagttgtcgggtcttaagatcaattttcataaaagtgaactgtattgttttggtgaagcacttgattatggtgatcaatacaaccagctctttggctgccaggtcggcaacttcccattccgttatctgggcattccgatccattattggcagcagaaagtacgcaattgtgttttgagtgtatgcatgtgacttagatagttgcataaatattttataaaattagataaaaatagattatgatgatataaaaaatacaaatctaaattcgatctacgaataaaactgataacatactggagactgactatcaatggcaggtgaggcaattgatttcattttttttaaccaaataagcaagggatgttggaacaacaagcccggccagatcaacttgcacctatggttgcgagaagacgatgttttcacttgtgttgcccaccaacgcgaggctctcctcaaacaaacccaaagtagagacttcgttattgctgtaatcgtgatattcgccgacggcttcgtcctccggcgagaagataatctccagggtcccgacgctagggtcgaagaccaacacatggcctgtacctgtggcaaacatgatctttttcttcttcttttcttcgttgttgccatcactaaacatatgaatcggggcgatccaataccaccttagacacgaatggtcaggcggcaacacgctcacccattcgatggaacacagcttctcccagcttccagctgcagcttctctcgtcacccatatttcgcacgtaggactctccggctcctcgtccacgagctgcaactttacgtctgtgaaagtatacacacacagacagccatccaactctgtcagctcaaagtcgtcgcgagattgcagctcaggaggaggcttcaacgacgacacgccgaaagattcgtcggtcacgttgaatgtgacgatgtcgccgtctcctcggaggaagtgcaggtcgccgccgttgcagagcgcggctcctcgtcgccaattctctcgcgggtaatgccaatgccgcggcggcggcgtcgtggacgcggcggcgggcggcctccagctgctcgacggcgacggctcgtcgccgtcgagagccaagacctcccagacgacggtcgccggcgagcagcagcggcaacccaccacgcgcaccaccttgtgccgccgcgtggccgagcagtagcccaagccgtaggtcgccggcggcggcgtgttgtccgtgcccgggagacgcaggatgtggcgggtggaagggttccagaggtagtgcgtgtggtggccggtgatcttgaggaggacgaggccatggcaggacttgctggcgagcggaaagatcgtgccatgtggcagatgtctagcggtcatgatctcctctaccgggggcctggggatcagatgctgccactgccattgccaggcgaagaaaggttgtcgaggaccgaacggcggcctgatgaacagccgtggtgggtgtttgttccgctgctttcgctggaggaaatgggcttcctggaacaggtgtgacgaggtgatggtggcgtggaaccgccgcgagacgcatcggaatcggaggagcgatttgacgggcaggtgggagaggatctcgtcgacgatgtcgtcgggcagtggacaagggcaagcccccgagaaacgcttcatcctcttggcgctcctcgtgccatccatgtcttcctccctccttgcctccttggttggttaatgattactcaactcactcctgtttgttttgtttgatcgattctggtgaagtgtacagcagatccaggagatcggtgccctccagttaaatgagtacccaaggagcaaggatgagtccgaatttgaatgggacacgcaacaaaactctagtccgagccggagtcagttcgcacgggcacggtattccttcgattaattggcaatcgccgatcagcgatcactatcagccagctttgccgtttttagggaatatcctccccgtcggttgctcgggagaggtatagatggtcatctgggccgcccggcacggcatggcccaagcctagccgtgcctaggctgaggtttgtcgggctggcacggcccgggccgtgccgtgccagctcacaggcagcatacacagcccaggcacggcccaatactactcgggccatgccaggctggcccgaagacacgaaggcctattgtgcttgctcgtagaaaaagtatatttttggttcctcaactctgcggctgtgtttgaatggctggaaaataagtctattttgtatgcctcttgtcttgggccttgccttatacgattatataagtctattttgcgtccctatatttttttatttgatcgggccgtgctaggccagcccaccatgccgagggtgtagcccagacatggcgtggctgtcaggccaggccggcacgagcacgaccccagtcgggccttgccatgcttgcatcgggccaaaattgcgagcttcgggccaggccgtgggccttgggccatatggccatctatagggggagggagaaaaaatcgagcgctccctccccccacgacgcacgcccccttggccccacccacgtgtccctgcctccacctgccaagtgtctccaccacatactccattgaaacaaatcacccacatattttggaacgggattgctatatgtcattcgaatgaaatttggggaagaaatcttacagattttgaaccattggatccatgccaaggttcgtgcatcggcttctctccttcaactccggcgggctccccttcttctccggcgccggcgacaccccaactctgacgggttagggtttggggttgggatgagggtaggaggggggttgggtgagggggaagagggggctttcctcggggtttagagggatggccgtgggcgacggaggaccgatggtgggcggtggactccggcgggcggcaaggcggcggcggcaccgccgaagccacggggatgaaggagggcggtcggccggcgtcagcggtgggggcaaagcaagcatgagattaggaggcggcggccggtggtggcggatccggcggcggggagccgccggagacggggaagacggcagggcgggggcacctccccgtcgccacctcgaggaaaggagggaaggaggagagggggttgggggaggggg

SEQ ID NO: 47009 - DNA, 5204 bp, Oryza sativa
agggtctcgccggtgccattgaccccttccaggatgccggtgaggcgggcggcggcatggtggggcggtggggcggtggcggtgggggatcgcgcgaggacggaggagtggtggcggcatgcgatctatatcggggggaggaggagaggagctagggttaaaagggtctgcacggatcttgaagcatatccaatggtccaaaattcgaatgataggaggtgggattttctgtcacaagacgtatagacagcaccctatattaagggaatttgtttcattttttgctccacaaaaaatattttacctagtgtactcacaatgtttcactatgtatatatctaatgttgcagtgaattgaaatattcttttgcaataaatcacccacatattttgaaaaccctctattaagggaatttgtttcattttttgttccaccaaaaatgtttcaccagtgttcttttaatgtttcactatgtatggaacaaatgttgtagtgaactgaaacattctttcgctatttgctaaaacattatttttatataaggtgaaacaacacctaatttaaatgattgaaacatttttgatctactgtaaaataattccgatatatttggtggaacatcgtgcaacattttaaaataattcaataataagctaaacaaatttccgtcggaatatatccatgtatggtcttattttgaagatttaattgcaacaaatttaatggtgcaatcggatcatgatttggataaataatttaagagaaaaaatagtttaaaatggttttgcacgtatgcgtcatgctgacgtcatcatccgattttgccccctccccgtcggccgaccaacacgtagtcgtctcccgttttcagcccaacaatcctttcctgtttttgtcttttttttaacaagttcatttgaggtcccttaactttacaccgagttcaattttcatccttgatgcaaaattagacacaacgggtccctcaacagtcaaaactggtataaaggaggtccctcagcggtttagatggcgttttagctgacgtggcatgacgcctacgtggctagtctgacttggtcctcgtcctacgtggtggtgacatggctctagaagcaaaatgaaaaatatgtgagacccacatgtcaatcataaaaaaaatatagtgggacccacatgttcctcctctctatctccgcccgcagtctacgaaacgctcaccagtggctacgctcgccgaccgcttgggtgaccacggcggcagggatgggtgggggaggaatggcgactgggggcagggggagggggctgtgtacaaaacaggatcttgcagcactgggacgaatcgatggcgtcaacgttggagaacccgctgaagcggcggcagcggcttcgagctcgagtctcgggccccgtcggcgccacgctgtccgtgtcccgcgactgcgaactcgccgttgccagcgccaactcatgaagatcaatgcggcgacgcaacaggaggaatcggcggcgcgggggggtgaggtcatgcagctccggccgccactcctcctctctcgtctctcgcctgctgccgcacgccgcttctctgccattgtccatcgtgcgccactccgcctgaggcccagagccgccccgctctgagcaacgaagagaggggagatggggagtaggacaagaagagggggcgtgaatgacatgtggggcccacgtgggccccagtatttttaaattattttttgtgtaactgatatgtgggaccatagtttttattattttgcaaattaaattgtcacataagcgtcatgtcaatgccacattagatgaagaccgagtcaaattagccacgtagacgtcacgtcagctaaaaccgccttaggacttattttgcaccggttttaagagttgagggatctattgtatctggttttccagttgaagaatgaaaatcgaattcgttgataagttaagagaactcaaatgaacttatattccaccgagcattcaccgtcaagagaggcgctctaaatttctttgtttgcgaggtgacatttgatagtgcattcctaggaagtacgaacatattgctttttttatggaccagtaatatactcgtgttgtgtaaggctcttagccatacaagctgcagctactgtggctgctatatcacaaattgactacaagtagttgcagcaattcttaactacggtagccgcagttgcaaaaatatcagccgagcacatcttaagtgtgtaacaggctagacgcatataattaagaattgattgggtatatgggaaggaaataagatggagaacagtagtagatataatgaacacaatgagtgtgtttagttcacgttaaaattgaaagtttgtttgaaattaaaatgatgtgatggaaaaattgaaaatttatgtgtgtaggaaagttttgatgcgataaaaaagttaaaagtttaaagaaaaaatttagaactaaacaaggcctttagtagatataatccgtacaacctattggagttaatttcgagacagtgtaatttggctttgcatagcagccacaggaaggcaaagccacacaaattttgacaatttgatattttgaaaaaaataattttacaaataaaccgtcactaaaacttattttaaaaataatcttttttttccagtaccaaatcatctggcgctgaccttagacacctcagcgccacgtcatctagcgctgaatgtcgtgccaccgcagatgggaggctaagtcagcgtgccaacgcatattcagcgtcacactatttggcgctgagatgtttaagttcagcgccacacgatgtaacgctgaacaaaagggttatttttaaaataagttttgatcggttcatttgtaaaaatattttttgcaaagagtcaaattgtcaaagtttgtggcaaagccaaacgggccagcacttgttcaccgcgcagcgcttgtcggccgccagctcgcgcggtcgcgcccatgtggtgatacccgtagaccggatatagagggtattggggtacgttgatgcaagggtctacgtagtatgacatcaagcaaacagaagacgaagattatactagttcaggcctcttgacaggtaatagccctaatccagttggtatggaattatatgatgggaatcacaggttacaaagggaacgatggaactcgatgaaaccggcgagatcataatcgaattgattcgactagatctcccagcgattcggctcctgcaggctccgacttcgtaggctgtggtggtggcgttggctgtgagattcgatcccgcaggtcctcccagggggtcccttttatatcgcaggtcaggcaatctccaagcaggactcagagacatcgaaccgcacacgatacgttgacaacacagtcttgcccgagtaggtctctttccatctgccaattccgtgaaggatttccttaacacgtatagagaatgtccctatatgcgcaggcatgccatattgatatgtgacatatatcgaagggtaaagggtatacctaacccgtaaccctgacagtagcccccgacttctgcttaaatgaactcgtgtgaccaacgcgacttctgatgtcgaagctgatgtcgttctcggtgtgggaaccgtagagacaggacatagtcgagaacaccatgtgaagtccaacggtcatgagtgaatttaaactgaagtctgaaagaccgccgcacgcaatagacccagaaatttccggcgggcatctatctcctttccttgaaattcgcgccgtgcgaagcgcgtctacttaagggaattttggggattcattctgaagtccgcctgttcgtgggaaaactttctagcctccaagcatccctcgtcttccccgctcccgcaaaaaccctcgcttgttaatctccgtccttcctccgacgatctctagttggcgatggatctcggcaaatctacttccaccaacgcgtcgctgaagaaactccaggaagagggcgcccttcccggtcgcggagtcatggagagagaagtaggaggtactgaaccccagcctgtcctaggtcgcatggttgcgatcgaggacaacattctttgtggttttctccctccaccttctgaatttcttctattggttctgcacttctacggcctttctttgctccacttgaaccccaattccattgccttcctcagtatttttgcgcacctttgtgaggcttacattggggtagagccttttctcgatctcttccgcttctactatgagttgcgttggatggaatccaacagggtgtccggatgcgtcggattccgacttcgggatggcttgaaatcgcgctacatcccgttccagtgcacttcttctcgaagcaaatggcgggcgaggtggttctatcttcagatagagaattcggatcctgtctttgtcgtccctgaggaacaaccagacaagatttcgtcttggaccgcaaagcccgccttgaccccttccctccaatccttcatcgatgccatcgacgacctccgagtacgaggtttgtcggggtatgaagtcgctaccgacttcgtcggtagacggatccaaccgctccaggcctgagcccacccagcctttgactattctgggccggaggacgcgacccgggtttctcctcggggtattttcctttttagttaaattgactccctcatgcgcgtgttctccctaacttatcaaattctgttctcgatcagcaggcttggatagcgccaccgtggagcgccgcgttggccaactgatgatcagcggcccgacaacggcagacgacgtccccgttcctctttgtgagaaggaggcgaccgagcgcgaagccgcaatcaacgtgagtgtagtcggcagccccttcatttttgctcctggattggataatgactttatgcaatgtaggctctccctctgactgacgccattggaccgctcgtggaccaccaggcggcggccttgttgaaggagggcatcgctcaggaggcgtccgatgtggccgttgccgctacgactagtggcagccgtgtcccaaggatagggagaaagttcacctccgtgctcggcagccgccggagagcgtcctccccatcggtgagtttcttgattcgttaactgcatagtcggaagatgccaccctcaattcgtacttggtttacttaggccgtggatg

SEQ ID NO: 47010 - DNA, 1863 bp, Oryza sativa
cataggcgaaggcggcgcaagacaggtctggagggaactccagcgcatctcctgcggtggcctcgaccgatgtcgtggtcgtgccgaggagccgtgaggcgacgccgagtgggccagccagtgacctcgggcctactcgcggcccgtctgccgacgtcctcacctggggggagtttcaagccgagatggggcgcatcctcgaggctggtgctcacggcataagtcgcgagattgcggaggcgagggcagcagcagcgtcgtcggcgaacgagcgtgccgacaagctggagcacgacctagcggaggttcgcgaggacctccagaaaatgagggagctggtggccggcaacgagtgacaacggcgggcactcgagggtcggatgtcagaactcgagaacaacttgtcggagatccgtggctcgttgcgggtcacctacaccggcctacaccagctcgccggggaatgtggtgttacgacaaccatcccggcgaaccccgacgagttctcgctgacgtcttcactcgcggaactagcaacgacgatggaggcgataccctccaagcatgcggccaggatcgtggaggaggcgtccaacgggatctataccggggcctgtcacgtccttgcatgtgtaaggttggcgcaccccgagctcgatcttcggcagatcttggatcggggggccgccaacgacgcgcgtaagggcgtgatggaggaaatcggcgagctgggagagtctgttctcccgctttttgaagagtaggacctttgttcctttgtaatcggttatgccttgtaaaaactttgttggcctcaactgcctttgcttgtgcagtcgtcaccttggtctccattagcactttggtcctgaatatttttggttgtcgtttgtaggtatgtcgatgtcgaggatgtccagcagcgtgggcagcccgagttaccggtggtcgtcccggcgattgcgctccaaccatatgtgtcccaggacgatgtaggtcaaagtttgcccgtgaatacgggtatggcgatgacttccctaagttggtgatctttgttttcatctcctttattcttctatccggagtgacttgattttctgtgttctcggaagagaagagcagcttgacttagttgtttccatgctgagcagatctcgagagtaggcttgctgaccaagatcgtcgcatccagtattggaagacgaagtgtgaggtcgcggaactcgagagagccatgttggaggtgagaaaggaccaggccgtagaggcactccgaggccgcgaggtgtggttcgactcgtatctgaagagttgctgcacgtccatgtcgagggtctgcagagagctccgagtacctcgtggggatcccgaagagtcggcggccggatacatctcgtggctgaacggagcctgcgctcagcttgagggcattggtcaacgcatcgacgaggccttgaagcaggagtgtcgtcgctcaagccggtatgccgggggacacgtgttggcctgtatacgagatcaccgtccgcagctgcacctcgaggtcctccgcgaaggtttttcacgttctcggaggactcctacggagatagatggcctggcgaagtcgatggtgccgctggcggagaaagttttccagtcgatggactggcgttggccttcctagtagcctttgtaccttgtgatagacatcttagggaaaagtgtaatatggttttggacctgtgtgaaattgtaagaagtatcttatgaaatagaaaagaaatctatcttaatgagtccttcttactctggatgtagtgtgtaagagtgcctcttcagttcccgactttggccagtcgtttgatttgtacactctcccta

SEQ ID NO: 47011 - DNA, 34100 bp, Oryza sativa
cgaaattaacctgacacatgatgaaaatgaatcgctgttgaactggtgaatcgggaatacatctcaaggtgggaaagacaaagccaaagaaaaaaaaatcaatccacatgctggtagcatgggaaatattgtgtgagcggaacaggcgagtatttcaaaatcaagaaaaaaaccttgctgcagctactagacaagattcatgatgaagtcaaactatggagaatatgtggagcaacaaacactgcgagattatcggcctaagactctttgattgattagtggttttctccctcttctttttttcctcttcttttgctttttcttttctttttctttttatcttctttctctccttcaccgttggtgatcatgtaaatagtatatcccctacttaatataacaccagctgtgctggctcgttttttttttaaaaaaagaattattagcagagctagcactcgatcttatatatcttgatcgacgatcaccttgctccacacctctcaatagctctacatatatatagtaaagaacattcctttcaggattagttgtatgcaaaataagaaacgtgttatcgtatgattaaattagtattaattattaaaagtttgaaagattgatttatttgattttttgaagcacctgttatatatgaagtttttcataaaacacactatttagcaatttgaaaacatgctaatcaaaaagagtagctaagctcaattagctactcccttaattaatccaaaagtcttaagcatattttaacttttggttttctaaataaaattataatttttgtagtctatgttaatgtaggatgagtttttttttccgcgaacgctaatgtaggatgaattaatgtttccttgattttaatgacaaaagagatatctccatcgatggagggagtatttagaacatgccattagttttgacatgtttaccgggaaattgaagagcaatgtccccagatcgaattcgagtactggagaacaaccaatatttagatagcattacaactccaaacaaatctaggacaatgggcttggaattttaaactaactgttggacagcatagtttgcatggatatagagcactagtaacatttgttgagaaaaaaaatagttaatacaaacaatttatttgaattaatgattcctggggcaaagatcaattaaggaggtgggtaaactcttaagggagctaaccaactcaataatcgtacgtatttatatgcataataatcaatggcaggacccgtccgtcggtccgtgtttatgctaacagagactttacggattaatttttcatggtaattgaactaatcctatacaaaccttatataattcttagtatgttccaatgaagcccttgccggtttagctaggaacgacttaaaggtgcatattgttctgcacgctccaatttgtgatccatgagtcatactctcttctttcttattattggacacagctaactaatataaatttatctataaaaacattaaatcatgatgttttggtgagcacacatagaatagcatctaacgtactattgataatacgacatcttttcaaatatctatatcttttgaaaagacactatatatcaaagattttataaataaagtagtacctattggcaaataaaaagaaactgagggagagtaagtaaaaaatgtcgcagtacaattatgttgtacctaacaataaggctactgctacagtagcatggcactattccgtgcattagatgaatcacagcacgactacaggcacatataacttttcctctaaaaacatgagcgtttcagtgtagcacctgtggttttctgcgctggatgatcgccaaacctagtgatttcccctgaaggcctgaagctctaagacctcgttaatttaggaggtctaaaataggatgggattttagccatttcctcggctcatcccattgctcaaatttagctatcaatgttttgagaataatctacattgaataagctggattattataataagttgatacagaataagttgtgagttatttgtttctctggattattgaaggcatctaagggtagtgggtctttagccactcaataatctagaaaaagctccttcagatgagattattagattatactaatctggttcatagattataataatctattataataatctatcataataatctacttatttgttttagcttgctcattataatccaaattataataatcctaaactgaatgaaacagtacctaaccatccctacatgcttatgactggttggacggaaaatactcccagccctcaccaactgaccctgatccctgagggtgtgtttggataatgagaaatgaggggtgggattggtattgggaaataaataaagggttagtattaaatggatgagggagaatgaatggttaagatttaaagaggggtgggaaatcatttcccttagatatttgccaaacactgcttcatggcttaagccgaatggcattgatgagccaaaagggattgcaccttttaaatagtatgtgcactttcttaacttctatttttctcactttttgcacgcacgttattaagctattaaacaatgtgtgtttctaacatttttatagaaaagttgcttaaaaaaattatataatctattttttctaatgcttaattaatcatataatacatcactctgttttgcatgtcatgaaaatgtctcaactttctcaaacgaacacagcgctaggcgggaataagattagaagatcattcagatggaaacagatattccatccatgatctgcaaacagtaagggctgtgtttagatttaggggtgtaaagttttggcgtgtcacatggaatatacggataaacatttgaagtattaaatgtagtctaataacaatcggtcagtaaaccacaagatgaatttattaagccatattaatccgtcattagcaaatgttcactgtagcatcacattgtcaaatcatgacgtaattaggtttaaaagatttgtctcacaatttacacacaatctgtgtaattagttatttttttgtctaatttaatactctattcatgtgtccaaacattcggggcctgtttagttactaaaaagtttttccaaaaaatcacatcgaatctttggacacatgcatggagcattaaatatagatttttaaaaaaactaattgcacagttgggaggaaaatcgcgagacgaatcttttgagcctaattagtccatgattagccataagtgttacagtaacacaaatgtgctaatgaaggattaattaggctcaacagattcgtctcgcggttatgaaattagttttttttatccttgtccgaaaactccttccgacatccggtcaaacgtccgatatgacacccaaaaaaattttattttcgaactaaacaagcccaaaattttgctagggggtctaaagagggcctacataaaaacatagcaggccggccgtctactgtttcatgaaaaaaaaactgggaacagaacaatgataagttaacatatgaaccttgattttgattgatctctatttcatttgcatcaactaatctttggaacacaaaattacgccaaaacaattgcatcaaatatgaccgtcgtcgtggtgcgtacgaaaatcacacactgttttgatttgatgaaccatttcctcggaattgaatagcacatttccgtttgggacaatatttatccagctgctagatttcccaatttcctttcttttttttatctatgaacgagcgccacgtgtcagccgccggagcagcaggcggcgcaccggacgaggccgttctcgttgcacgccgtgcagacgcggaagccgccggtcttctcgctgtaccgccggtggctgccgtcgcacgtgccgcagggcacgaaccgcgtcccgccgcacgacgcgcacggcgtggccgccgcccgcgccgcgccggccaccacgcggtggagctccccgctctcgtggaggaggcgcacctcgtcggcgtcgcccacgaggcggcccccgacgaacagctgcggcagcgccggccggtcccggcgcatgagcgcgcggagctcggcgaggtaggcggcgtccatggacacgtcccgctcgtcgacggcgacgcggagcccccgcaggatggcgcgcacgtcgcggcagtcctcgaacgtgcctcgcacggcgcggagggaggtgaagtagagcaccacgcgccgctcgcccgccaccgccgcggcggccgcctccgccgcgacggcgaacgacttgcacgcccggagcttggtcgacgacctcacgcggtgcaggacgttccgggagcccggcccggggggcgcgggcgccgcgtcgtcgtcgtcgaggacggagccgatgccctggtggtcggccttaccgccgccgccgccgccgccgccgccgctgctgggcggcgacgccacgcacgagggggagaaggacggggactgcgtgagccggccggtggcccggccgcggcggacccacggcgaccacatcgcgccggcggcgagcgatcgacggtgactcggtgagggaggagtggatcggaggaggggagaggagaggagtccgcggtgcgcgcgcgcgcgcgatggatttggcgcgaaattagttggtcgccctgccccctctggcttgctaattttaaccatgcgttttaactgtctccgctgcttatttgtggcgctggatttgcatcgggttagtttcctttgatctcttctcctggtgctgacttttttttggggccaactcatagagcgtgaggatgacaagtgggcccatggatgtgatcgacagaatttttatgtggacactttttttttcgcaagatactatcttgcaaccattaaggcaacaaggccttgttcggttacgcccggatttaatccggactgggaataacaagtataataagaaatttacatagatacaataagagaccgggatttatttcggaccgggaaccaatttactcatgatatagacaataagaaaccgggaatcaatccactagtcaagaggtgtggaactaacccagatgttttgttgtccctatgatgagtaaattagtttccggcccggaataaatcccggtctctcattgcatctatcacaaatttgttactatacttctcattcctggccgggattgaatccagatgtaaccgaagaaggcctaagggtgtttagatccaggggtgtaaagttttggcgtgtcacatcaggtattatatagtgttgcactcgcatggggtgttcgggcactaataaaaagctaattacagaatcgtccgtaaaccgtgagacaaatttattaagtctaattaatccatcattagcaaatgtttactgtagcatcacattgccaaatcatggagcaattatgcttaaaaaatttgtctcgcaaattaatcgcaatatgtacaattagttatttttagcctatatttagtacttcatacagatgtttgaacgtttgatctgacagggcgaaaaattttagggtgggatttaaacaggcctaattctcgttcatgtatatgttcataacggataaaattagaatattatcaaagcattttgcagtgcaaatctatagaagtgtatttggcgtgaaaaactattttgcttactcttagaagcaaaatggctcttccatagtagataggagtgcctttttcaaaaaaatagtagagaggagtacacttctttaaattttggaacaaaaatatgtttctatatttttttaaaagaatatttttttaaaagaatatccataatggaactaagtcgtggagaaacttaaatcgtgaagaccagcaaaacgtgtaggcccagctaaaaattctcttctcttcggcccagtaggcgcaactaatgtactgagaagcttccgtagcttggaccaaaagcccataaaagtgttaggcctgaatcgttatcgcggcttaagccacagtgggccgccttgccgaattatagtgggaccggattaagccacacgatatcgtagcgcgcggccttcttcaaatcggagtcggactccgcatcgcctctgcccagcccagcccagctgacgataaatagccacgtcacccgcactccattccctccctttctctcccgcccaattcaatcaccaccatggctttttcctctactccccaccttcgtcactcttgcttctgcttccgccgctgtcatcttcgatgtttctctcaccgcagctccccgctgctccatgccgctctcccgtcctcaccatcgtcgttccagctggcctggctgatcgtgaggtgggctctgccgacgccggggtggtgcaagctgaacttcgacggctccgtgttccacgacgggtctcggcgagcgagcatcggtggcatcatccgtggcttcgactgcggcggtgcctcgccttcaccgagaccacggagcactggacggttggtgtggtggagggccgtgcgatgatccggggcctgagactcgcactggcgtgcttcgtcgagcggatcgtcgtcgagggcgatgacctggttctacgcagatgaggatccttttaatttccttcctcccttaaagctgaatctcaccatttgagaagctatggaatcgtcgacccccttaccaagtagactatgaagtcactttcattttttggttgtgtatgctatgtgtttgtgccccgtcatctaccaagtacttcctccgtattttaatgtataacgccgttgactttttgacaaacgtttgacctttcgttttattcaaaaaatttatgtaattataatttattttattgtgacttgatttatcatcaaatgttctttaagcatgacataagtatttttatatttgcatagaatttttgaataagacgagtggtcaaacgttggtttaaaaatcaacggcgtcatacattaaaatatggagggagtaaattcgacaacaaagctatccgatgtatatttgtggccgccatgcacgaggagatcctctccttcctccgccgtttcaccgagttcgaggtgagacacatgtggagattatggataccccatatctacacggcatgtatagtccgactgggtatggggtgccatgtatagatagaatatctttaagatgactcgggttaaattccaaacttgtatgtcaaggaaatacctgagatcctagtcggttatggttgtattttatctgtaattacatattccgttaggatatggactgcattttgtaatacggactccttcccctatataaggaggggtccgggtgcctctaggggcacgattttcacccagatcatacgatcaataatacactcggcggatcaatccccggacaggagtagggtattacttcttgattaagaaggcctgaacctgtataaaattccttgtctctaaacccatccacttttccatcttgatagccacccccttttagtattgccgaaatcttgtttcgaaaattggcacgccaggtaggggctgcgtcaagttcttcgccaaccagtgcgatgggtttcatttccggcatcgacgacttcgtcttccctcccgggcaggcgttctgattcggcagcctcgacttcatcaccaacgacttcggcaagatttctctcctcgactcggattcaaaccagtcgggaagagatcagatctccgccccgttcggtatcccgaactcggccgaggtctaccccaagatcatatccaccgagttggcttcaaacctctcggacaaggttcaatctacttcaacacgacccgatcaagatgatggggcctatccgccgatcttgatgaaactccccgacgatttggctgctgtcttcaccacaagggcgtcttctccccataggcctaggcgggatccggcttcagccccggcccggcctagctccatggaagtcggcgtcatactccagcctctcggcacggtttcgacggaacaactggacggctacctcagctcccccggcgtcgacttgcaaccaaccgagatcgtggagtacgatgacttcggctaccgctacgactaccgcaacctcgacgacttcaatgaaggctttgaagacaactacacgcctctctacttcggcattttcatggctgacaacgagacagaagaacagcgtaaagcccgagaagcagaagaactacgtgtacaacaggaagccgaacgacgccgactggaagagaaacgccaagcacaagagcgagaacggctgcagcgtgagcaacaggaacgtgaacgggctgcaaaggaggctcaggaccggcgacgacgggccttggatgccgggcgatgagcacaagaacttattgggaagcaagacgtcgagggaactgcggttttttgcgcctctcaacaggacgcggttgcagcgatcaccctcctcgacaccctcctcaaggaagacacgctcaatcaagccaatcacgtcgtcaacatcttgaaccagaccaagaccatgatcgccgcctcggtcccgattaactctgcaagcgtccgcacgccgactggcagccgagttcctcatcttcgatcccaagactaccaccaaccaagccttagcgtcgcaggtgcgggatctagtcgcaggagcaagggtcacgacgagcgatctgtccactcaccccccgagcgacacagggagcgtcgagttgaacgaccacgctccccaccttgcaggcgccccgtcgatcttcgcgatactatcaaccagcgccacgcgacaagaggctacgctccccaccattcaccagatcgctacgatgacgacgtggatggagtcgctgccttcacaagcgacctgcgtcgagtggattggccagccggcttcaagccgactggaatcgagaagtatgaaggcaccactaacccggagtcttggctcaccgcctacggtcttgcaatccgcgcagcgggaggagacagcaaagccatggcgaattatttgcctgtggccctagcggattctgcccagtcctggcttcacgggttaccccgtggcacaatcggatcatgggcggaacttcgtgaccacttcatcgccaacttccagggtacctttgaacgccctggtacacagtttgatctctacaacatcattcagaagtctggagaatcccttcgagattacatccgacgcttttccgagcaacgcaacaagatctctgacatcactgacaatgtcatcatcgccgccttcaccaagggcattcgccacgaagacctagtcggcaagttcgggcgcaagcctcccaagacagttaagcagatgttcgaaaaagccaacgagtatgccaaagccgaagatgccattaccacatccaagcagtcaggcaccacttggaagccgaagaaagatacgccgactataggggggagtggaagtaccaatcacaaggatcgcaagcgtaagcccaaggaacttgtggcaaatactacaccatcctcccgacaacgttcgcgcatcaacacttttgacaagatcatgaactcccaatgtccgcatcatcccaattccaatcacgcggccaaagattgctttgtctacaaacagtttgtagaacaatacgccaagaacgcacgcaaaacctctgacggagatcaaagcacgtcaaagaaaaaggatgatgaagatgataccccgactggttttcaagaccattgcaaggaactcaaccacatctttggcgaacccctggcttatgaatccaagagaaagcaaaagctaaccgaacgggagatcaacgctgttcagcccgacacgccccaatatcttcggtggtcagagacaacaatttagtttgaccgctcggatcatctagaccgagtggtccacccggggcggtatcccttagtactcggcttcgaagatccctcattgatggtggcagtgcactcaacatccttttcgccaagactctggacgacatgcagatccctcgcacggaattaaagccgagtaattcaccctttcatggagtcatcccggggctatctgctacaccactcggccagatcactcttccggtcacttttggcactggggagaacttccgcacagaaaacgtttgcttcgaagttgctgatttcgagacagtgtatcatgccatactcggacgcccggcattggccaagttcatggccgttccgcactatacctacatgatgatgaagatgcctggccctcgaggagtcatatccctgtggagtgacatcaagcaagccgtcacatgcgacaaggaaagctgcgagatggcccagatccgcgagagcacgctcgcccgagaagaaatccgactggctgcgtccacggcaagcgaaggagaagtgcctgcaaccaagataccaaagagcggagaaagcgacgccaagaccaagaaaattcctctagatcccttgatcctactaagactgctgtaataggcgctgagttagattgtaaataggaaagcgcgctcatcacctttcttcaaaataataaagatatctttgcatggaaaccatctgatatgcctggtattcctagagaggtgattgagcactctttacatgttaaggaagacgctaaaccaatcaagcaacgactccgccgtttcgcataggataggaaggatgcgatcaaggaggaattgaccaagctgttagcagcaggcttcatcaaggaagtccttcatcccgactgactggccaacccagtcctggttcggaagaagatgggcagtggcgcatgtgtgttgattacactgacctcaacaagtcttgccccaaagatccctttgggttaccttgcattgaccaggtagttgattcaacggccggctgcgagctactcagttttttggattgctactcaagatatcatcagacccgactaaaggaatccgactgcttaaagacttcattcatcacgcccttcggggcctactactacatcaccatgccttttggattaaagaacgcaggagaaacttatcaacgcatgattcagagatgtttttcaactcagattggccgtaacgtcgaagcttatgtggatgatgtggtcgtcaagaccaagcagaaggatgatttgattacggatctagaagagacctttgcgagcatccgtgctttcaagatgaaactaaaccctgaaaaatgcatcttcggagtaccgtcagggaagctgcttggatttatggtgtcccatagaggcatacaagccaacccggagaaaattagtgccatcctcaacatgaaaccgccgagctcccagaaagatgttcaaaagttaaccggctgcatggcggcgctcagtcggttcgtttcacgactcggcgagcgggggatgccttttttcaagttgttgatgaaaactgacaatttccagtggggacccgaagcacaaaaagcctttgaagacttcaaaaaacttctcactactccactactcttagcttcaccacatccgcaagagccactgctgttatacgtgtcggcagcttcccatgttgtaagcacagtcctggctgtttagcgagaagaagaaggctatgttcaaaaagtccaatgaccaatttatttcgttagcgaggttttggctgactccaagacaagatacccttaggttcaaaagctattatatggtgttttaattaccgtcaggaaactatctcactacttccaaggtcactcgatcacggtggtcacatcgtttccactcggggatatacttcataatcgcgaagcgaacgggcggatcgcaaagtgggccttagagttgatatctttggatatatccttcaagccgcgaacttcgatcaagtcccaagctttagccgacttcgtcaccgagtggatcgagtgctaagaagacacgcctgcagagaagatggagtattggactatgcattttgacgggtcaaaaaggctttcaggcactggagcaggagttgttctaatctccccgactggagagaggctgagctacgtattgtggatacacttttctgtttcccacaacgtggcagaatacgaggcgcttcttcacggactaaggattgcaatctctttggggattcagcatttaatagttcgtggagattctcagttggttgttaatcaagttatgaaagagtggtcttgccttgatgataacatgaccacttaccgacaggaggtatgcaagttggaagacaaattcgatggacttgagctcacccatgttcttcgacacaacaatgaggcagccgacaaattggctaattttggttcaaaatgagaagcagccccttttgatgtgtttgttgaacatctctacgagccaaccgtaccacggaaggaaacaatcgaggccacggacactcaagacgtaagcatgattgaagccgactggagagagcccctcataagatttttgacaaaacaagaacttcctcaagataaagatgaagccgagcggatttccaggcacagcagactttatgttattcatgagactgagctgtagaagagaaacccatcgggaatcctgcaacgctgtgtttctttggaggagggaagacaattgctaaaggatatacattcaggcatatgtggtaatcacgctgctacacgaaccatcgttagcaaggcttatcggcagggttttttttggcccacagctgtgtccgacgttgacaaaattgtgcgaatatgtgagggttgtcaattttttgcccgacagacttatctaccggctcaggagcagcagaccatcccgttatcttggccgttcgcggtttgggggctcgacatggttggcctgtttaaaaaggctatcggtggttatacacatctcttgtagctgttgacaattttccaagtggattgaagccaaaccggtcatcacaatcacggcagacaaggctagagatttcttcatcaatattgtgcatcggtttggggtacccaggaggatcattactgataacggcactcaattcacctgcggagtatttaaagatttttgtgaggacttcggcatcaaaatttgctatgcctccgtagcgcaccccatgagcaattgacaagtcgaacgtgccaatggtatggtacttcaaggaataaaagcgcgagatttcgaccgactgcaaccctatgccggcaagtgggtagaacagctatcatctgtactttggtccctgcacaccactcccagtcgggctacgggccagtcgccgtttttcctggtctatggagcagaagcaatgctgccaagtgaggtggaatttgaatctttacgatttcataacttcagcgaggagcgctacggagaagaccgagtagatgaccttaaccgactagaagaagcccgtgaagcagccttaatacagtcggctcagtatttgcaagggatgtgccgttatcacaattgcaatgtttgatcacaagcttttttagtcggtgacctggttctgagaaaaattcagactacacgggatcggcacaagttatctcccttgtgggaaggaccgttcataatttccaaagtcactcggccaggttcttaccgactcaagcgagaagacggtactcatatcgacaactcttggaatattgaacatctttgtcgtttttatgcttaggcattacttttgtatttcccactttgactgctaacgtcaagtttttccttgagttatcagtcggggctactataataataatggagtgtgatttttatcaattcaatttgcttacctgatttattattgccctgtttgattttttggcttggtcaatgaggactgaaagttttttaacaacttttacgggttttaggctcaataaggtttgataaaagcttttaagaaatcaggagctaagtttaaagatcaagcacagcataaattcatcagtattgtacaaattgtgcctccatcatcatcatcatcatcatcattgttataatacaacatcaatcggtatcagttttttcatcatcagagtcattagatccagtcggctggaggtcgttgtcctggaatatctcaactacatcaacggctatcttatcagcagctttctgcgtatcattgatgaggtcgagaacggcttcttcgcttgtctcgtctgcaaagccatcaatggcgtcaatgtcaatcttcgggtacaaggacttggtcattgtcaatgccaagctcgctcccatacttccagcttccttgatattcttaaaatatgtatccgcagcaattctcagcttgtcgaagatttcggaagcatcaaatgcactcggaccattgttattgaagaacatggcttggacaagtggtgtagtggcattggcgacttcatctctggctccttcaagcttcttgattttgttaactaagacgtcgaattgagcttgggatttgatcttgcagtctacacaaataaatctatatcaatgactaggcatgaagatgagagtggtgttttgaagtattagttaccagtaccttcgacgtctttcagagccgagtcactttgttttgccaattcgatcttgtctttctccagagcttggatccgtttttccagttccgatatcttggcggcttgcactgtatcgcttcttgttggttgatatcacaaggatagcagcataaataagtgagacagggatgagaattatcttttgactaaccactcagctcaaagttggaatcttgaagctcggtgattcggtctcttagatcatgttcagtcttcctggcgagctctttagtttcatgcagctggtttcgggtggcctcaagggttccaagatggggaactagtctctcaagagtcgtagtcttcgcctcgttcctgagatggattctctgcaaagcaaatttatccgtatttgagcaaagtggctgacaggatggttgaagctgtgtacaggaagacttacatttacaagacgagtggcttggccgagtgcctttttcagtaggcatacttcctcgtcttccttttgcttatttatcacaattccctgtggttgcatgtcatcatcccaccacttgactaaaatgggtgggcgagaatcttcagctgactgtatctggaggatctcttcttcgtcgccaatcatcgggccttaggcattcatgaataatggtgaaacaattgaagaaagtctgttggatcaaagcagatttgaagggtttgcttacctgttatgatttccggtcggggacgaggaggtctttgtaccctaacaggagaactaattccaggatcaacaccggtgtctgtcttgggagggctgttagcttgagcttctacttctgggatatctttatctggctctgtacccgactggtttccagtcgggggctcctgattagcgccagttctagcttcggccgactggttcccagtcgggggcttgttgctgggttctacattgtcggtggccggttgattatcactcgggtgatcttctgcagtcagcccggtttcttttgacgggcctgtctccatgtcagtcggctcggagtcttttccagaaggatatatgtcagatggcttcctacaaatttgagttatgctatcaatactatttcaatagtgggtaagcagcaatacaaggaagatggccaaatgatttgtacctggaagattttctgattttcgacatgggacgactggatgttttcttcttcagattagtttgccttggttgttttccggtcgcttctttgtcgccagttttttcagcatcatcgccctcatcatcactcaggaccaatttcctcttgcgagagtctggctggctagtttcctcgaggtgtttggttgagtatcagaccgaatttttggtcccccactcgcctgaccagtctgccggctgggtgatcggcgttgagcgatcggaagatccgacttcaacaaggcgaattcctgagcatgatatttcgaactttcaattagcttaacagaaggcaaaagcgtgtttttgagaaaggctgaaatgtttgaatacataccggtggaggaggattgaaggcgttgtatggcaccactagtagcaagtgcgaataactgactgcggtagcgtttgagaagattttgtacattctctccttcatgactttaaagtcaagagagtctggatcttcatggttcgggtcatgcttgccgttaaattcaaaggctgtacgggatctctctttaattggagctagccggctgttgataaaatgccgggtgatctgttctccctgcagaccttgctcctttagcttcagcatacggtccatcagggcaagtgcctgagcagcttcctctcccattggaagtgagttccaagtgtcctgataaaccggaggaagacacgagtactcggggagtgcaggctcggggttttgtacatagaaccaatttgcatgccagcctttgtttgaggttttgaagggcatggagaaatatttttggcttagtgttcctctcagttgaaatccagctcccccaactatgcatggcttgctcttgttcggttggggtttgaggaagaagatatggcggaatagggcgaaatgaggcctgatgcccaaaaatgcttcgcaggcatgtatgaagttggcaatatggactatggaattcgggtttaggtgatgcaagctaatcccatagaaatccaaaattccccggaagaatcttgaggttggaagagagaacctgccatagaagaaatgagaaaataccacgacctcgtgtgtgtcaggggttgggaatgcttcgccgcatgctggacgccacccaatgatctcctttaccagaagaacaccatgcaccaccatctccttcaggttctcctctgttacatcggagggcgcccactgactctcaaagctctctctctctctcttccgccatggatgcgatctggataatatgatttggttcggtgaatggctgggaatggatgggggattgatgcggtggatgcgcaaatgatttctatggagttttggaagatggatttgggagaattggagaaccctagttccgttggagtggtttcgtactgtagcggagaatggggaaaaatgacgaaagtctcggcggggaagacgaagcggcagttggttttctgctgttattagggtatcaggagtgctaatgggcctgggcctgtacagtacttcaggccaattttattatcagcgtggctagttgtgatccttagggacttgggcatttttgcttcggcaatttttgctcacaacagtatggcccaatgctgttaaaatcctttttgacgcagttagataattccttggaattactacgatgcaaataaaaaggtacccgacagaaaggtgttatactacttttgtaagcctttttaggttgcgaaggctgtttgggttttgttgagatgattggtttttgaacagtcattctctcggcatgatatatgcttattttgattatggcgtgagtcatagcctaggctatttagactcatcaattatcatgatatcatatttataccatatttgatagatcttttgagagtttttacttagattcttgccatatgtgttggtttatggacctttagagtattttttactcgggcctctttatatcttcatttttggtatattaaagctaaagcagtcggctggatgttttattaaacgtcgcatatgcttagctgtgtggtactttgggtaattcggttgtaaaaccactcggatggatattatttgcacttcgactatatgtttagcctttagctacttacatagtcgggggttacacctaattaggtgcatctattcgatgcacccgattatttatttttagcccttcacaatctttgattttggtactcgggagatcaatgcagaagaaattgaagcactcggattatcattttgtgctacgagaaaaggctattttgtcgactgtaaatgtctcgggtgctactgtggagattatggataacctatatctacacggcatgtatagtccgactgtttatggggtgccatgtatagatagaatatctttaagaggactcgggtaaattccaaacttgtatgtcaaggaaatacctaagatcctagtcggttacgattgtattttatctgtaattacatattccgttaggatatggactgtattttgtaatacggattccttccctatataaggaggggtccggttgcctctaggggcacgattttcacccagatcatacgatcaataatacactcggcggatcaatccccggacatgagtagggtattacttcttgattaagaaggcctgaacctgtataaaatttcttgtctctgaacccatccacttttccagcttaatagccaccctttagtattgtcgaaatataccgagagggaaactgcgccggcatgtggtcggagagaggagggatgccggccgccgtctgggagaaggtggatgacgatcggcccggggtggtacacgagcgcccccgcaagaacaagtgaagcgcaccaagaaacaagaagcagccggcatgcgagccgagccgtagtctctgatcaaaagttcaagacttctcccaatttgtgattattgtagttgtacttgtacgattagtgtagctaaatactattcattgtagaaatagatcgatgattcataacactaatgatgtatttattcactgattttgaaataaaacaataaacttttatatatgcgtgctctgtttcttctcgtgtgttgtgatttgtgctgcgtgtgattgcggtcgtcttcgatgcggcggtgtggggattggcggcggaggtggattaatttgcggcgagcaaagattccacggcgatcgtcctctcctctgtttcttggaacgcttctctctgcccaaccggaaacccgagctcatgctctcgccgccggccaactctccatcaagaagaagcactctgctcctcactgcccaagcaccacgcatctagggaagcgctgatgccagggggatgcgttcctcatctccatcgagcgccgggcccccgcgtgcgacgccgccgagctctcttccttccctggtggtgggggcctcgagcttcatctccgcccttgcgtacccgtcgcccgctccctcatcgctcgagctccacctccgcccacatgccggatttctggagaaagaaatctgcttcagttttcgtgcacgggagatgtttgctgtattgcctaagtgagttcctgtggccttgtgtttttatatcctcctattaatgaagctcctgactgttccctcaaaaaaaataataataagtgagttcctgtggttgttcatccatttgggccctatgggttcaaattatgttactatgttgtgaaaccaagtgtgtttttggtttatttgtgatggaaaattggcaatgaaatgtgtaaccatgagttggttttgagcgagaaatttggtttggaatgctggcgattgtcaacgtgagtacatgcgactaatgcggtcaggttgcgatgtctatactcagaatcggatgtttggtttcatgtgtgtaggtaatcgaagtcaactttgatcaatggcgaggatcgggactatgctcaggaaggagcagaggtcttgcacggtccagaagctgtgacaaggtgggactgacgtcatgatttctgattgtcaacctgggtcgacggcagatcaggactaaactcagtgaggagttgagatccagaacgataaggaagtcgtgtgacaaggttgagatcaaggtgacacacggtggacaaacaccgtgtcgggaggttatcgcaacgggcttcgcaaaatcaactgcaagcgttgaaattcgcaaagaaattggaattaagacgtattttgtgtgcagcgtataatacatggcgtatggtcgatgtgtacgccatgtattcgcaaagaaaattggcaactaagcgtataatgtgctgcatgtatgtgtgtcaaggacaacgaacacatgcatggctcattggtgcagccaagactagggccggccacgaggcaatgcggacggtgtgatcgtaatgggtctctaaaaattagatgcctttaaaatatacatattatgatatcaggcctgagaggcttagaggaaagacagaagaccaatcggtgatcgagcatatcgtgactgcttgattgtattttaaacttattagtgtgaaattcattaatgataataagattttaaatattatcttgtatttttatggtgaatgggggcctttatttttttttgagcaatgctgcacgtactaaatttttcttactaaacttttactaacaatcatttcaaccgtttgatttaagtagatggaagttacaaaaaatctagatgcacttatagcatgacacattagtgttagtaagaatttaataagaaaaagttagtacatatagccttttcctttttttttcttttctataccgggccacagaaagtcaggccggccctgcccaagacatgtatgctctaagtacatgtgtgtacattagcttgagcagtgcatgcatgcacgaggagacatgcatgtgtgctgtgatcaaggttatcattatcccgattcgtatcctagtatcttacgatactacgatcctactaagccgaaacggtaccgatcccatctagtatcctaatttttatagtatatcgatcctactattcattactacacgatcctacgaaatcttaggtgatatcccgattctacgatccctatgatgctacaaaatattatttaaaataacatggtttgaaaataatgttactaaatatgctcaaatttatatgaaaatcagttaaatatataaaaaccaaagtggtttctcttgataaatatctctgtttgcatgacatatatcattactgtatttttttatatggaatggctatatataataaatataaatattaattaaacttaaaaaagaaaatcttgtagtatcccgatactctgatacgatcctacgatacgatattactttgagcaaaacgataccacctagtatcccgatccccgatcttgataaccttggctgtgattggttggcagaggccaagccaaccatccatctgtgatcatgggctaggccaggatgccacatggctgtaccggattggcccagtccaagatggagcaggccgtcatggtccaagtgacggcggcccggctccgtctccgcgtgcgtgggaaagcaacggagacacgtaggatccgtacggtgcgggacccacaggcgacgtggtgcgcatcgactgggagacagacgcgtggcgacgcggcttcgatacggaggagaggcgcgcgcgtggagcggcggcttcactcgctgtcaagcgggccggccggagcacgggcgcccctggcgacgtggcgacgccgggttcgcgccgtatgatgcgggacccacggcgcggagagtgtcaggcaagtgctacggtggacgtgactatcacttctaaatttatttatttggcaaaattttatacagaaaattcaaaaatatgcaattagctatgggacaccgtaaaaacgcgtatttgctgtaggacatcataaaaaactggttattagctcctggacatccgctgcattattttattatttttagaggaatatgagagagaaacggctgtgtaagtacggttctacccttcgaattaatttttctttattcttccttattcttctctctctcattctttctctctttctctctcagctatttcttcaagtgagcctgagggagagggagagcgctggtgatggcgtgggccggtgtagcgcctcggctggggcggcgctgcgcggtcatgcgggaggtggtgcctgagctagagggcaggttgtgccggcgcagttgggcggcatcggcgcgcaggcaagggcggccgggctcggcggcgcgaccacgccaggagcgcggctgctccaggccaacttcaggaggctggaccggatggcaccggcgccggcgcggcaaggctcaagccgtcgctgcgggcgctcttctcatgcgggatcttcagcacctgaacacacccagcactcagcccgacggcgacgcccaacaacaatgtcgtagcagggatgagtgggtctaagggcggatcgagcatgccattgggttggttgtggaggcggcggcaccggcggtggagacggcgtcgtcgctggttgtggaggcggcggcggaggtgacagcggatgcagcagcgggcggcggtggcggcttcgatgatggtcgacgagcccgacagctgcggtgacggaggcagcggcgagcagtgctgggaagcgggcggcggtgatagtttcgatgacgatcagcgagccggcggctgcggctttgacggtgacggttggcgagcggcgctgggaagcggctgccaacaatggggattagatagggctaagggcaattttgtctttttgaaatttctctctcctctttttgataagaaatgataaaatattacctcaggtgtcctatagcaaattacacaaattttatggtgtccatcagcagcgacgtgattttacagtgtctcccagccaattacacaattttcggatgtcctagggcaaaatttgcctatttattttattcactcataaacttagaggcaacccatataatgtatcacctttagtacacataccaatacctctaatactttcacacttttcttgaaatttgtatggaggttacctcttgatttaggggtggctcatcatctctctcctcatttctctcctccaccttatcactcaatccaatatggcactcttagaggcaacatatggggcattatagtacttgccctcagaagccgtttagcacagctctaactcccaactccaacttacctagagccggagttgtgccaaacagtatagatccttagattttcagagtggagttagtagagttactcctaaaaattgaagtgggtggagttgggttttactactccacaactctactccaccccaaaagatccactatcctttatttttaacatatttacaacaaaatgccagtgaactaccctacctaacccacctcacccctcaggccctcatcccatactctccctgtttgctagcgatgcgcagcgactagggttggcggcgcgcttcttgcctggcgacgcgcggccggcgacgcacggcggcgcgcggatgtgtcacgcccggaatttctatccaaaattccaaacgcttacatgtgtgtgaaccctcgtccaggaatcaactgaggcacacaataacaaaattgataatagagtacaattattactctaattattaaacgaataaaatatcattacagaggtagatagttcctctcaatcaataaagatctaagcagcgaaaaaataagatacacggcgcagacgactccactccacaggcagcttgaccagggctacacctaatcctccacaccatcagcacactgtagaactcctcctctgatgaatgattgcaaggtgagtatatgacatacttagcaagccacgcagcaaatatgcaagtgcataggataacaaaggatggcatagtagggtttcatttgcataaacaacatttaataaacatttcagaatttaataaaatagttaagtagtaattaaacaatattaatccaacgctatacaacataccctgttggataggcccaaccattctgaacaaccatcccggctgcacagttctatctccaaaccaggaatataccattccaaaccaggagctaatcaaattattaccagttatagcatcttttattatgatgagaaatgtgaaactaatcatgaaagatattgttagacccgcccataaccgcgggcatgactattcgaatagttttactctgtccagagatgtaccactgtacccacaagacacagccccacaacatgtcaccatgcgcctcaataccaccacagtacctcagaaaggagctgtgacagtacccctcgcacaacacaatccaccacagcacaccgttcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccagtccttaattgtcatgtgcacgaccatcaaaaccatgtgctcacaacccaccattatcaagttttagttggcaaattaattaattaaccaatcacgattgaccatcgtgagctatcattaagccatcattaaataatagtgagtcataagtatcccagttatatggactagtgtttctaagcatggctaagcaattatgtctaacatctagttgaaccaatatatataaagctcaactagtcaaattataatatcccaaggtatcaaggaatcaagtaatcaataacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaagtcttcaaattcttctcctgcaaaaacggactctccagaaacgtcggaatctaaacagaaaagagcaaaatcaccaaaacagcacacaaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagagaattactgcgtcagcggctagggttcgcggtggacagggtgcacggcggcggctcacggaaacgaacggccgagatcgatccatccaaaacgaacgaccgagatccatcggtctacgaccggtctacaacggacggcaacgatgacgtcggcgatgacgtcatcatcggcggcggctcgggcgtgcatgctcgccggcgaacgacggcgcgacaacgcgaacggaggacaccaacacatagagggcgtcgtggcgaactcaccggtgaccaaaacagcggcagacggtgatcggacgacgtcggcgacgaggaagaagcggcggcgaccttcggcttgacgacgacggcgatgctccggcgatcgacagcgatagcagaggggcggacgaggttggcgacggcttggcgaacccgacggcggctttcccgagcgacgacgacgaccgaagcgacggcggcgcacggctggagcgacggcggcgacggcgacgctaggctgcacggggctagggctctacgggcgacgagaggcgaaggcgagggtggcggcgggtagtggcgggcttgggggtcaatttatagcggctaggaggcggcggcgaaggcccacggcgaccggcgatgcgaaggaaagtctagggttcggaggagagagatcgatccgaatcgaactcgaatccacggatttccaaacgaaattagccgacgattccataagagaaaagatagaggggatcccgaagatcatttcccctctactaatttcatcggaaacggaaaggggcggccggatttggaaggagatggcggtggcgcggtgctagggctcgggcggcgggcggccggaggtagacgacgacctgacaggcgggccccacctgtcagcgtccgagggcgcgcgcacgcggcggctccaggcggactgggccggcttgggctggggagagagagagaaggttttgggccgactttcggcccaaagccaaaagagaacttttaaaaccttttccaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaatttagacaacaatttatatattttggatttttagggtgtgacaggacggcggtggcgcctcggggacacgcaggcggcggcggaacggccgacgatggtagggcggcggctcaggacgcgcggcggcggcggtaggactcccggtcggtggcttgccctaaggtacaaatccggtacatctcctctattttcctctatttattttcgattttagttctagactaagaacaaaataggctgattttgcatgtatgttgagggtgattcttctttgtatatgataaggattaacatcgcaacataagccgattgtttcattcataaagggttcattcatctaggggttgatgatcctatttttggatatgaagaatggagatgattgttcattatatgaattgctgccattggtttatgcattcagaatggtatgaatgcttgcaagggaatgcaagcaatgatttgcatatatctgtccaatgcatgttacttctgttggaaaaaaagggaacactttgggtgattttgcatttatatttcatattgtgacaaagtgaatttttttatgcacatacatgagtactgctagcctttgttcagtaaatataaatatttttttatgttagtattgaaaaaagaaaggtgtgattgggtggatggcagggatggctcaaaatgagtcttcaaaaggtgttaagatggcaatggattgtgctgattagaatgaccacaacactagaattgtatgtgagctttttgttgatcaagtagtaagtggtaatcgaccaaattgccatttatcaaatcctaggtacgatgaagtcattgaacaatttgccgcaatagcaagtttgaggtacactaggcttcaaattaagaataaacgggataaacttaaggtcgaatacagctattggaagaaattgagaactcaaacaggactaggatgggacaacacaaggcaaacagtgatggcgactgcagaacgttggaggaaattgaaatcggtaagtattttataataatgtgtaaaattaagaattgttctactaggttttatgttctaactcaattttataatgccatgttatgcaggacaaacccgggtgtgcaaagttcatgaaggctagctagcaaaatgaagagctacttgagaagatgtttgaagacattcgcaatactggtgctgaccattggtctttaggacaaggcaccattccgacaaacaccactcatgcaattcatattgccgatgataatgaaattgatgaggaaactgatgaggatgaatcaactgccaagataaagagggatggtggtggatcaaagatggataaggggaaaagagcaagagtggatcccaaaagatggtacaggagatgtccaagagtaatgaactctcagcacagacattatcatccattcaatcatttgctaggtcgagcgaggatcttctgggttgttccataaaggatgttatggccttggaggaggattgtgggctagttgaagggacaaatgagcacctcattgcaactgagatttttataaataaaaggatcaaagagtgatgtttgtcaattcattgcgcactcctgtaggacatttttcatggcttaagaagaagtacgaagtgaagtatggaaactagttgcatgtggtgttgccatggaatctatccctttgttttaattgtattttttttcatttcagaaaactatctatggtttgatttcagttatgaactattgttggtttgtatcaccttattgtatggggtgtttccaattgtgaacaattattttcagacctatttcatgtaattgtttgcgtatgttcagacttatgttatgcaattttagacctatgttatgcaatttcatacctttgttatgcaatttcagcaagttttcatgaatatcatgttgcataagttgtaatttatgttgcataactttatgtgtagatgtcaagtgatagtgaagatggttcatcggatgaggaatatgattatgatgagtttaccatgcatttgttcgaaactgtagcatccaatctttcttcgactagaaaagctgtagagagttataacacactctacttggaaaaggctccgccaaggacatcacgcctcagtgggatggaatgggtgcaagaaacgttagccacatgaggtgaatgctataagatgcttcgtatgaatgggaacaccttcattgtattacatggtcttttggttacaagcttgaatctactatacatatgcatacaatggaggcacttgcaatttttctatacatacttggtgatggctcatcaaaccaaagagcacaaagccatttcaagcattatggtgagacaatttctaggaagtttgaagaagtattgcttgctgtggtagaattggggcgtgatatcgtgcgcccaaaagatccaaacttccctactacccatgatagaattaggagggatcatcgcatgtggccacatttcaaagattgtattggagctgttgacggtactcatatccttgcagtagttctagatgaagataaggttaggtatattggtaggtctaaattgaccactcaaaatgttatggctaattgtgatcatgacatgagatttacctatgcatctattggacaacctggatcgatgcatgacaccactgtgttatttaatgcactggaaaccgatatagctatcttcccacatcctccccaaggtaattgccacatattatgtcttgtctatttttctatgaagagattctaaattggaatatttctaatgtttgtatatttctaatttttttaatcgtagggaaatattatcttgtcgatgttggatatcccaatcgtccagggtacttggcaccatacaagggacaaagatatcatgtccctgaattttggagaggttcaacaccaactggtgagaagaaaaattcaacttcttacactcgagtttgcgcactattattgagtgatgctttggtgtatggaagatgaagtggcgagttctcctaaatatgcctagctttccgctaccaaagcaaaagatggttgtggcggcaacaatggcattgcatcatttcatttgtgaccatgatgcaccagatatgcattttcataggtttgataggaatccagattatgtgcctaccattcccaagagatttatattattaatgtactaaaaatttgtattatttgctaattatgtcaactattttgtcaattattatttaaccttgtaattttgaagaaattctaaagaaaaaatatacaattatcacttatataccatgaaaacaacaaaaaccacaagggtattattgtcaacctccctcctatcctctcttttaggagttctggagctgacaaagctagccaaacacttttcagctggctccagctcccattgaagttggagtttggagccttaccaaacgggccctcaatcatgagtgcgggagcggctcgggcaggatgcgtggaagcttctgattcggcaagacggtgaggacatggattgatacatccgtttcagcgagaaaaaaaatggatcgatgatgtggcaatcatccggagctattcctttgaggagaaggaaaagcgagtggctgagatggagtttaggctagggattagccctaagggcatttgtgacaatgtcttaggggggtttcaactataaatagagaggtggatgcaagggtgggggtgtcatttttgtaatctttggagatgctctataatagagtttaggtgtgggtttggagtgtgtttgcccgagtggcttttgtgtttgaatttaaatttatgttaaggtgcgtgtttgctcctcattgagcggttgttttgcaacacctatgaataaaatgagttgatgaatttcgtttcatttttgcctctctatttaaattccacaagttaaattccgcttttgtttttgcgatttggatttttcgataacggttttttctttctctctctcacctctcccctagttttggtttttcttctcacctctttcctaggtctggttttctaataacaattttgagaaatcaattttgagaaacacttttgatgagtactttcaatggcaaatcttgaatttcatattcacccctctaaagcaattcttggtgtttcatatgtgcactagtttacaacagaattatgcatatcacacagaaattcagaaacaataagctcttctcttattagatccatttatctattgaaacttaacttttatagcatgattgacatccttaatttcaatttatcgtattcagacatgctaaagatcattttgcctatgcttcctttcgtgatctgaaatttattctcttatagtaaaagatttcttggaaaactatctgcttagattctactatctctgaaatgtatatttgagttgtactattgaaaaacgagtaccatttgttttgacttttaatcacacgtttgcacatgtgtgtaccatagtgtgttttaccattttttagaattaacaatgtaacaattttaattgggaaaatatgttcagcgttctaattaattagcatgtgattgtcatggtttcagttagatattgcatcattcatttgtttggcttgtcctgcttcttcgtcttcgacggcttcctcaccgtgaagaagtaccatatattctctccgtaacccttgtatttctctacaagtaattattcatgcatgtgttgtgcatgcacttatatcaccatggttaattaattatcatatatgtattcaatggttgatcaattgttttacactgttaataaagtgaaataattaaaaaagattggttaccgatcaatttgactggatcgaaactaataatgtcaacctcgttgatgaagtccgtgggtgcctgggcggcctacgttgctcgatctcgccgcggaggtagaagtcaacgagctcctcatccaagaccacgaagtggtggcctggagacaactgcagcttcggcaccagcttgtgtctccgccggcctccattgctcgccggcgctgccaccaccgagcagtcgccgccattgctctccgttttcatctgacgacgacgtagtattttgtgtggtacgctaggaagaaagaaagaaaaaagaaaaaagaaaaaagaggaacgtaggtattgatagatatatcaagacatgatgtaatcatgctcttttctctactatgtttcttaatgcttattctctctataggtgttgcacggcactgtaacagagaaacgttatgttctagtaggaatgcaagtgtagcattagtctgtttaaaaaatcttcattatagatggaatattttcatatatttttagtttcatatatttttagtagctaatattgctagttcttttgttgttgaacatggtacaaatttgtatccttgttctaaaatctgagattgtattaacacttgttttgcaatttgaatcttttgctttaaaattgaaaatctgagagtgctttttttgaaatttgatattgtactagcacttgtttccttgttgattttactgttatcaagttgtcatcgttgattgccaatacagtgtccctgatgccagctgcctcagcaaagtcagagcagtagtcagattacttgtttacattggcttacaaagataggcatgctggttcagagtaaaagtccatgaatcataagatatttttctcccaaaaagagtttacaaggagtacatgaatgaacatccagatagatattttcccctaaaaaaagttggatagttttacatgaacatgaattaactatattttgtccaattgctacaacgcttaaagattttgtcctgaagttaagctaaaactataattcaaaatgagtactgctgggctcaagttctcaacttttcaagttatggatataacctttcccctaggtgattttacttaatttaaattggcaaatgaagtgaatttgtccggttctttttttccgataatggaagctttattaaaactcactcaaatacaccaagatgataccttctaactgagctcagtcacggcctctgtatgaaatgcacacagccacaaaacatgatctaactagaccctcaacacaaaacaaagaaattagtgactatcaagccgtagactagatcgccgcgacgccacccatgttccaaggcaaaaaaaaaaaactcccgtgccacctgttccaaacgacacaataccaccataatagtatcctgaagaccctattgtggaggataggccaggtgcgtagctaccaggtgactaaagcaataacctgcaaaggagaagacaccatcttgttgtcaaaaattacctcgtctctggttagccaaatggaccaacaaagagttgttgcacccatcaaaagtagatttctcatgtccttaggaacacatgtaagccaacgcccaaacatatgattaacattttgaggaggttttaagttataagccatatgaataacggaccaaaccaaacgagtaatatgacattggaagaacaaatgttgtatggtttcgtccttgtgacaaaagcaacatttcgtatgacctttccactttcgcttagctagattattcttggttagaattacgccctgacgtaagtaccaaaggaaaatctttactttgagcggtactttaaccttccaaatacgtctatttatattcgtgatgcctgtatggacaagagctaagcaatgagaattgacttaaaagactccattgggggtgagatcccatcgaaattcatcttgatcctgtgtcaacaccaaatcagctatgcgaggccataaattgtgacaagtggctaattttgctccgattaaatctcgtctccatgaaaagctcggaggattgttttgaaagatttgtgacatagtcgactgtttatgcttagctatgttatagagacaaggatattgatctctcaatgaggtattacccaaccctttatcatcccaaaaccttatttaagagccgtccctaatacgaaaggactcgaacctaagaaaatctagtttagctttcataaggttggcccaaaaatatgagtctcccgcattcaaaaagcctgagataaaggttgcgatcccaaatatttattacgtagcatctgttgccacattccatatgtggtgagtaatttgtatagccttttgctaagcaacgctacattctttacctctaggtcgcgtattccaagccccctttgatctttgggtggacagatgatgtcccatttagcaagctggtatttcttcttatgtccatcccctttccaatagaacatagatcgaaggtagtcaagtttcttacgtaccccgctaggtattgcaagaaaagacatcatatacattgggagactgctaagaactgagttaatcagcgcaagtcaccctcccaacgagacaagttttcctttccagctactcaatttgttttcaaatctttcaaccacttctttccattctgcatttcttaacttcctgtaatggatcgggatgccaagatattggaaagggaaattgccaacctagcaaccaaagagttgattatattgatatctgtaatcaagcgcttagccaaaacaatatagttcgcttttataaaagttgatcttcaaacctgataggtgttcaaaggtcagcaacaccgacttcatattttgagctttatgtaggtcatgattcataaaaagcattatgtcatcggcatattgtagtatggacagtcccccatcaatcaatgtggtatgagaccttctactgcccttgtgttttggccctatttttcaagggtggctaacatgtcagcaataaagttgaataagattg

SEQ ID NO: 47012 - DNA, 8455 bp, Oryza sativa
aaattaagcaaatcatgcttgatgacttcccaaaaatttttggtaaaattcaacagggaaaccatctgacccaggagctttgttatgctccattgcaaagatcgcttcctttaattcttcctctgagaaaagggcagtaaggaagttattttctacttgtgtaacctgagccatatcttcagttatggtctcatcaagcgaaaacggattttctttggtagtccaaagagtctcttgtagaaattcgtaatgtatgttttcaacgcatcagccccctatttttccttcatcctggtgtagaaagaagatcctcttcttcctatgtttgccattggcaatttgggttaaaatattttgtattattgtctcaaaagagtacatccgagacttttgcgcgttggtaccatttaatctcctcttcatgaagtaggcttgtgagatgatccctcgattgatcaagaagaagtctagatcccaaaggagtctagcctctgcagcgatgtccagagagtcagtggtttgttgaaaatgagcttttttctgtttaaaaatgccattggtatgagcagaccaacctctaagaaatcgacgtaaagcgctcatcttggtattctatctttgaattacattacgacccttgactagtctattccaaacttcgacaacacattcatgaaaatcgtcccacaaaaatcagctgagttccatcttgaactgcttaaggtttccagcgaaagccgcttcctctgtgtcaaggaacataggcatgtgatatgacacccctctatatctagagcatggaccgaaaccagagggtatatggattcccatttctatggaagtgaggatcctttctagcttctcgtatgtcggtataggaagtgagtttgcccaagtgaattgcctgcccgttatagtgatttttgttaagtcaaagatatcaatcacagcattgaagagaaaaggccaacgagcatttgtatcgatcattgttttcttggcactacttctcataatgttgaaatccccctattaaagtgggtagatgattttgttggcatgtacaaattgattccgccaagaaactagatttaaatccatcttgggccggaccatacactgccatcaaaatacatttaaaattatcctccctattgttgatatgaaatttaataaaaaaacccccttcgacaattaaagatagatccaagatagccacattaataccaagaagtataccctccttatcttccttttggtggaaggcaatgccagacaaaatcagcacctccagtgaggcgatctgaatttgtctttgacatttcgtcctttcttgtatcaagcaacgcaacaaagtcgagcttttttttctctaagtatatctgccacataccgaaatttagtcaaatctgaaagacctctgcaattccaaaagatacctatcatgacgaaaccattttggtgtttttttggatttttgggacgagtctttcgctcttttctttttgaagatgatttagattttctagtggaaaccaataagtcacaaattttgttactttggtccacatcctccatatcaatctctgaaatatcctttactaagtgatcgggtagggcaccatcaatatcgtcgccctcgtcatcacttgacataaaaggatccatctccgacacaaaagtattggtctggttattttcattagatttggttcctactttagatctatctacctcaatatgtttcaaggcattaagcgagaaagaaataggaaaattagagttacccaaagtaactcctaaagatctaaagttggaaacaacattatcaagaggtagagatgaaaatggctgtggaggggtagtagcagtaccttgatgaaggatgcattacgggcatagttatcaagaccagaccggaccggcatcggttcaggaaggcatgtctcgtagtgatagagacaatgctaactgcctaagtgcagtcagtatttgctaactaatcacatgtctgtgatttggtttttaacctcttgtgtctgtaatccatggatccaaggagtttgccttcactgttaatcactagcacgggatagctcatctgtaatgggtgggaagcctcatctgtgtcggcgaggggtacacacgaaccaaaagtcacttatgtgaaaagtcatctgtgttgggtcggccgccgtcacagatgacaatcatctttatcgataaaagacggtcacggatgactctcataagtgacggttcataagtacgagaattacaatttttgaattttaaatatataaaaaccctaaaaaatatattttaaatattactagcatattctaaatggtatatgcatacatgtcatatatgagatttgaacataagacttctcaacacatgcaaaccaatcttaccatctcacctacagaccacatgttgattggtaatcagatgttattcttttaactattgtccaaatatgaaacacaaatttgaaactctagatgactttaaataataatgctttcaagtacaaagttgcagatctcatcgagctctagaactttagtgtagggtatatctccattcaaggtcgtttgaaaaattcaaaaaatatttttgaaatatatcacatcacctgtaacacttattcggagatgaaaacaactttaaatgaaaatattgtcaattagaaagttgtacatctcatcgaaccctttgactttgatatagactatgtctccatctgagatcatttgaaaaattcaaaattacgtatttcaaaatagctatcaccacttataaggcatattcagacatgtaaactatctcaaatttaaatattattagttttaaggtcataaggtatgtctctatttaaggttgtttgaaaatttcaaacatttgaatttttcctcatacgtgatggttcgtgattgtcactcttcatggataatgctatccgtgaagggtgttaattaagtcccgtcacggatgagtgctctcatctttgatgggttatctcattacacctgtcacggatgacatgttatccatgacggggaatggttgtgacctgttatgttataggtcatatgcgatgtgttagaactacgagtctacgatctgacaaagatgactttaaattggtgatggggcatggtttgtgactcgttataggtcatccgtgacgtgttagaactacgaccccacaaagatgacatatcggtgacggaccatccccgatagtcatatcttaaacatgatacttttttaaaccgttagagatgagtcatccgaaaaaggttgcattagctcgacacatatgaatcgtcaaggatggccggacttatactagtgaattatcatgtgctaatttgatcacacagaaaatatgcgttgcaacagaaacaaccacaaacagccgtccagcgtggtcagggaaggaagacaatatgtcggctcaactgcacgcagccgccccgctggtatctctacgcaaagcatagctctgtttagatttcaacttttatatcacattgaacttttctacacatacaaactttcaactttttcgtcacatagttcaatttttttaaacttttaattttagtgtggaactatagacagcccattctgttgttccagacgcgccgccgcaagaacctttccaagtgccgacgtcgcaataccgcgcgtctctgcctcgagcaacgctagtgcgctatcacgcattatatctcaagggaacccaaatgaacttattccccctatcactggtccggcccatcgacaaacggcccaggcccaactgaaatgcattttatttatttcatttattttttcttttcctccttgtcccctctcgttagggtttcccctttcgcccccgccaccgcggcaaaaaaaaaaaattttggaagcctcgacgagcgggacaacgccccgcgcttttcccccacttctccttcccctccacctcgtcgccggcggcggcggcggctgcggcggtggagagcgagatggctccggcgatcgggtcgcggcggctcacggtgctgcgggagttccgcccgcacgggctcgcggccgaggaggccgacggcgagggcggccccggggagcggccgccgcaggactacgactacttcctcttcgacccggccctcgccgcctccccggccccggagcccggggaggaggccgcctcctcctcctccggcgccgacggcgaccacgagctcttcatccgtgggaatcggtgcgcacgacatcgcctccgctctacagtgactgtatattgttggtggggattgggagttgggggcatgattaagctttgtcatcccgtcgaaatgggggaaatgggcagaattgactttattgctctgtgatcgcagcgaaatgtagcaacaactatgcattaagaatctttgaatttcattgttcgatttccacctctaagtcatttgtatctctacgtccgggagaggcatatggttttgcagactcacactaagggtgtgtttggataatggaaaatgtggagtggaattgggattgggaaatgaatgaagggttagaattaaatggaagagggagaatgaatggttaagatttaaagatgtcttttagtggatgggaaatgatttccctatcccattagccaaacagggcctaagtaatgcaacttcatttttaatttactagaacttgtagtatgcttatgtgtccccaatgcatttctgcgtattggcttctatattttatatgctgctatttgttctagtggtcaaagagcaaagatgtgagcgcaatagggcattttaccttcagcgtgcagataagcacaatgcatttccaggtcaatgtcgtactctggaatgctcctccgtagtcaccctaggaggcatgcacatatttaaaactttcactttaatattcacatagacatttagagtcaccaaatttagtgatattattagattcgtcatcatgcatatttccatatcaatacatttaatctctttagctaagcatggtcaaagcctcaaaggcatctatggcagactagatgctagcagaaagaaattggttaggtggatttttgtttctattgatatctgaaaaatgtggcatgaacttgtgtgtttaattgattgatcgatctgttttaaatttaaagggatggaagttgagttcatttatttcttttttatgataatttatttcatttttttatgccaaagtttgatttgcatgtttccagtgaattagatgaaaacacataatataggttgggtgaagtgggaaatttctttttgatgataatttatttcatttctttcatgccaaagtttgacctgcatgtttgcagtgatttagatgaaaacacaccaatataagttgggtgaagcgggaacacactagttgtgtggtggttaggcaccgagttgtggtgctacccgcccagggcttgaatcctgggttgtgcaaaacaaaggttgacctcgctgagtaaaaggctttcagaattaaatgcgactgtgtcctgggcctccagcatccagcatgtttttcgacttacagtggaaatgctctggggatgcctccccatagagtcgagttttttttttaatatataagttggatatgaagttatatatcttgttgatggtactatattttgtgcttaactacttgaattttgtagttcaattgattctttcatttggtaaatgttgatttcttgtatcatcagtatgatatgttcatgttttccctatcttgcaggataatatggagtgccggctcacgtgtccacaaaagatacctctcaccaaatacagtcataatggtattttgactattttgttttgcttgtttaacaagtaactatcttcccttatctttttctttttcatataattgctcataaaattagaactgtgactgctgatttctctgtgctcgatgtgtttcctcctctgagtacttaatctgatcttttttgtttctgtacagacatgtttctttattctcctgcacctctaaattgttttcaatgtttttactagagctgaaaattgctccttcaatgcttcaactatctactctgtacacattttagttgtacagtactaggttgttgatctttccggagaacaaaatgagcatgttgacatgaagcaatacgatccttttttagcttacagtgcattttcttttcatttagcagcatgcttctgattactaaaaatctacaatgggtgctcatttgctgatgttgaactgaactgtaggcctgctggtgtaggatggacaaaactcgtgacgcacttctatgtgttctgcaggtcgatactttatctatatacaatgtaaatggtgagtttaccctcttactatatagtgtagtgccaaatgatcgctgaaatattatcccttaattttctcatgcacatgatttaaattgcaggcgaggttgccagtattccactaccatatgctgtttcatcaatatggcctcttccttctggccttctacttcagaaatctactgatggaggccatatggtattatcctcaacttcactgctaaaatcgagggatttaattcgtcctaacaaggaatttggattgaattacaatgtttcatcccaagtcaatactttggagactgtcagtaaagctgatggggctattttttcgtctcacctcatcttgaaacatccacttgaagagcctcaggtatatttgtgctgcatccacttgaagggcctcagatatatatatgtactactccctccgtttcacactataagacgttttggcctctccatttctcatctggattcagtaacatccataggaattcagacacatatatgaatgaagcacatacatcgatccatgcatgaatttattcaaaacccaaaacattttgtaatgtgaaacagaggaagtgtatgtttttgaccatgatgcaagtttttgagatgaatttgccttctcttccttcaaatttggtagattacaaatgcattgatttctccatggtggcatgttttccttttactattactgagtgccaaaacagaaaggtgcacatattttgcttattttactgcttttgtgatttttataaggtgtcctcacatttttagatctaaagtttgaagttgtcaccaacatagccagcaatacttctgtgagaaaaatatgctgctatattgattttgaaagtgcacttgtatttgcaactattatcttgtggtcatgattttgtagttgtagggaatatcagtggaaatatgctatctctatctgtattccatgcattgttcactggacattttatgaatatataagaagtctgattgattctttatccattttgttggttgcatcatgaccaaatatttttaggcaacatattttgaagaatggggcaggttggatatgatgaaagattttgatgaaaaaactatatggacaagtgatatagtacctctaatggcatcatatcacaaaggtactattttttcaattttttgatctttacatttcccattattttgtggcttgaaatgaaaattgatttttcatgtggcaggaaaatttcagcactctgtttggcaaattgatggtacaacttaccaggaagaaatcaatgacaatgcagtgcccccaattccatgtgatatttctatgcataagtttgcattccgtaagatatggcaggggaaatgctcccaatctgctgctagtaaggtttgctccattccaacttcatgaaaagagctcttttttctgtcatattttccattttccatctatggccatatctttcaatgttgtattgcttgttttctgattgattcattagcaaagtaacacgttttttgtgctgttaagatcaacacaaaagaagaggttgttttgaaatgatattcattatgtaatgtaacataataagaaaaatggggcatggatagattatggccacaaccgatatatacttctcatttctttgttgcagggtctctgtttgtagctttgaatagatgaattctaggtacaataggacaatggtgatcctttccccctctcttctgcaattgtcaaatgtgctccgtgccagttgaaggactttaccaaatgggcattagtgaagctttactttttttttttgtagggagtgttcatgatgacttagaggccttccatgagcctgacgctagtgtacccctatgaaatttgcgtaataagataatcaaactccgtttaaacataatttatatctgtctctgttgtttcccttttttgtatgggattgtttccctttacttgttcatactttgcaattattttaccaccatcattttctttgatatgttttggaaatgactccaatttcctaccaggttttcttggcaactgacatcgatgg

SEQ ID NO: 47013 - DNA, 1262 bp, Oryza sativa
taatgccctagcagctgcctttctttttgtgtacatgacctttagttcattcatgtgacaaatctggttctccattgctttagtagtcataatagcagctgcgcttttctgttgtatatgattaaattctagtttcagtttaatattagggtgtttgttgcagttcgcaccaggtttaagcaaagtgtaaatttgcaccatgtattttggtataatgcttcacttagtagcatgtttttagcttgcccccttccatctgggcttcttttgctgacatggcgcaacaagcagccaccttaccttagacctgatctagaaaagctgtgtgcatcatgtgccatgtaatttgcaatcatgtcaggacacagaattagtaagtttcatggacaaacaaagaattaaagcatgaatccatcacaatgggtaagtttcacgcaaaataagttaactaaatatccagtgccatttgttgaataaacagcgtgacctccggatgtatcatagcatcactgcggattatagaaaaatacagatgaatgacactacttcacacatccatatttcacaccacataggcaacagataataaatcatggtttatttagtgtctgaaccgtgattgcaatttacccggtgcaatatgctcaggtatgcttctctagataaggttagcaaggtggatgtttgtttgtccttgtcagcaaacagaagggggcaaaaggcggccaaagtgcaacaatattctaaacatggtgcaaaccatagacttttcttaaacatggtgcaagctgcaagaagcaccctaagtcctggttcaaactgtaattcttgctcttcttttatttgtcaagtgcagtctggaaagcagtgcctctgcagatatactcttcctactgaattggggaagggtatattttcaaattatgagctaaattctggggttacagagttttactctgatatggagatcacaagcataacggatgctgttgaaggtcgtataaatgtgacatgcagcaatggtctggtaggttgacatatattgctttagtatacttgtggttacttagaatggtgtgaattcctggctgtattttggttgtgtttttctaagtttttttttgttgtgttgatttttggttatttctatatgtttgggttcattaaaaaattggggatagtctttctgttggtagcaatttgctggcttatttgtcaagtctttaggtgtgacgtgttagaactcagaagttcatactgat

SEQ ID NO: 47014 - DNA, 14911 bp, Oryza sativa
taacttgatgctaaacttgtatttttatgatacaccctatcaaatatatagttttaatttaattggatcaaaatagttttatataatttactcaaattataagtttacgatattataaagtatacttaagttttaaggataaatatatgcattatatttgtgtttccaaactacttctaactattttaaaatgcatcaatagtcaaaatttaaaatatttattaaaatttcaaacgacatatctatatacttatgggcagagaccggagagacaattatagacttgcgagtccaacattaccatcaatttttgtaggaggacttagatctatcttgtagtactatgattttcttcttttaaggaaagggggaaaaatgatgtcttaattattcttctcagacacattattattccacctactttggcctaaaaaataccctttgccaaacagaaagcacatcgatctgaccttgacatgtcacattccaagcaccttaaacccaactttgacttcttcctttttctctttctttctcgcgcgcgggtatctctgtctattaactaaactaaacatgcaacgcaacgaattgtaccaactctgtactagctctagctactaccatatagaacgtgacatatataactacgttgtcaatttaacaaatactacttatatattattcccttcggtttcaaatagctgccattattgttgatctgtataatttgaactttgacgatcaacaaaattataaaaagatagctcatggtttaccactagtacagatccttctatctgtgacgggctctaatatgcttagaaatagcgggccgtcacaaggaagtaatctcaatcggacccaaaaagtgcccgattgagatatggtcgctcagacatgttagatgggtataaaacttaagcccgtcacggatgacacctatcattgacgggccacaactttaggcccgattaagataacattccatatctcaaacgggcctaaagttgtggcccgtcacagatgaccatcatctgtgacgtgcaccaacttgaggcccgtttgagataacaactaggcccgtcacagatgattcatcagtgacgggctatatacttaatctctatcggtcattaactaaagtccgtcaccgatgactattttttcatttttcatatgaaatgtttatatttctaagttgactatagcaaaataatttatgggtagtaaatgatttcaaatggaaaaaatgtcaacaacaaaattgtataacttatcaatatttacaacttttagtttggtcatttttcaatataacatttttttgaacagtttgaatttgaatttaaaaatatgacaacttcaaacaacattttcaaatactaaatgatttcaattgaaaacgtcatcaacaacaaagttgaataactcatcaagatctaaaacttttaatttttgttatttcttcatctgacgaaatgttagtaatattattcataaattttacatatatgtgctatagtttataaaaccagataagagatatgtcaattttatgaacaatgttactatcactttatcgtatgaagaaatgaccaaaataaaagttttagatcttgatgagttattcaactttgttgttgatgactttttcagttgatatcatttagtatttgaaaatgttgtttgaagttgtcatattttcaaattcaaattcaaactgttcaaaaaaatgttatattgaaaaatgaccaaactaaaagttgtaaatattgataagttatacaactttgttgttgatgactttttcagttgaagtcgttcactgatctaaaattctatttgaacttttcaaactttgaatttcaaatttcaaattgtttaaatagagtcagatggagaaatgaccaaaataaaaattttgcacctcgatgagttctacaactttggttttggtgacttttccatttgaaatcatttaataaccccaatttgacatcctggcctagggcataataggattaatacaatactcataccaacatgttacaattacttttccggaagccaatctctagagaactttgacgttaagtgtgcttggtctggagcaattttgggatgggtgcacacgagtgagggctagccagaaaataaaatttatttatttttggaatatactcatctgtgacgggcattaactggtcgtctgggaagtttaaacttcccacgtgggtgcacacgagtgagggctagccagaaaataaaatttatttatttttggaatatactcatctgtgacgggcattaactggtcgtctgggtcaaagctatcggtgacgggctttacttagggcccgattgagatagaatcatccgtgacagccgtttgcccgattgagatagctcttcacatcagtgacttctagcctgtgacggacgccatacccgattgagatggggcttaccgcccgattgagatgagggtatccgttatagtgtacaaaagtattgtatatctatgttaaggatacaaaacacacttggtgaataccaaatatttttgaagtatcgatctatgcattttcttaaaatgacggccggcgagcagttaaagtttaaaaataaatgaatagtatatccagtatatatatcaacatctcccaatgtttaacgttggttagtgcaaatcaacgtcaaacaaaaaggacggagagggagtatttgtccagagatcaggagtagatcgatcagtacacgcacgtacgtacattaattaccagatgtatcacagatgaagctgtccctactagagaaaccatctttagtcggtcgcctaaaaactacaatagtcccggtttaaataggaacagagactaaagatcatttttaatcccggttaaaaaaaatttaatctttagtcctggttagtaactaaagatcatttttagtcgcgatcaaaaggttgttgggtcaaattcagaccccaattatctttagtcccggttggtataaacaaccgggactaaaaataggttttagtcccgattgtttataccaattgggactaaagataaaaccacctgagcggcgcacgccagtagtctcgatcttatctaatccctcccccttcctctctctctctcctccctctcattaacaacctcctctcagatccggcctctctcagatctcagccttcctctccccttcctcccccttctcctctcctccccctacctacctccacctcccatacccgagcgagcccagacggccgagcccgggcgacggcggctggcgctgtgggcagcgggccgcggcggggggcggtaggcagtggcctcccctctgccggaggggaggcaggaggcggcagcggcaacccttttttttcgaatttgtgaatcattggatctgtgatgtatgtgatttgtgatgtattgatgtttggatctgtgatgtatgtaatttgtggtgtatttcttttaaaatttgtgatctatttttttagaatttgtgatgtgaatctgatttgtgatgatactttgatttggggataggatttgggatatgtagggacatttgggaggagcaactggatttggaaagaaacaataaaaaaatggtgaccaaccaggattgtgcgctgccatcttttgtcccgattggtaacattaaagatgtatttttagtcccggttattttaaccgggactaaagatagcgatctttagtcccggattcatagtcccggttagaaaaaaacaggactatagggggttaccagccgggactataaaggctttctccacctgtgcgtttgcttaagcttaaaacctaactgataccatatataccacgtatatatgcctacaacttgcactatattattgttattaattatctgacaccgtaccatgcatgcatgcagcgcaggacatatatgcatggccggtggagctagctatcgatcgatcgaggaagaagacgacgacgtacgttgccgtcgttggcttagctgcactgcatttgcatatacacgtacgagcgagcgaacgacgacgacgcgcgcggcgggcgagcgatccccatctatcgcaaatcgcaatgaggcgcgcgcgcggcagcaatcgagcggcgcgcatgcaactagctacagcaacgcgccaccctcccccggcctccatcgaccgagagcgagagcttgtgtgcgtgtatgtcttccacgtaattgaaataatcttcgattttatatatatatgggtgtgtcaatggaactaacttatattacaagaggtaatcgatcgagagcaagatcgagtctgtgtgcgcttgcatgtcttctacgtaattgaaataatctacgactttatatgcgtgtgtctgtgagggtggagctacacacattataagagggggagtgtcaataacctggctgagaaattcttttagttacagtttatctattttcattaaatgggcattttctccatgccaaactcccgtattatctagtttaaattcggttgaagtagagtaaaacaagcatgtctcctatgtaattgataaaaatgaagaacgaaattagcgatcggcatagctggctgaggctgcgcaccgaatgggagccaatgatcttacggttcactacacagttcttcacattcaatcagttcacgtagaagtttccagcttgcggtacacttcgacgtacaacttctgacgaactctttgtcttcctctggattgtctaatcccatcgggattgtctatttgtcttcctctgtttatgggacaggtcataatttaatttaatctgcttggttactaagatatcacaaacgacgcaatcaacacgcggtgtgttaggaaaatctctgagaatgctttgctttggtgtcaaatctgcatgagacctcacatcagtttccttgttgatgtaccatctaccacgctttctaaagcttaatcctgcctgacctgaccaacttgatgcatggtagtagctagcatcccctttgtctttggcagctcatcctcttcaactacctcaacggcagaactagctaggagtagatagccagaattttatgtaaaaaaaaataactggactattgaggcacatgaagcagtgtgaacgacgttttcaaaattcaaaattgaattcgggcctcaaacagaaaaacaaaaatgagtttgaaatttgactagttagtagttagagatgcaagctggttttgtcaattaatcccattgcgcaacacaaactatgtactccctaatccattccataatataagggattatttccttttgggaaagattaagaatgaaaagaaaagactgcaatgcctctattgaatgtgattttggttgtgacgagtgggtagttgaaggttaaaataggtagaaatttgaattagaattaatggaatgtgacaagtagtatagcaaagtcccattgtgggactaatagtaggaataaaatctcttacttcctccgtcccataatacttgtctttctagcatttaaaaattgtcccaaaacagttgccattttgaagtactacatgtcacatcaaccacttccaattcaaatttctccctattctacccctaaccaccatcccacatccaattatccattattagttaaggggtattatagtatttttcttcaaatattactatatgctaaacaacctataacgacaagtattttggaacggtggtagtatattatgggatggagagagtagaaagtgaacatttattgggtgaggtgaacaatggcccactcaatatatttcatcgcaattaaccagaccgcatcctttgtcattagtgttgaccatttgacttgcataaatgtagtttaaaattttcatttggtgaaacctctaatcaaattttcccaaactgtaaagttcaacatctcttaaacatttagattggataaataatgattttattgtagatctgtcttcacaactattttttgccatccaattttatttttcttatttcaggcatccgaaatttttgtaggtagcaaacacttaccaaaaaaggagcgcttttccaacaaatattggaagtaattcactatttttattttttttaaatagcctcagtcttgagccatattagcacatatttccaagagtaaaatcacgcaacctgtccagaatctagttttttaaacaataattaatcgtacgaaattcgcttatttacatggtttatatatattaatgatggccaaaatattacagtcataccagattttgccaaagctgaactccccctgtgatcgaagaacacataccaatcttgtagcgttaggcaatgtacaaacttcacacaatcaaatctcctaccccctccgtttcacaatgtaagtcattctagtatttcccacgttcataccaatattaatgaatctagacatatatatctatctaaattcattagcatcaatgtgaatgtgagaaatgctagtatgacttacattgtgaaacggaggaagtaattcagaaggaataactaataccttggccctagctataccatagcaacctgatcctatctcaccatctcgtgataaaagcgcctcctttaattacaaacctctctttttttttctctttctagacaattaattgctagtacaaattaaaagcccccctctaggattaggacactaattaaaacccttcttttgcgaaatccgtaacaattctactactatcatgtatcctcctgtgacctctcacctatcgcaagaaccccaaccactggatgaagtgggcatagtacatgcatactcctaagcaatagtagcactagttaggtcgaaaaaatccaagtcgagccaagcacaagaatttattgtcgccgcgtgccgtgggcggcgtggctctcgctagctcgccgcagtggtcacgcccaaatcatcttctcgcctctgcttcttgctgctgcctagcttagcttggcttaagcttatctctcttgcattgctttccctgcctcctctgcaagagctccatcatcatcgccattgctgcaggcttctctctctttcccttcttaagaccgtcctgctcttcatggagaggatgagcagggtggcggtggctgtgctgctgctgctctgcttgcagcttcagcttgggatcagcggcggcggcggcggcggccatggtgctcggcgaggtgtgtgttgtatgtttgtttttgtttgttcagatgatcagcttgtccaagaatgttctggtttctgtttagctgatttgtgtatgttttgaaatcattgttatgatgtggtgttgatggaacggcgaattggaatgaaggcgtgcgccctgcagctcggtgagaacgattgatgttttcttggctcactttcatgttcgtacatgccctgaatttcagtctaaattttgacaaaattcagagactcttaattataggcagtagtaataaagtttattttcaaaaaaccgcaataatagagtttcctttaaggaaataataattcacagtgttataattaggttgcagcttgggcataatttcttcttctcttccatcacaagtttcccctgcatttgaacaagcataggccaaatttgcctgaattatccgtgaatgttcatcacaaagacatttttccatagaaatcaaagtagatatagaatggtaggaaaaaaatttgtgctaggaatgttgtcgtggctgtcagagatggacagctgaacaaccaaccattcgaccccatccgggctgcacgcatgttcttgtccaattgctcgtcaactttagcctcatctctgctcaatcattcgcaggttgatccatgccaagaagtcatcatcatcttcgcagcagcagcagcagcagcagcggagcaggcaggccggcagcaaggccggatggccgtcgacgtcgtcgacgccgtcgaacccgttcggactcccgatgctgctgccgccgccgccgccgctcaaggactggccgccatggctcgacatgccgccggtccagggcccgtcgagctcgccctcgccttcgccttcccctgcgccttcgccagcgtcgtcggccgcggtcgccgagcacgcggccccgccgcggcgcggcgaggaacacgcgcgcccccgcagcatcgcgttgccgccggcgtctagctccggcgacgccggcgaaaccagccggccggaggtgacggacgggagcgcaacgaggcgcggcggcggcggcggcaagacgaactacgttcttgtggcggcggcgggggcgtcggtgcttcttgcggcgtcggcggcggcgttcgcggcgtgctaccggtcgagcaaggtggtgaggagcgtgcggccgtgggcgacggggctgagcgggcagctgcagagggcgttcgtgacgggggtgccggcgttgaggagggcggagctggaggcggcgtgcgaggacttcagcaacgtcatcggctcgctgccggagtacaccatgtacaaggggacgctctccagcggcgtcgagatcgccgtcgtctccaccaccaagacgtcgcccaaggactggtccaagaagtgcgaggcacacttcagaaagaaggtattactactgcctccctttgtaaatattactattattattgtttattttattgtgaattggtttatcattaaatgtaatttaaatatttgcaaagaaaagctaaataaggacaatggtcaatgacgttatgtattaaaaaccagagtaaataattgtcaattagagtacatgcacaaatcatatctagaatctttagtgtgtgtaagatacgttcccttgatattattttaattttgactaccaataatgcaatacttgattatttttttccctaggtccctatgaaattgaactgattcactgattcctgtgaaaaagtttacgagataacggtgcctaacattgtgtcatttgtgttggggggttgttccagataacgagcctgtcgagggtgaaccacaagaactttgtgaaccttcttggctactgcgaggaggagcagccgttcacgaggatgatggtgttcgagtacgccccaaacggcacactattcgagcatctccacggtaattttctttggaactttggatttctacctacttcgacaccccgacctgtagcaagcacgaaaaatggcagctgacattgacggtgggaaatgcagcgagggacgaggggcacctggactggccgacgcggctgcgcgtggcggtcggcgtcgcctactgcctggagcacatgcaccagctcgccccgccggagatcgtccggacgctggacgcctccaccgtctacctcaccgacgacttcgccgccaagatctccgacgtgggcttctgcgaggaggagatggcggcggcggcggcggcgccggcgatggcggacagggagagcgtggtgcacgggtacgggatgctgctgctggagatgatggcggggcggctcgcggcgtcggagggcgggctggtgcaggggtgggcggcggcgctcctccgcggggagcggcggctgcgggacgtcatggacccggcgctgcggggcgccttccacgccgagaccgtcgaccgcctggacgccgtcgtccggtcctgcgccgaccgcgacccgaggcggcgcccctccatggccgacgtcgcggcccggctcagggagatcaccgccatgccgcccgacgccgccacccccaaggtgtcgccgctctggtgggccgagctcgagatcatctccaccgaggcagcctgaccagcgtgccagtatttgtaactttgctcttgaaatgaacctactttgcatccatctgtaaatatgacatgaacaatgaggggatttcatatgtagtgtgcgtgcagattcttgtgaggtgtttaacgagattgaaatgtaaaaccttgtgtagtttcacaaaccaatctacctgagctgtacagcttctgcataacattcatcctgcacataatatctgaaaccaaagcatatacaagttcaacgagtatcaacaaaagcaaagttgtgtggtagcatcacaacgtctagtatataactgaaaccaacatcttgacaagtttgaaatgacttgccaacaaggatgacaattgacaagaacattgcatttgcaaatacacatgacaggctggcaactttaatatcacctgaacatgataagagtattagagcaggtacaatagcataatttagcaagctataagccagttacaaacatattttaaaaagataaatgaggaaaaaaaagagcagcaggctacagatttgtagccagctgtagcacggactccaagaaggagtgtgtgtatgacatgtgggaccagatattaatagtgtaatatgtaactattgtatgaatgagctaataaattgactatagataaattagagctaatagttggctatactattaaacttgctcttaggcaggcagtaacatcagcagaatcgaatggataaacaccacaggtagaatacattaacattaacaggtttagctgttcaagacattcaatgccagaatccacccacgccaaatgcgacgcataaactgacttgacagactgacgacaaaagcacagaagcagcctacgactgacgctacatatatgttggtatcctttcgttcaatctgtggcaaatggtcttggcacagccacaaaagaaacctccccaataactgacaaaacaaaataatcccctcttaagaaaccagtgcttggtttatcattccctgggcccatgacgcggtgtccctaacttcatcatccaaatcgtggcactccctcaggaactcaacatggaagaggttgcttttgaacagatcctttgagcttgagccgagtgtgtccgcaagatcccccaggacagcaactgcagcctttgtcacgctctcatccctgaaagtataaacacaaatgtaatgtatgtaagcgctaagcaggtaaaaacttaccaatataatacaacataaattgcaatgtgcatgacattaacctgctgcggtccttgtagacagcttcagtgaactgcaatagatggcttgcatagggtatcatcaactgagcttttgcaccctttataccctggagtatgccagagtaagcttcaaagattccccgtctgagctggttaccataatcaaccatatcctcatctgtatggtccaaaacagcaagaagttcggcagctccttgaagcattggcatagcataaggaaggtatttctcaaaattatcaccaatagcaagagcaatgtctccaaagcatgagaaaatcggaggcttcacagaacgattaagcatcgagtttgacaggtccttggaagaacagtcataatcccatcacagaagggcaaaattttatcttccaaggcacggcaaatatcacccaccactccaacagagatggaacagacttggtactcttcataattctgcaagccagcttccagatacttgaaaaactcaggcatgtatttcacaaaatctgtaccagtggcataagcaagagcaccgatggcaagcatcgcttcttcgtgtacagtagagctgtggcaagcaaaaacatgcagaaacagaaacatcaactgatcagcagtctgggcaattattgacttagcatccgagctgctcaatttctgaatgatgacctgcagtacaccacacagtaatgcctgaagatcactttgcttttccttgtcaccagatgaaagtatatggagatcaaacgtcagattcaatctcctcatgatctcctgcagtaactgacctataatgcctgacgtttcagatatgttgctgactctcacaatctcattcaatgcttcataagctgatgcacgaagcctgaagtgggtggtatcagcacgatccgccgcagaaaggagagcagcaatgagattaggaagaaaaggtgtaagcacagatgaaatcgactctgcgtcttcataaccttgggcaagaaaatatatggctccacagactttctcagccacatttggaacatccttactactttccagcaagacagtcatgatacgagtaaggtttgcgcttgttataattggatttgcactggctggagaatgcaggagctcaaataccctcccaagagtccatgcagtggtgtcccttacctgactattcgggtcttttgttgtgttcagcaggaagtcaaacccagcctgtaccaggggagcaagtttctccacagatggaccttcaaggatagaaccaaatgcaaaagtagctgcctcacgacaatgccaatctggttttgtgatgttaccctcaacaaaaggcatcacaagaggcacaatcgcatcaccaacagttctagcaatgagcccaaggcatgtcccaccactcatggaaatgttccatacattatcatcctgatcttgatcttcctcttgctttaacagagtttctagcagcatcggaacaagtgaagggagggccttctcaatgaagcgataatttacagtagaattagcatcatcagatccctcatattcttcttggagctcaatctcttcatcacaaatagtgctcagaactcaatagcttgaagtgcaactgcttcctcatctcctttgacagcattagctgtcaggttgaaaatggtttgcatataaggatccaagtgtacataatatgtggaagcaattgcaacaaggcattcaaaggctgcctgcctgatctccacttccttcgatacagcagtatcacaaattaccttcatgatataattcctttccatttcatttgcaaagttgctctcagcaaaatcaagagcattatatagggctttaactgctgcaagacggacttcagggcttagctctgtctggttcattccctggacaacagcagttagaacagcattcacctgatcctgctccaagtgttcaggagaaatctcctcacagacataccctaaggcctctagagttgcttgctttagtggagcaggtgcaccctgttgtgtcatgttgcccaataatttggcaatgagttcttgccattcacgccgggggatctcaatggatgcaaccttggcaatgacttgtgatgaggtatgcctagcatcatgcaccgaagatcctagcgttatcagcaaggactcctttatcttctgtttgattgatggatccaggctgacccattgctgaatcagtagttccttttttgcagaatcctttgcatccaaggagttcttaaggataataccagcaagtcgtctagactctggtggtttttcattatccgaaagttccactgacaaggagagaaggaagttgggaagattctgctcctggaactgcttgaggttcccttctgctactacccgaaggttaccatctgcagattgagctgatagcaggatttgagtgatattcatggctgtaccaactgtcctagcagacatcaaagaaacagattttagctgttaatcatgttaagcgaaaaacaattacacaaacttaatgaaaaggcacatcaattaacaatcctagcaactaaaggccgttgggccagtttgacctagcttagggtccttcagaattcctttccatccacagatacttgcaaattatggttacaagatgtagaactatcaccatgcaacatttatgttatccacattagcaacacagttaagctctgctaaagattattcaaatttaatttacccttacttaaaaattgattgtttcccataagaaaatcaagttactcagttaaacagttggataagcacctcatttggccatgagtttcatctaaacaagggaaccaagctaagtacaattaacaatgcaaagctcaattagactaactatgctgtgggcaattagatattcaacaggcagctgcacaagtacactaagtcagcggaacacattagataaaatatgaataaccaaataaaagggcaacaccctgacatacaatgaagaaattactaaaccaaagtaaacaggttgaataggtgaatatgctattagtatcaggatcttgaacaggccaaatcagtttgttatcaatcaaccataagaaaagcaaacatatatgctgtggtataaaaaaaaaccggtccacacaacataggcacaacataagcatgtgaatagccacaataaccagaccttggacatccacaggtattatgtttacactgaacagcaccacccagaagcaactcacataacaaaaaacacaaaataacctaaacagctagcacaagcgcaggtagacctgggcagtatacaatgacatctcgtgccctgaagaccaacaataagagatggaacagtatattcagtgcaaggtcatcagaaaatcaaagggggtaaaataggcccaatcaaatagcgggcgctcatctacacaaacttagtggatggaatattgcagaaagatctgtattacctttcttgcaacaatgaagagaaaaaattaggtcaaagtgaatccatacacacttccgcagcacatgttgacctaaatcttaacatctaaaaccgtcaaaatgagcaccccttcccctcccttccaactagggcaaaatcacttgcaacacgcctaccgcgaaatatataacatgatagtaacctacccacaggaatgcttatactagcataaataagcaaaaacaaggttaaaccccacccttccctccttcaaccagcgagataatccccacaatatacggcagtgaatcccaggcgaactgcaaaaccagcgtttccattttaccgaaagcagaagattcgagtgccgtagctcacagcgcgcgcaagtgaagagaaaacggattagggtaaactcccccccccc

SEQ ID NO: 47015 - DNA, 3542 bp, Oryza sativa
ttcctgcagcccaaagagagaagtagaccgtaccagcgggagataccttcccgtgcagatctggatctccggctccgctcctccgctcccctccgctctgacgaaggaaagaacaagtgccctccggtcagagcacggcgatgcctgcgacgaaggcggccgcgagaggaggaggagggggatgctgacgcgctcgcctgattcccgaacggaatggatggaaggagaaggaactctgctccggcgggcggaggaaggggggaagcgaggaggtggggggatttgaggggggaggaggcggcggaggcggctagggtttacgacgcgggcgggctccggggttttggaggtgggcttttgggagggagagacgcgggagggacgcgtggcttcatcccagcggccgcgaccgatcggacggccgagggggatcctatccggtggtcgcccttgctggggagatcggacggtcagtggtggaggtgcctccttttgaaattcaaaagggataagaaaaggtatactattttgtactcctaactcctgaggttaatggggttattttatagctagtcatacgtctaaatattaggcaagtttgattagcttaggtagttgtatagggagtagctatataacactcgacagttttttagatgaaaaacttttaaatgtaactattatgtaactatagtgtaattacattgtaactactatgtaactgttatggaactacagtatatttagtatttaactcaggtgtaactcccactaaagtgtaatggagcaagtgtgtatgctgtaggttttgggttcgatccccatggcgcgcttgcaaaatttttccatcttcctgcaccgtcaggcacgaactaggcttacaaattggtgcagacacgaattgggcttgcaaatttttttctatcttccagcaccgccagcacgaatcttggagctggatcgaacggacaaaaaaaggaaagttttcagcgctgaaaactgtcgatagttaactagcaaaaacgtgcttttaataaagggtctatctatataaatcatgtgacacaaaatcagaaatgtatcttaggcttactaatgacctaagatgtgacaataattttgaacacttaggctgtgttattgcatggttaattaagtattaattattattttttgaaaaatagattaatatgattttttaaaacaactttcatatagaatttttttgcataaatcacaccgtttagcagtttgaaaatcgtgcgcgcgaaaaacgagtgaggtgggttgggaaaatagggggaagaacacagccttaatcttagacaaatgtagcaaaaaaaattttggtaaatagaggaaatttttagcaaatgagtaaattgactggaaaatatataacaaaattctaagttgtgcgcaagagtatgtagtgaccttaggtcacggacaaatcagggataggtaggaaagtaatatgttcccaaaagtgagatgactcgaaaagtaaagtctcatctgttgtatggtattatgatatatctgacctcgtgtctgattacaagatcatgaccggcttatatagcctccggaggtacatgtgaggttacaatcctacccctaactatacataggaagttacaacaatacccctgtaaagttagaaaccctaatagtatggcgccagcttataggagtggttaaaatggtccctgcagtatcttcttgagtaatattcctcactcaatgatataattttcaggcttcatccgccatggtctaatggtattttcctcttgtggtaggctagaatactcctttccagactagcgttcttaccatgtttgtcagtcttttagtatttacttgtcacattaggtcgaaaagttttgccacgagtaaaaacctcttttccaagtgggtaagagtgtttcgatcgaatatgaggatggtgtttgcctcttgctacaacagagtatttggaatctagataaatttggtcaagccttcaaaggtgtattaaattatatttgtctcataaatttttagtttttttagtcttaaacaccattatgtttgatcaaattacgttatattccgctaaaaggaagtttttataggtttaaatgtttcactattatgtttggtcgaatctacatatctcaagttggcggtaatgtcgccgtttgattggaccaagtagcagaatgattaggtggcatgtgtaagaaaaaaaaagagagaaacaacaaacgtcgcatgtacgcatccgcctccccagcgctccctttcctccatctatccagcaccgtgcacgtaccgacgtacgcttccgcttgggccattggcccaaacggcctccccaacataaccgcgcacagcaacagcaagcccacttatctcctggttttatcttaactttctttaatgaaaagctaacgttctggctcacgtatatgtgtacggtagcgtatacgtgaacaactaaaaacaaaaatcatgaataaacaactagcaagacaaactacaaatttaggatctgtttggtacaactttagcttcatccccacctctcttgaagtcagagagtccaaccaaatagtttcaacttcattaaaaataaaaaattgcagtggagctggctaaagttttctacaaaacaaactagagaggtggagctgatttagacagctccacaactacactccagacccaattcttataattaaatttaaaagttaaagtcttaccaaatagaccctaattaaaagtgaaaatataaactaaaagacatataaaataatagataaaatcatcggatttgagccctcactcccacggtcccacccatagtcaattcatactcctaatctctactattataaaaattgaagatgtttccgtggtccgtaatcggtgtttgagtcggttataaaaattgaagatgttttcgcggttcgtcatctgtatttgagtcggttttaattttatgttttggttttaatctatatctcttctctatctctactattataaaaattgaagatgtttttgctggtattttggtatgtcatccgtgtatgagtcagtttttaagttcgtttgcttttggaaatacatatccgtatttgagtcggtttttaagatcgttcacttttggtaatacagaaggaatcatataagaaacatgtttaaaaaaactcgcatgctaacttgagacgatcggactcctaactgcagctcatgattttctaaaaatacatatatccaagcgaactcccacggtgaatttcatcttaactaaaccatataacaataataataagattaaaattgacttcacccgttgcaatgcacaggcatttttttctagtaaaacataaaatagactatgctagctattgttgataaaacttctgttgaaaaaaaaatattatgttctaattttttagatcgtataagttagataaaacacaaattgcagcaaaacacgaattgtattgaaaattcataaactttattgaaaaataggattccgattt

SEQ ID NO: 47016 - DNA, 1740 bp, Oryza sativa
  unsure (1)..(1740): unsure at all n locations
ttgaactcaaacataagcttcctttggtacacatgagtttttttccttgatttgtatgaaaaatgagctccttgatgtaaaggctctctttgtttaggcttataagccaactttttttttaaaaagtttaagccaaaacaaacaagcagctttttcattcggcttttttgaagccataagccactctaacactattaagccaaaagctaggttggagaagctttttttggcttatatgagatagatgtatgactccaccactaaacttaggacattaaatccactggcttataaatcatataagtcaataaactgacttaaaagtctaggccaataagcctaagcctaaacaaagagggccaaaatccctggaaataaccatgaaattcctacccgtccaaggatgcccactacagatattgtactgctggatcgctcaataagaatttaagaagtgagcatagctcacctgatggaaggtgtgtgttcagcttcatcctccaagttcagcttcagtaagcagtacgcttcattcttttttaagatgaaaaaccctactacctaataaactaaactaggaatcgtgaattcgcgatgcagatgacctctcttcctatcgtacctcacctgcagtgcatatctctgctcggtcgccactgccacgccatgccactcctgatgtatatgttacatttaactttacaagttgctcccttttcttttcccatatataccaggactatacaattagaaggtccgaaaggcaaagtgtacattgatcgacagtctcgtgtacgataccctacaccaactattgtcctcgtttcaccaccaaccggtgatggcagcactgaagatttacaaattctgtatgtactctcgcagtctcgtccaacaaatagctccgacgaggatgaacaactcgaatcgagctccttttcagccaaaaatatacaaggaaccgtaaatatgtaccagctgcttcaccctcccagtcagagtcttctagcgtctccttcaccagagccctcaaaagcatttgaagctccagcttcacatgagcataagtaacttcagagccagataggctcacagcatgtgcatcatccatagtttgaacttgcgcacgtatagatatatgacgcacggtccaatcagatcagtttcggagagtcgcttgcagagtttcatgtaggactccaggctgccagattcctgtatgtttctccgcagggcggtcagcacagctgctctgtctaggtactctggatacaagcccatgtcaagcatcttcatgagtgtttccgaggcctccagataaaagccgcctttgacatagcctcgtagaagccatgacagagacttcttccttcttccagcactggttgactcgactccagcgagcaatcgacggacggcagcaacttctccctgagaagcgcagatggccaaaacaacatcatagagctgtgtgtcaggttccctaccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47017 - DNA, 3077 bp, Oryza sativa
  unsure (1)..(3077): unsure at all n locations
tacgcaatcctccttttgcattgtacctgtacaattattacgtctcaaaagtatattgctgtcaaattggtaagctttgtccatctaataagatgtatggtgacttcctgactgattctttattagacaagtcttcctttcagatttatgtattgttctttttttcttttcaaagtagtggattccatctgttataggaatgcatagtgaattgtatacatgacctctgccagcaatggttttccctccttatctacatccaatgctcattggacatatatagcagataatcttcaaaaaccccttttcaacagaaccaaatacatttttttaacagaaaaaaaccaaataaataactcctaattctctcagaacttgctattagaagtgatgaggttaaaaccacctgcttgtcctgctgtttttttttttttattttccttctgaaggcacaattactttagtcattcagtgtttccttaggttgtcgaaaaaatcaggtttattgtggtattgtttctgtttggtcactttgaatggggatgtgctgctttgttgactgccaaattgatttttactgcttttggcttgattgcaatttttcagatgctctattttcatgtcccttcccggcatccatcttctacgccagagttggaattacctactcttctgcaggtagcatttgcgattagctaatgacttactgtgtttttcatttatttttatggattctcagcatgtgatccttgagttaacaggtcttacattcacatgttgtatactgttgcgtgttgtaaatatttgatagtgaaatggatcctagaccaggcaattatttgtaaatattatgtttgggtggagcacagtcttaatttaactcttatatgaacatttctagtaagatatgatttttgtttcagtaggttttggtcctttgtgggtttcgccgaaggggtaaaaaatttgagaatttgtttggttattgacagatgagatgaaaaatatttttaaccaagtactaaaatctcattgtgcagtttgtttataatgcatgctctttacctagtgctgttctaagaacagagataatgtggttcctagtaggtttatatcgttactagttttagcaaatgcaattttgaaatttcgacttacgatgctcaactagggatttttctgcatttgacaagcaaaggctttatgggccaaaatctggaaaatataaagtgatgcttagcatttgatttgttggctttagttttggttcaatattagaataggttgtatttaatgtgggtatgactagtgttaacctttgaactgtactccctccatactcataaaggaagtcgtttaggacaatgtttaagtcaaaccttgggaatataaatcatgattaactctcaagttgttgagtttgaaaatataaaatttatatgaatagatttgtcttgaaaaatactttcataaaagtatacatatatcacttttcaataaatattttttatagaaaaaagaagttaaagttgtgttttggagaccgtgtcgctgtcctaaacgacttcctttacgagtacggagggagtacaccagagttagaatgaatcaagataatcttctattgtgggtttctgccttttataatttattctttgccatcttgttgtcatgtagtctgtaatagcaatttcttatccctgtcacctgctattgagtgattgatcattcatgattataagcttttacctaatatttttttgttgtaattttttatcaatcgggtaagctacattccctgcaatttatgccttcttgcaggaaatattatccatctgctcttaaaattttcatattttctattcttccagtcagcagcagtgatgggaattggacttctctatgaagggtcagcacatgcattaaccatgaaaattcttctggtactttcttggccgtgctatatgattgggattcctttcactttctgttagttttcttttagcaaaggatcacttcatttcagttgtccatgacactaatgttgagagggtaagggaaaggacattagctacccacaaatatcaattgttcatcacattttgtctgcaagagttatatacacacacaagacagtcatgagtgccccattggccaatcctagactatggggtaaagccatagtatactataaacatatctacacttaatcttttcctttggcattcaatattctatcagttcgccagagcagaaatactaaatatgttccttttttttaatctcctgttggagttggatattttgccctcacagcggtttcatatctacaatttttttggtttgtttgtggctcagagggagatctgacactgacctatccgagtggattgtagaatggctttaggtgaacgagggcacaaactggcaaggaaatagatctagagtagctggttaagaaaatgatctgcagaactgtagggactatgagacagtgttattcatccttttgctttacttaataaatctgctgtccacttaaatagaatcatggatgtaacaaaccaatctaaaagacactaagggtacaaagaaggatataattgaaccaaactaaagataaggaaataattgaactaaactgaatccgaagcaaagtctaccagcttcttgggctatattgatgtggcattgtgcacatgataatatatgaaccaatttggactaggtcatatttttttttccttttcctaatgttgtttcttttcacttatcttgtgctcattacattcagggtgagattggccgaagaagtggtggtgataatgtgctagaaagagaaggctatgctgttgctgcaggctctgcattaggacttgttgcattaggtgaatttcgtttgacagattcatgttgcatatcttaagctggcacttcagcacaaaaataaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47018 - DNA, 3323 bp, Oryza sativa
ttctgatgaagacttgcagccactgcaaaggaatgataacagggatgccaattgcatgagcctactgcccaagtgtggagatgattgtgtttggcaggcccccctgattgtcagttttggtgtttggtgcatccgccagattctgaacctgtgccttgtcgaaagtaggccagaactttggggcaagtatacatatgttcttaatcgtctccaggtatttttttttctattgctgtctattttgggcaaactgcaatatggagggtaacccagggatgcagatcatcaatggttgcttcctgcatgtagcatacatactatataggctattttggcattgttgtgaattatgcttcctacatatagcatacaaactagtactatataggctattttggtattgttgtggattacgataatctttattcgtatgatggctttaagatatttcggttttttattacctgtttttgcctaaatcaaattgacaaagatatatttcagtaaaaaagagagagagattgatttcccaataatagtagaagtggatggatatgggagaacggcaacagcttgataaccaaatttgacactctctctgatttttcaatggattgtgaaaatactccatatagcaatcctattttccataggaactttaaaaataagcactgtcagcacacataacaactgcaaactaaccatatacttgctatggtggctgggaatatttcgtgatgtatgaaagtatgaaacactgcaatagatggcattcatttatataaatttaaaatatagttgtttgcagagaactttgttttgtatgactactatcattttcttcgcctgtagatgaatcctgcaacttgtaagtgcattttgtcctactctgtgcttttaaccataagataaaccttaatcagaaatcccaactactgatttccttcagaagtgcataaaaacttgtgagtgggttcggttgcattgagaaattgacttctaatgcgacttgcatgcagcagaactgcccaaacttctgccacactgtttggacttcaagtttgctaattttctttttcatttacttgctagggaatacttgatcctgcattttccaagcctcagaaacccatgaaaggatgcgtatgccttcaaaaagttgccaagcccatctctggtactttcaccactgctggtatgatcttggagatgattaaagacgtggaacaagccatttctagccgcaagggccgaagcggcacagcagcaggagacgttgcttttcccaaagggaaggagaacctagcttctgtccttaagcgatacaagcgtaggctctcgaacaagacatctgcaggacaatagcgtggcagcgagctttcttttgtttcttgtttgtatagggttcttggggctgctccacaaagttctgtttttttgtgctcctcaaaccttgggttttttcgatgcacacgatctccagagtgcctgagagcttcttgatctttggtcatttttgcacatgttgtttatgaagtggccaagggtgaatggtataccttgtttattcatcttatcagcgagatctcaacagtagatgatatttgctggagcagcaacattgtaaagttctttttccagatgaacattctgaagtccgctggcttggctttctgaaatctccactagactcgttgttcctttcggctttcgctgttaggttgttactgagaattttctgttggtcagctaagcttgagttctggtccttctggactagacacagtggcacacgatgcagcggatacccatgtgcacggcttatgtccacttgtctgatgttaatttttcatcgtgcttgcttgttactgtagttgttactgccttactggtatcatccaggagtcatattttcgttgtttgcatctctataaccttttccagggaaatgcattgttgcagtctttctgaacatatacttgatgaattcttgagtttccatgtactacgatttattgactgtaattggatggatcctgatcagctaggaaaagctcaggatcagcagagagtacagtggacggttcactgtacagtacacacgatctatctcgctttcgacaggcaggattggtcagggtccataaaattcaggcttctgtgcagctgagctatagtgtcttggacaagggcccccacatttgcatcattgcacgtgccacaatcaatacccccaggctttgctaaagatgctttcaaggatgcaccaacttgggggcgaagatacacggtcatgtacgctggcgatttttgcacgtcgcacgcaccgaccggtagaagatgcaaggataggaccaaagatcatcggaattgtgaaccgttgttgcaacttttctgaattacccggtaaaggttgtaaaaaaaagctacttttgattatgtttccacaaatacaaattgtattttgtgtacaactattgcttatgctttcataattacagttttatattttatacgcgactatatttattaatcttcaccattataacctagatccatagtgatggaacattttttttctttaattaatatggttttttctcacataatataataaatagaccgtcgcaccaaataaatatactttttatgtgaattgagtgtagcttaaccggttaaacttctagttctacccttgacacatgtatttatatttacggttaattattcattcaatgatagataacatacccgtcagtagtgagccgtctatggcgactttgtgaatcttaaaatatatcggtacaatcttcgaaattgctcatagggatagggtgcgtatgtacactttcacaaggatgagctgcgcgtatatgggtgtttgcatctgtactgtgttttttttaaaaaaaaacttttaatcaagggttaattagatccatgccactgcaaatgtggcaaatcaaaaaaatgccacacatattcgcattatcggctggatgccacttcaaatttttaaaattgaaaccatgccactcccgtccctttttatgtctcctctcaaacgccgtccccgtttccgtctccctcttcgttctcccttcttctgcccggcgtcgagcacggcaaggtcggcggcggcggcacagcaaggacggtggcggcggtgcccgtccatctcgcctctctcccgctgtccatcttctcctccctcccgccgtccatctccatcaccgcgctcccggcgctcctggaggtgtccctcaacgacctcccccccgacgcgtatcctcaccgtcatccgccacgcgctccctccactt

SEQ ID NO: 47019 - DNA, 2521 bp, Oryza sativa
caaggtcgtcatcaacgaaggaggccaccgccatccttgctgtgccgccgtgttcgacgccgggcggaagaagggagaacgaagagggagacggaaacagggacgacgtttgagaggagacagaaaaagagacgtgagtgccatggtttcaattttaaaaatttgcagtggcatccagccgataaagcgaatatgtgtggcatttttttatttgccacatttgcagtggcatggatccaattaaccctttaatcaatgactaattagaaaacagtatccccatctataatatataataggactaggatacaacttgtatcctctgagtgtatacttagttgacacctaatatttggtaaccatatatatcattttaaaaagaagaattatagtgtttgctctaccacccttgatcacatctaggcgatgatgctctatagggatgatttcaagggcggatccaaaaaatgtatagagggagggtttatctcctttctcctccaatccccctgctcttccttctctccctcttcttccccctcccacccccctttcttaatggtgatccagcgggatagagggacttgagtcctccagcacccacgttggatctgttcctgggtagtgttttgtccgtcaccaaacattgctacattacagttttaacatatcacagtgtgttagctatatgtttgctttattgtcacacttatgacattgcaactcgatttttaggctagttgtgccacacagaacgtacttttatgtttttttttcacagtttatctaatttcagttgtggcaagacgccaaccaaacatccaagaagaattcaccacgtttgtgcggacatcaggcacggcgtcctgaaaggacggcctgaattgttcatcaccgggaggcaaggacgatgatgcggcttgctggtaggcattggttgtgtgcccctgctgttgcctgttactcctcatagcctgtcggtactattgcactgggcactggctgctagtctgctacagtgcggcacgatctcctccccgatcttagctacagtaattacccatgaaacattgatatctcgtacaagtctgccccaaaacagccggttcatcattatgggtgccttttctgtccatccatgtttagaagagtcctgcatatgaatcaatatcatcccacttccaaaaacaaacacatgttttatagttattttatatatttaagagcggagtgtatattcggtcctaagcttgtatgggtgtatcatcgagacccctaaacattttcaagtttctatattgatcttcgacatcatataggtccaaacatgttccaatttgctttgtacattgacatggcatgcaacaatattttctacgtattagtgtgacccacgtaacattcatataggaaaaaaaacatattttcttctctctaccttaaaatttttaaaaatgattttttattttctttgtcttttctcctctctatctaacatgagaaaatatgtttttaaattttatttttattttagtgggtcctactaatacgtaggcgccaccgtggcatgtcatgtcaacactaaggatatgtttggtagcaagttttcccaactcatctttctcgtgttccgcgcgtacgcttttcaaactgctaaacagtacattttttacaaaaagtttttatacgaaagttgcttagaaaaactacattgatccatttttgaagaaaaaatagctaatacttaattaatcgtgtgttaatggaccgctccgttttccgtgcacagaatacttgttcccaactaatcctaatgaacacagcctaagagcgggttgatgcccgtttagatctatatggcactaagacaaattcaaagacacgaacatgtgttttgagaatttgagaatttagggttctagataacacacctgtacaaatttagagcccgcaagtgtacttaactaaaatatatacactcttgttcatatcaatatatctattaattattttattataattataaagacaactcgaaaaggaaacaacgtatttgctatgaaggcttgaaaattaccatattaatcgaaaaaaatctaagccatcattagatcgtagcgagacataagtagacactattataactacataaaaacaaaagaaaaaaaatgaacattaaatttaatcatactttcaatatctaattatacttttatatgtaagagttgcataacaaattcaattcaataaatttgtgcgccgcagtttttatttaagtttcgctcacgattaggcggaccagcgagggcgtgaaaagctacgagaaggaaaaaaaaaagagctactagtagtactaataaatcaaagagatgatggcataattaagcagcgtgagctgtgacgtgagctgctctgaatctctgattttatcataaaccacaatcccgggcccacccgtcatggaccatcaaataaccgatctccctggcccatgggccccgccctcccagcacggcacaac

SEQ ID NO: 47020 - DNA, 3544 bp, Oryza sativa
ctctcccccgccacgcagtcctcgctccgcgcgctcctcctctccgcggcgtccgcgacggggctctccaagtccatctcgaagaagctctccgacgccgtcgccgagctcgcgtccttcctgctgccgtccaacgcgtggcccgacctcctcaccttcctctacaagtccatcgcctccccatcctcgcctccggcgctgcaggagtcggcgctcaacatcctagcccggctggcctcccatctcgccgcgggcttccccaacctccacgccctcctcctctccgcgctctcgcacccgtcgtccgcagatgtccgcgtcgcggggctcaacgccgctatcagcctcatacagtctctcccctctgccgccgaccgtgaccagtttcaggatctcctcccagccatgatgcgcgccctcgctgaatcgctcaactgtgggaacgagggctctgcacaggaggcgcttgagatgatgatcgagcttgcaggtgcagaaccacggtttctccgccgccagctgcctgacgtggttggttctatgttgcaaattgctgaagcccctggattagaggatggtacgcgacaccttgctgtcgagtttgttgttacccttgctgaggcaagggagcgcgcgcccgggatgatgagaaagctgccacggtatgtgggccggctatttgcggtgctcatgacaatgctgctcgatgtccaggatgaacctgcgtggcatgcagcggtgtcggaagaagaggatgctggggagactgggagctatgttttcgcacaggaatgtcttgatcggcttgcgattgctgttggtgggaatacgattttacctgtggcagctgagttgctcccatcattttttgcttctgaagagtggaagagacgacatgcggcactggttacgatagcgcagattgcagagggctgtgctagagtaatgattaagaatctggagcaggtagttggtatggtgctgaattccttccgggatccttatcctcgggtgagatgggcagctatcaatgcaattgggcagctttcgacggacctggggcctgagttgcaaaataaactgcaccatgttgtcctgcctgcattggcttcatccatggatgatttccagaacccgcgcgtacaggcaagttattattgaggatttacacttaagtcatctgctgcacttctttcaatattcgttatcgtattttatagtgtaaactataaagcattggtggccctgtaacccacaagtatcaggctcagaggaacttggaagttaaaaagatattatcttgacatatatgcattctaaggaatgagtagaaattgctggaaactaaaaattatatttaaagagaagttcgtagactgattaaggtctaatgctcaaagctgtcgtacttttaatagaatagtacatggaaattttctcaattatattacatatgtatcagtaaggaatgggtctatttaacccctcaactatcgtgttggtctaatttcaactctccagttatgcaagtatgcaaccttgtaaaacacaattcttgaatatcaatacccaacaatctacaaccctcaacctcaccctagttgtttgatgtttgaagtaccatacaatgtgagtgattatgctagcctatgtgcacaggttattgtcgtgatcaagtttcatgatgcaatgatttagagaggtttgatgagactgctattaatgcctaaattgtttgtagtgtgtcctcatctgagatcacaactggttacacgtttttttagttagtggccattagtttgtgccacttgctttttctttgacatatacttacaattgacttgtcattaatacccatcaagttatcagctagacatgctctaatcattgttttatattccgaatgagttcaggcacacgcagcttctgcgattctaaacttcagcgaaaactgcaggcctgatattttgacaccatacttggatgggatagttgggaaactactgtcattgcttcaggtaatccttgcatttgatcatggagccttcattttgtgcagcataaacatgaaccttttcggaaattttgtttgttttctgatagactggaaaccaaatggtgcaagaaggtgctttaactgctttagcatcagctgcagattcttctcaggtacaagaggaaatatttttgaaggttttcgggccagcattcttgctcaaagttttgcaatcttattgtttcaggaacacttccaaaaatattatgatgcagtcatgccatatctcaagtctatactcatgaatgcaactgacaaatcaaatagaatgttgcgggccaaatcgatggaatgcattagcttagttggtatggctgttggaaagcaaaaatttaaggatgatgctaagcaggtaataatttgctagttgctctgatacattgtaatacgtttgaagaaaatgtcaaagcacactgtataaatgttatttatgacttgttctgattgtattgctgatgggcttatttgaatgctgtttgctgaattcgttgtttctttggctaacatatttctcttgctaggtgatggaagttttgatgacattgcaaggatctcagatggaggctgatgaccctataacaagttacatgctgcaagtatgttgtagcttaaatactattgccattttatgccatcactagtttgcttcagttttgcttattctaattgcattttctaggcatgggcgagattgtgtaaatgccttggtcaggacttcttaccatacatgaatgttgttatgcctcctctgctccagtctgctcagcttaaaccagatgtgagtgtcacatctgctgggccagaagatgaaaatggtgaatctgatgatgaggggtacgtttttgttacgctggcaacttaccataatgttgtcacattcccatgatagaatattgaaattgatgaattgttatcattgtaggcatgatattagtttgttgccctgtttcaaatttgcatgtatttgtcagatccataacagagcatttaatttgaatgttgatatcctgttgttgtctgattctatgatcttatgatatctgtaaaattttgtgttttacctggctgcctgcataaaatgcagtgttgagactattacgctaggagacaagagaattggcatccgaaccagtctgctggaggaaaaagcaacggcatgtaatatgctatgttgttatgctgatgagctcaaggaagggtttttcccatggattgatcaggttatgttacgattttttgtgaactctatgtgtacacgcacgcgcctatgtgaagagctccagctgaaccttgaatctgtacaggttgcaactactctggttcctctcctcaaattctattttcatgaagaagttaggaaggcagccgtttcaggtctgcaactacccttttcagtgtattctccattatttttagcatttttctcaaagtgacattgtgttatctccctagcaatgcctgagcttctacgttcagcgaagttggcaa

SEQ ID NO: 47021 - DNA, 2393 bp, Oryza sativa
gataatgcgatggcatatgacaatgctgtttctgctcttgggaaaatatgtcagtttcatcgtgatggcattgatgcatctcaggtgtcttacaagccatatgaattaatatacttactctgaagtgtattcttactcatttgaaatcatggtgttgctacctgtcctgctgattaattaaactcttgtctacagagacaaagaataccaagtttcttcagttgcccttgataaattttgacatcaacgtcaataacataaagcatgtaacagcctaaagagcctcagccgcatacagtatgctacatgcaaaaacattgaatgaacgggttgaaagccttaagtgactgctcagtactattgaattaattttctactaaaacatacagttaaatgacatgagaactcttctttactagagtagtgtccattttggacttacattaggtctgccaagtcgtcgtagatttattatactatgtgtagtatttccttaaccatgcaatgcttctaagttctaaccgtgtatcattttttaaatattaacaggttgttcctgcttggttaagttgtttgccaataaaaaatgacttaatcgaggccaagatagttcatgaacaactctgtacgatgcttgagaagtaagtaatgatctcagtatttttgtacagttacgcagcttggcttatatatggtgtagaaacatcaatcttgttcattgcttccttattataatgtttatttttcatttcattgaagatctcatttcaatttttgcaggtcagatagggagcttttgggtcataacaaccagtatcttccaaagattgtctctatttttgcggaggtacctatttatttttttccttaatttttccttttttgttctgattaactatatagaaagaactgcaacacaactagttgcagagcagtattggaatgtttatgttgaaatggggttgagttgattgtgtttggctggtcagttggaattcatcaccaactgaggccattaggttaactaccttttgatcctgaactgggttgctacaagcttaacatagctttataggggctaaataattttcagtagaggagtacatagcaccagggtactgccaatttagatctcaaacgaatatgaataaacaagacattttatggcttatctggtctataaagtagccccccccccccccccacacacacacacacacaaaaaaaaaaggaacatatttcaccactgatttttcacaatgcaatgtctttatctttaatttagataatttaaaaagatagcatttgcttgtctcatgtactgctgtgtagtatcgttggtagaagcccctgaaataagatatttgggagacattccaaaatggtgatttgttttctctgagttttgagaaagaaagtagttatactttaatgagagtatgagacttaggcgattaaccaccatggcttttagaacattgtttggtttgtaacaccacatctatttccttatggatgcagatattatgtgcgggtaaggatctggcaacagaacaaacttttagtaagatggttaatttgctaagacagcttcagactacattgcctccttcagtactggcgtcaacatggtcttctttgcagccgcagcaacagcttgccctacagtctgtgttgtcatcatagctgaacagtaacctcagcaatgttgagcatgtggccttcacatattgccttcttttttgggttttcatgtggttttgtgcttgggttcctggagtttgtgcagcatacaaatgccctgagcttttgtatgaagggcatggtttgcatcagaagtgtatactgtcacagaacatcatggatgtgtatggggctgagcaatctctgcttcacagcaagtgaagttgtaaagcaatatgttcattttactaggaattagttgggttgaagaaaatgtaaattaacaattttgatcgttgatgttttgatatcatattatttcaaacctctctgcgcaccttatgtccttacctattgaatttaggttgcttgtctgagacttgtgtagaatgaccatcttgctgatttgagtttgctttactgacttttgagaacatgtatggcatttgcatacttctactgtcaagtgctcaagcggcatctgtccttgatcaccctggtgctaatcttggagcgggaggtatgtcctgataccgcacaagctgtagactgtcgctgtacttgtggtttgatgctgattgcatctattcctgcaggttgaagtcgaacagatttgacagctccatggcgattgtcgtcaggggaaggttgaggttagattctgtgggccactgggaaaacctcaaaaaggaaccagtatttactttctg

SEQ ID NO: 47022 - DNA, 32818 bp, Oryza sativa
cctgtttggcacagctccagcctagctccacccctcctggagctggagctcaaccaaacagtttcagctccaccaaaactgggagtggagttgggtggagctctctcacaaaatgtactagagttgtggagctgggtttaggcagctccacaactccactccagactcaactcctggagttatattaaggagttggagctgtaccaaacaggcccgtaattcccttgtttacccctttagctctttctggcttaggccctgttcgaacgagagtttcaggctcaagccagttaaaaaagaagaaataccttctcaaaagaagaagaattacaggcttaaacagtttgtattatcggatatcttgtatacattcgaccctccgagatctgttgtaagatttgtatcgtggcaccttctctcgctccagcgagcttgtgcatctgcggctacaactggcaacaaacctgacgtgttttggggtggggagggagagttcctcggggtttacacggaagcggacccgtgttcaacgtataaactcttattaattcaacctcaagatcttgtgttcaattcttagcacgctcataattttttcttagagagattcttcttaaaaaaatgtttggagggatttctcttccttcaaatcacgtttttcttaacccaaaagttgttaatgctaagtgcagatatttcagcgaactattgcaatcgttaaaagcttagagagattcttcttaaaaaaaatgtttgaaggtacttctcttctttcaaatcacctttttttaacctcgaaagttgttaatgctaaggccttgtttagttttcaactttttcttcaaacttttaacttttccgtcacattgaattttcatgcacacaaactttcaacttttctgtcacatcgttccaatttctttaaacttccaattttagcgtggaatgcagatatttcagcgaactattgcaatcgttaaaaaccctaaagatttggtaagggtagcttttagtccaagaaacttcgtttatactcaatgcacagagatacctcatcgtttcgcctacgataaattatactcgtcgtttcacctacgattgattataaatcataacacttattaagatctttaaagaaatatagataaaacttttatatgtgtgttattaggggcttaaaaaccgatgaattacgttgaaaaagctggaagagcaaggctaccgatcggtggatggaatcatggaatcttgtgatcgatgtccaacaaggcaacaccaccactaatcatcattccaattaacacagtccaagcctccaagggcgacaggatatagtggataactgaatacacagtccagcagcacacgcctgtaatttaatcacagcggcaattgagtaattgacagtcaaggacgactagatggtgtaccaatgtgcaatttataatcagcgaggaagcacgccagcagcacgcctgtaatgatttccaattactaatgtgcaaagtgcaatggcaaattgctaacgggcgtaaagaggagaccaccatcaattccaccacacgcggacaggttcctccatcgtcacgacgcggccaccagccgaagcgtctcctccgagttcttggagttctgctccgccaggagggactgcaggtcgctgccgttggccaggctgttgaactccaccgacctggacgggtccgtcgggtacttcctctggcagaaggtcatcagcctcttcacggactgcaggtacttcctggtcgtctcgtcgttcatgatgtgcgccacgctgttggcgtagatcttctcgcgcgccgagcgctcgtggatgcccaccatcgtgacgccgatcggccacggcgagttgccgatggcgagcttgatgtagttgtccaccgccgccaagtagtcccgtctcatgcagcacctcaccacctccagcaatgatccacggacatcttcgggcagggtctgtcatgggataattggattcatcaaaatgtggaaggaattagcaaggtgattcagaattgttcacacccattatatttgggtacatcaagaaggaaaaagtttggattaatgaggcaactgtaggtgaagaatagtagcagcaaataattttcttggatcatactgcagagcaggtcctatgatggcaagcactggcaattttgaacaattcagcaagcattggcaacgttaaacaatccatttcaagaaaaactacccataattccagtgggaacacactagcatacagaaaataagttgccacaagtaacacaaaataaccttagtggtgatcacagagagcacattctctgacattatcatccggagggaaggtagtaggttaatccagggaaatcatgaaggaattatcgaacttcctaaaagcataatctgcaacctgataattgatttgttgtttcaagattcagaatggcaccctcctatttcaaaggcaaagagaaaaattaagacaaatatattcctctgttacagagatttataactctcttctttttttttttttgcggggaacagagatttataactctgaagtctgaacacatcatgagacactttgataataagaaagcgcaaaggttggaacttgagaagaatacatgtaatatctgctgtcttgttcgccggaatgtatgatgattaccagcttctgtctgtcaacatcttcatgctacaaggaactaagaagagaacacattaaacaatatttgcaacacactcaaatcactcagtagcattaccacttagttcatgcctacaaaattatagccgatattggaaacgaattttgcaatatctacaatgtgccaccagtacaaaggcagtttggtgtttcatcgaaactgttgcatgtcttatgaagtgcattttcaaaatggaagctcacataacctatttggcttcttcactatatcatgtgttctgtaaggcttgcatttccccttccacagtgaagcatcccaagctcctaacatgtccttatgcagcaaacattggttgtaaaattgtaatgcttcatactgttcttttagcacatcttacagactcactccactaactttgggttttgaaagcatcggaggcattcaataaattcgattacagcaccaaagaacatcagattcttaagtgtgtgcgtgaattaatactgtcacataccttcttcttgcacagcttgaacagcggctcgagatagcgcgcgcactgcttgcaggtggccaccgcagccttccctttcgccgtccgcctctccgcctcgggcatctcgtccatctcctggctccactcgctcatcagcctcttgaagaaggtcatgatcttgtcctcgtcgcagagctcctcgaacggcacctcctccctcgtctcgcccccgctctctgcagttgcagcgccagccttgggcttcgccgccgccgacgccgacgccgcaacggccttcgcccgcagcgcctggatgtcgcggaggaagtcgttggtctggccctccccgatctccgccgcttcgacgtcggcgagcgccgcggggtcctcgagcacggcgtggaggcggcggaggcgcgcggcgtcgtcctcgccgaagagcgtggccggctggcgcagcacgcgcaggcgccggatgacctcctccctggggaggagcggcgcgccctccttctcctccccgtcgccgcggtgctcggtccgcgacgactcgtcgccgtcgggagcccccggcgtggtcgtggagcgcgacgcggcgcggtggtgggaggaggaggaccggagctgcttctggaggaggagccggcgctcggcctcccggatccgctccatctcgcggcgctcgatctcggcgcggcggaggagcttgcggccgccgaagtcggcgtcgagcagctggcgcttccgctgtagctcgcgcttcaggacgtccattggctcgccggagtgggggtgggtcgcggtggcgcactcgcagagtgggttagctttgctttggattttggagaggcgaatcggaggttccgcatggcggatcggaggatggatggatagtttttgagcattcgtttttgggagatcgatgggttctggaagcatcgagcacgaaaggtttctcgcgcgaaccttctcgaatctcgattttcggagttcggattgagtgaagagtaaaccggtaggtgattggcccagtttaactttaggcctgctaagtgcaaacttaagcgcaaagcaaagcccatacaaacagtgttttctccgtatttgccgtgtggaaaatactctctccatctatttttgatagtcatatttcatcttagcacacagaccaaggataaatgattctacttatcatccatttaaatatgctactagtcattcatcgtaaacaggcgattcattaatatttatatttctcgatgcccatgtagccaatcttgtgtgtaagaatgaagagtcgcgcattaaatccaagaaagccattgatatgataagttgttggattgaaatatgctaatcaaaaataaatttttcagatttagaaatatgaatatcaaaagtagatggagggagtactttggtatactaatttaatcccctttgatctgctgactggtttactactttcagatcagactgctggggaaaaaaatgcaaatgctgaataggactaggagtatttcactagaattactactaccgtaacaatcccaattccgtagacattcacccatttcttaccgttaactaaacgattacgtaaaagttttaaaaaatgataaaataaattaatggtaatatattattttacgcacatgcaaatacgaattgaacttctaactgtaaaaaaatatattagttagagttcactttgttatttttattacaacttgtaaaagctagatttaaatttttatgttgtgaagtgatatatttcatatataaatttatcttaccattttttaaaaaaagtttataatcattagagtttgcataaaagaaacagagtggaggttcacccggaatccatctccgattcccagtctggtcaatccgccagaaaatatcctcctgccctcgtttcaggggctgcagcagcagaggaggccggaagcagagaacgaaccgcacggcgagaaggcgcgcaggctgccgtctgcccgtctgccgaaaccgatcgcgaaagcgagccagccaaggtgccgcagtgccgcccccttcccttctttcgcccgcaagcacgcacgaggaaaggaaccagcggtgcacgcacactgaccaccgcacaacacagcgccgcgtccagcgaggaacacgagccgaaccgccacggcgacacaccaaaaaaaattccaattccctctcgtgatccacgcctccccccagctcgtctcccgctctatttaaacgcaccccccacccccaaacccgctctcccctccttctccccgcgttacaatcagcacacgctctctgctagtctgatcgctctcgccatcgcacctctgtctcgtcgaacaatggcctccaccgccgccgcttcctcccctttcgactgcgtcctctttggtaaccacgtttgtctctcgattctaggctcctctcatagcgtgatcactttcaattctccgtctaaactctgcctttcccgggctgttttttttttctttctttcttttctatgaagacctcgacgacacgctgtacccgggaagcgcgggcatcgggctggcgacgaagcgcaacatcgacgagttcctcatggcacggtgcggcgtcacggcggagcgggccgccgcgctccgcgtcgagctcttccgctcctacggcagctcgctcgccggcctcatcgtacgtccaattcccaatccccccacgcacgcacgcacggcacactcgaacaatccaaattcgcctctgttttcgtcctctgtttccgtttctaactttggctttcggatttgggtttccgcgcggcaaaggctctcggctatgacgtgcacccggatgagtaccacaggtcagcacaacacatcacatcacttacctttgcagctttgcttaaccaattcgacaagccaattagtaattattaagcggctaattttctgtctaatccgaatgctgacgctgcttggttgatcgattatcgtcgcagctacgtgcacgggaggctgccctacgaccggatcgccgccgacccgcagctcgccggccttctgcggagcatcccgcagcgcaaaattgtaagctcacgcatcctctttttttcctgtgaaattcctgtggttttccggacttaattggaggcagctaattcgtgttcgtgtttcagctgttcaccaactctgatcgcgcgcacatgaggaaggcgctgcagcggctgagcgtcgacgagggctgcttcgacgccgtcgtgtgcttcgagaccatgaaccctcacctcttcggtgaggcgccgtgcgcctccggcgatgaccgccccggcgtgatcctcaaaccgtcccccgatgccatcgtcgcggctctgcgcatcgccggcaccaatccacaccggacggtaagccaccacaccctgctcgacatttttcagtaggattttttggagcttgttgcaatgtaaatgtagttaaccatatgggcaattttatcattcttaaaaatatactgggaagtaactcattttctggtgaaaagtttagtatctccagtcgatataggtaactcgaagtaccaaattttttttatctaaccatgtacatttaacagcaggtctatcctctaatgataccgttaatttacaaacccaaaatgtattaatcactcttccatttttcttatcacaacaaggaaatagaatgtctatggaccaaagagtgtattatgcatcttggaaagtgacatcgagtgtaaacccaaaaggcttagaaagtaacgagtagtaatagggtctttgtcagcgtatccttttccatcgaaacaaacatatcgcacacatatggtatatgtgattttacgtgcttcgtttgtgctcttgtcaatgatcacgaagctagtaaataactcgttcttgctctgtcagctcttcctcgacgacagcgagaggaacatcgccgcaggaaaagctcttagcctccgcaccgtcctggtaattaaccaccacaacttaattgtgtgtttcagttttcttcgtaccgcactgttggtttaagctactataaccaagtgacagtattttccttgttttgaaatctgaatctttttctccactaccataaaatccttactagctccaaacgggacatagatgtgttcaaaacacagtaaaattaatttcaccaaaaatttacatgattggtagatatcgattcaattcctatagtaattatcgggaaaaatacacaaaaatcaatgaggcatataagttgctgtctctgcctgtccatttgtcgatgggttggtcgatcaggtggccggtgcacacagcgtccctgcagctgatgcatcgctgatggtgttggccttgtcggattagaaaagcatatatcccaatttcttcattgccgtgatgccaagagtttggtttatgcactcaaactgtgtgtgcattattggttaatcctgcttttgcacatggacgcttagtcacataatttagtgctctcgcatttgtggctggcaccaaattggccatgtcgtcgacacggctctggtcggtgtgattgatatatctggcatatatgatcccccatgattggttgaacaaattgcctcttgatactacttgagcagggaaaatttataattttaaatatagagactttttaaatatatggtttcgatgtgttctttgctggattcggtttcaacaaccaatttctaaaaagaaaaatagcacttatatatagtcctttcctactagtacaacaaaagctagtgaaaaataatggcaaaaaaacaggagacacacacaaaaaatctcctctgccagtgtacagccgttaacccatcgcatcgatgaacagtatccatgacgtgccaacgtttgataacaggggccatagcccattgagacccaactaatttgcatactttgcggctaagtttcctgcatgaacacgaatttacgttagctaattaatcttctcaattaatattcaggttggcaagagggtgaggagcaaggaggccgactacgctcttgagagcatcggcagcctccggcgagccatcccggagatttggggcggcgtcgccgtcgccgtcgccggcgaacagctcgaccacggcgccgcggagaagacgaagggaatgaggtccgatctggactccatcatccagccaacgtcagtcctggcgtaatcggttcctaatccattcgcacataaacaaatcgccactaataaaagcaagtactgtccattaattatcatgtaaattattctgattcctgatgctgagtgcgtgtgcagtgtatttgtatatgggcctggctgacaaggaaatatgcatgtgtatatcagttctgatgatcagcttttgtttgctgtaaaatgtaaatggcactatgagcaaggaatttgtctttgattgctgttttttttttgtttgtgtgtgtgtgtgtggccactgtacaaattgaagcatgctattttttccccttaaaaaatcgtagagctgcaatgagtagtcaccgtgcacaatagcagatgcagctgtcccatacaaatgaaatgttcttgcatccatcaaggagtagataccttctaagattatagaagtaattatgcattagacaattaactggaccactgttatgaaaagaaccattgatatggaacgattcggttcaagtggaacttggttcgttcaattttaaactggctagttaaatataggaatcgaggaactttccccacgtttaaaacgaaatctgtctattcgtcattagtcattgccatatgtaatacctgtagtatgttcagtcctactgtcctactccctccgtcctataataggcgatgtttttgactttttatttgtaacgtttgaccattcgttttatttgaaaaattagtataaatataaaaaaaagataagttatatctaaagtacttttgataataaagcaaatgacaaacaaaataaataataatttcaaatttttttaaataagacaaatgatcaaatattgacaaataaaaactcaaaaaaagacaagtaatatgggacggaggtagtagcagctaaatattcgcctttacgactccgagtcactcccttgctgcttcttgtgcagccaattgccaaatggaaagatggggagacccgtttttatatgtgcctggccttatcacctactagcagctcgcgcgcggcaacttgattggaccgacgcgtcgcccggggatcgcatcgcatcaaccggcagttcggcggatgcaagcgtcgtgcgtgggcgctgacgcggacggacggacggtgcgtacgtacgtttctagaatttttatcctcgatcgatcgctagacgctagctgttgggtttgggcagtttagataggatcgctcgctgctaacctcgtcacaccgtgctgtcgtcgccatccacagcggcctcgcgcgcatcctcctcctcctgctccgcggggaggtgcggatcggagcccatgtcgccgtcgccggcgtgcgcgcgacgtacgtggggacgaggcgtacgcgcgtgttcttatcgatatagtcctccgtcctaaatatttaataccgtcaattttttcaaacatgttatgaactttcgtcctatttaacaataaaaaataattagtaattatttaaaataagataaacgatcaaatatgttttaaaaaattaacagcgttaaatatttagtgacggaaagagtatatatacctgagtaaaataatggagggatattcatcagtcacccaccgatcggtctctgcgataaggttgtaacacaaacatccggaaacggcggcgtttcggataagagcacacgcgtacgccgtccgcgtgtcgtgtggatcgggcacactcccggttgttgggcgtgtagtgcgttggacgaaagagactcaccggacacatgcatgcatgctacagtaggttgctcagcatcgattgatcatttggccaggatagcatgtgtacgtgaggatatttccctagctagctactagccagttgccacgtgttgaggtcgagaattgtaaagcgcggtcacgatggaacgtacgatccccgtgtgtcgaggttgtacaggagtactccctccgtaaaaaaaaaaaaaagacaaaccctactttccgtgtccaatatttaaccgtccgtcttatttgaaaaaataatgaaaaaaaattaaaaagataagtcacgcataaagtattaatcatattttatcatctaacaacaataaaaatactaattataaaaaaatttcatataagacggatagtcaaacgttggcacggaaactcagggtttactttttttttttggacggagagagtacatttttcggctatagggggtgtatagatctcgtccagacatcacattatctaaacacatgcataaaatattaaatatagatttaaaaataactaattgcacatattacgattaatttgcaaaataaatcttttaagcttaattgctacatgatttgactacgtggtgctatagtaaacatttgccaatgacgaattaattagacttaataaattcgtctcgcggtttactgatggattctataattagtttttttattaatacctgaacaccataaattataccctatccaataccggacgttaacaccacgaaactttacaccctatttgacgtcaagaactgatagcaaaaggtacggctggcgacgacgtcgaaggttgttgggctggcgtataacttggccttttgtaatcataaacgggccgtgacgagttccaggtaacatcggcctggcccattatctgataattgggccggggccggtgatcggttttgcagacaaaatgaattttgatcgaatttttccgctacaaatcaggatttgctcgcaaaacaaatactggccattaacccgcagcatcggtagccgctctgagagagaggaaagccgcgccgtacgtcagcggaggccgagaaaaatgggcgcgctctgcctgctcccgtccacgccgccgtgctgctcttgcggcgcggccggcggcggcgggtcgccctcgcggacgcccaggctcgcgaggaccgcagcgcctttcgcctcctcctcctcctcctcctctggcgccgcttcttccggtggaggtttgcagctcgcgtgcaggcggcggcggcaagggggacgggggcgcgagcggaggggcggagttcttcggggaggacggcgtggtggaggacatggacgggtacctcaactacctgtcgctcgagtacgactccgtctgggacaccaagccttcttggtacggtttcttggttcctcgtttcttgcagtgtaaattgaagcagcttgagttgagcaaaatagtagtaggacaaagtagagactaaaattctgttctctgcatatatgagaggaaaaacaatctgaaattttgttgatatgttgtgaattgtaaattataaccaaaatgccaaatgataaatgcagtgatactattgtccatcgtcaatgactgaatggtccagtgaattttgattatgtctttgcttcaaataaacaatggattaattgatgtctaccaattcttcaatttcctatcaacctccaaagttagtagatcttcacaagttgtatcagataagaaggaaaaagaacatcttttattgttttctgttgaacattctaacaactttaactcttctgactctacagaactatatcctttcatatgcttttgtccgagtatgatcactacaactatatataatgcccattttcaggtgtcagccttggacaatcttactttcaggggctgttgcaattgccggtagttggttgcccatccattccgctgtgatcaccggaggggtttcttttgtaatatgtgcatggtggtacatatttctttattcctatcccaaggtttgaaaaccatttcccttattctttttgccactttgtggtgtttatatgattggctagaggtcagagccttgtaggttacactggctccacttatgattgttccacaagcccatgatcatgaattttcagacttgcgtcaaaaaaatatttttttgcgtaaaaaaaatgaattttcagacggttgatgaaagtagattgaaataacactctcgtttggtcttgacataattcttatgcaactaatgtagttacaggcttatagcataactgcataggttcttttcaaactgctaaattatacacttagctttcttaccctgattgtgcgtccccccacttaccagaatctatcagatacatctttcatcacatcatattgtgcacaagaatgtttgtaactgtgtcttggtggacttttactcctaacaaaatcacatagtaatatctcaaaattaatggacactataattttagttttttagcatatgtttgcattaaggggatgtactttaattcacgagctagctgtatacatgagaactaaaaacatagagcactagagggtagatttagctaatgatagcctcaactgagattgcatggtatcaagatagcaagtactacatgcaaaaggccggcgtgagtgcagagaaatcttgtggccacttgagatttaacatcaccctggtcgactagtgcttcatacactgtactatagttttttttgtagatgttgccgtagttcctgaagtgacgagcattatttctgatttccgactggaccttgtcggtgtaaccatcacatattgtctactttcgatctgtagtctttgatctgaatgtgttctcaactctcaagtctcaacatgatctgcagtagttcctgttagataattgcttgtttgtgcagagaacgaagtagaactaaccatctgaattgtcaggcatacaccgaaatgatagctgagaggaggcggaaggttgccagtggtgctgaagatacctacgggatggagaagagccagtgaggaattaattactgccaccactgcaggcgtgtcttgtttgtagcattgagtatgattgtgcagagaacaaaacaaaatcatcggtttgtaggacttgttcttcagaatatatgttccatggaatcaatctgttcagatcaatggccatctttgtttaatttgcaatggcctccattgttcaccatgtgcaagttggccatgtaggttaatttgcaattttttgcccgattcacatcaaaacagaaatattctttacagtactgaaaataaacaaaccaaaaaaatggttgcagggtatgactttaatacttatactcttagtggttcaaagccaaggttaaaacataaaataaataaaaacacttaaaatagcacttatcttttttcatcataaaagttttaaaggacacttaggacctaatttaaaattgagtaaatttcacgaaacttgggtattggggcatccataaaaaaatccagttattgtggtttgtttcaaggaaccaaatgttttggagcaaaacatttaaaaaaaaacccatatttatgtaaaacactcatatttaataaaattcttaaagtacgtgttcccctagtctagttttttttttaatttttcattgtacaaaaaaattcaatataatcctcactgataatgacataataactggttaaatatacacataaatggtcatagaataatgatcaacgatcgttgaaaagcaactaacgtgtatatgtatagtttttttttttctgaatttttcattgaacaagaaattcaatatttcctaactgataatgacataataattggttaaatatacacataaatgatcatagaacaatgatcaacgatggttgaaaagcaactaatgtgtatatgtactaaaaatatctcatacaattttttacaataattatagataagtatatagtcgggtagatgatataaacttgtagctgaggttttatgaaacactttgccctaaaacctgggtttcatgaaacaatttgcgttacggatgtcccaaaatctagggttgtgcaaaaatttgctctaaaaaattagattttatcagccaatcaatacccaacaaaatcaattttgcgccttgctgcctcacaggggattgtggccaggccaccacgacagcctagtctacggaaacgctttcttggttcgttcaaaccatgggagcatgagcccggcagtgcggacgaagcggccgccgccgcagccgctgccgcggcggccgccgccgccgaagccgagcgcggagtcgaagccggcgaaggcccgtgcaccggcaacctcgctactggagagcctcaagtcgttcaagtcccgcctggccgccggcccgccgctcgcgcccacgccgaagtccttcaagtcgtacgcggagacctgcgcgtccatcctccggctctgctccgccgccgcggccgcctccggcaccgctgccgcctcctcaaacctgccgctcgtcctctcaatccacgcgcacgcgctcgtctccggcctgaccgcggacggctcggtggcgtcgcacctcctcaccgcctacgccgccttcgcgcgcgcggcggaccgcgacggggccttccgggactgcgtctccgtcgtcggggcggcgtccccgttcgcctacgatttcatggtgcgggagcacgtcaaggccggggacatcgtctccgctcgccggctgttcgacggaatgcccgagaggagcgtcgtgtcgtacaccaccatggtggatgcgctcatgaagcgcgggtccgtgagggatgcggttgagctgtatcgccagtgcccgctctgctcggttcccttcttcaccgcgatgatcgcggggtttgtcctcaatgagctccccaaggatgcgctcggcgtgttccatgaaatgctcagctgcggcgtgagtccaaatgagatcactttggtctccgtcatcaaggcatgcattggtgcaggtgagttcgatctggccatgtctatcgtggggttggcaatgaaatcaaacttgcttgacaaaaatcttggggtacgcaactccttgatcacactatacttaaggaagggagatgcagatgctgcacgcaggatgtttgatgaaatggaggtgagagatgtggtttcatggactgctttgcttgatgtgtatgctgaattgggtgacctcgagggagctcgacgggttcttgatgaaatgcctgagaggaacgaggtctcctggggtactttggttgctaggcatgaacagaaaggcaatgcaaaagaagcagtgagtttgtatagtcagatgctggctgatggttgtaggccaaacatttcatgtttctccagcgttcttggtgcttgtgctagccttcaggacttaagaagcggaagaaagatccataaccagactttaaagatggcctgtagcaataatgtatttgtatccagcgctctgattgacatgtactgcaaatgcaaacagttgccagatgcacaaatgattttttactccctaccacaaaagaacatagtatgttggaactctctcatttcaggttatagcaacaactcaaaaatggtggaagctgaggaactcttcaaaaagatgcctgcaaggaatgttgcttcatggaattcaatcatctctggttatgcacaaaatagacagtttattgatgcattaaaatctttccatgcaatgttagcttcagggcagagtccaggggaaattaccttctcaagtgttctcctggcttgtgctagcctgtgttctttagagatgggcaagatggttcatgctaagatcattaagcttggaattaaggaaagcatctttgttgggactgcactgagtgatatgtatgctaagtcaggggatttagatagctctaagagggtattttatgaaatgcccaaaagaaatgatgttgcttggactgccatgattcaaggacttgctgaaaatggttttgcagaggagtctattctgttatttgaggatatgatctcagcaggaataacaccaaatgagcagacatttttagccattttatttgcttgctcccacagtggcttggtggagcatgccatgcattatttcgaaatgatgcaggcatgtggtatatcacctaaagcaaaacattatacatgtatggttgatgtccttgctcgagctggtcatttggcagaagcagaagatcttctcctgaaaatcgaaagcaaatcagaagcaaattcatgggctgctcttctgagtgcctgcaacatttacaggaataaggaaatgggtgagagggctgcaaagaggctccaggagttggacaaggataatacagcaggttatgtgttactctcaaatatgtatgcatcttgcgggaaatggaaagatgctgctgagatgaggatactaatgaaagggatcaatcttaaaaaggatggtgggtgtagttgggttcagataagaggtcaatatcaagccttcttttcttgggagacaaagcatcccttgttaccggatgtttatgagatgttggatttgctgacatgggaattgattgcttgatttttttaaaaatgtcatataggagtaaaaccttcgaggctttgacctcattttgcttctttagttcataaagataacgatagcaggatggagttgtttctggagaatggctgaaaggaaattgcttttgacattccaaaaatgatagttgccttcatatgctaagctccagaaatattcatggttatttgcttccaaccatctagctggaattttagcaaattgtgatagccgtgctggattattacaaaagaaggtagggcattattgttggtttattgactttgagcaccgtggtttgtttttaatctgctcttcaaaacagcactacctcggcatggtagcaacctggaatagaatgtctgtatctttttgctgaagttcgtgtgatttgacaacaaccaacttcagatgaacaacttcagaaaattcaactgtgtatttactgcattgtgactatcctgacttgtttactgaaccttgtattgcctcctttgatatggaattcaaatgaagattactgcaaaagatgtcccgggtgcgagaaccctaagcatgaattgtgctatgagctagctttagtgataacctttgagtatgaactctctggggtcaccgttgaagtgggtaaagaatgtctaagctttcgttattccagtttgatcgaaaatcaggtaaatactttgctatcttcgtcccttttgatattttataatctgctcgtgaattgacaatggacatgcacggatgcaccagcattcatgccttatttcgaagtcttttcagcattactggtcattttaatgatcttttgacatttatttgttttctcagtacagccaactggatcttagaagctgttcggtcgagaaatctcagaagtgtaccgtgtacgccgtctctgctacatgtatatggcttgattggggaactgattcttctttaccggttgaggtaaactcgttcacatgaaagctttataattataaagtgatttactctgtattctttatttttacttatggattataaaaggattttgattgcacgccatagtactaataatgtttttcctctacgcgctggcttcgcagtttttagatttcaaaaaagtaatgtgcagtttaaccaaactagcatggtggcccgcgcagattgcgcggctagcatcattatattttctctcatataatagcatatatgttttctcattatattattcaaatatattaaaatgacaacataattttaaattttgtaataactttacaaaactactaatgtgtaatattcatattatattttatatacgtgctatttattaattatttttactatcaaattttagttatttgtaaattatatatatttctatatggactctagactcgtcttttaatatatttttttattctgaattttctgtaaattgtatttctatatagactctatgctcttcttccaatattatttatttttatttatgaatttttattatttctaattgtatttctatgtggactctaaactcatctttcaatattctttaatttttaatttcgaatttcatttacttctaaattgtattcctatattgaccttcacctcttcttcccatgtttttcttaatttcgaattttagttatttgtaaattgtatttttatacggactctaaactatacttttaattttattatgtttattccaaattttagttagttttaaattcctatatggactctatactctacttctaatattccttattttttaattctgaatttctattttttccttaattctatttctatatgggctctatactctacttctaatattccttatttttaattccaaatttatattatttgctaattgtattctatatggactctatactctacttctaatatttcttatttttaatttcgaatttcagttatttcctaattgtatttctatatggactctatactttacttctaatattccttatttttaattccgaatttcagttatttcctaattgtatttctatatgaactctatactctacttctaatattccttatttttaattccgaatttcagtatactctacttctaatattccttattttttaattccaaatttcaactatttcctaattgtatttctatatggactctatactctacttctaatatttattatttttaattccgaattttagtgatttcctaattttatttctatctctagtctcctcttctaatattccttatttttttaattccgaatttcaactatttctaaattgtatttctatatggactctagtcttctcttctaatattccttattttttaattccgaatttcagctatttctaaattgtatttctatatggactttgccttttctttttctccgattaatgtgaggatttctaggccatgagagcgaacgtggaggctcctttctttatttctttaataatataatagatagatgttttgtaacgaagggaaatcagctatttttacaaaagaaagaaaaccgtatatctccacccataaacattaacggcagcattagatgcacactagtcgccactccctctcagtctcaggaagtcagaacgaacctagcctgtcggtctgtcggactactgacgagcatagtgactgatacagaggctgtatttgaatccaaacttctaactttttctatcacatcaatctgtcgtacacacagtcagatcgtactaatttcaacccaaacttctaaacttggaaggaactaaacacagtcagaactcattatctgtttacatactactagactagtatcttcttttcagtttattcactatattattgtcacgaattttgctctaggcttctaaaaatatgatatataaaagaaattcagttgttataaattatttgttagttttatttcttaaaatacttaatttatccctataacaggtagataatactttctctgttttttaatagatgtcgccgttgatttttgaacccacgtttaaccattcgtcttattaaaaaaatttatgtgaatatataagatataaatcatgcttaaagtactttgagtaacaaaaataactcacaacaaaattaattataattacacaatttttttgaataagacgaatgatcaaatgtgtaataaaagaacaatgatgatatctattaaaatacagaggtagtacacgataataatctttgaaaagctaatacatactccatctatcccataatataacaatctagaatcggatggaacatttcatattagaacgaatctagatagatgcatgcccagatttattgtattataaattgtctcatctaattttagattgttatattattggacggtggagtattagtgcatgtggaccgtataaataacatcactttctttctgtgtgaaccctctcaggatgcatctttggggaaggtgcagatccttaggtttctgtgctgtgcatttcattatcaaagccaaggtaactggacgacgtgcgcattgcactccaagccaatcacatcaacctgcagccgattgaaccgcggggttcaaattggctggccggtgccggtggcaattgatcgctctgcctcgtgccatcgtcggcacgcggcttgactctcttgtccctcctcgtgtcggcctacccgatcagcaccggacgcccagagcccagacacctcagcggctgggcagttcacatccgcgtgtactactacgcatattcttctttccccacccgcaatcaccgatcaaaccgcgtcgccctcagcagcggggtcaggtcaggtgcgccttctagctccttccttctcccactcgtctcactccatgctccactacttgacgcttatagcgcaccaatccccaactttaccaatctttttctccggacgatgttggtttctcccgcagttgtggtctaattaagagaagtgcagccttcaggtggctggtgcggcggggatggagccactggaggtggcgatcacgatcatcttcgacgcgctgttgctggtgttcatggtgaagctcttcttcgccatgttccagatgaagctcgtcgtcatcctcttctacctcgtcatcctcctcttcgccatggccttctccggccgggcacccagtagcttctagtatgccgcgacaaatttggaggtgcaaatctcttctttcccccttaattcgcgagctgattggtggatctacgtggattttcatcctctggtggaatcggtcgtctcggtttttgtgtaagaaaggagaatcatgaggccaaggtgcaaactgtgtagtcttgatcaaagaaaagccatggccatggccccctctcatgtgaatttagtcgagagtttcttctataatttccctgcttatatatttctacttacatttttgctaatgactcttgtcaaaagtgtagattttctagtggtttccttgatcatcaatggagagtagtctttcttgcaactttccccctttttctcttgaagaaaaataccacctgagttataccactttcttcataggagtatataaaaaggcagccttatgctattcatctcgccgtgtggcttcaataattatagagaaggtcccgaaaatgctgaaatggtagtctttctttcctggttcacgcgacactgaaatgtgcaatatagaaaacaaaaaagaagatccagtatactcctaccaatcaatcaatcatcaatgactattttgtcgtctgcgattgtacttaaaaaatactttttttctcatatcagtctacgctattgttcaagcttttctttctcatttcatcgaaactggctggcaaatctcaagttgacttatgtaaccttggcaatgaaacgaactgtgattacgccattacggcatcggctgatgccccctctgtcctctcaccacaccaatcgccatggcgtaacatgcgacgagcacaccacagtcaccgtggtcacatgctcacagcctcgcaggtgccacttgagagcaagtcttgaaatacagaaaaataatgatttaactacaaaatttcgtgcagctagaagtagaaatggggacaagttttgcagattttctgacagcaactctgcaagattgatcttcccggaaataccggctgaacaataaaaggtgccttttttaaaagaaaaaaaggcctattttacagcccaactgaagcctagcccgtgggtgttacgcgggagaatttttatttatatatttactttaaaaaattttaaaaataattggaaaaaaaaacgaaatactccatctgtcctaaaaagatttaaatccaacaaaactagacacacgtgtctaaatttattgtttttttttaacagatggagtatactctaacgcatgactgtgtattgtaaaagtcgccctttcaaaaaagaaatccttaaatattttttttaatttacagtttcacttcccgtccgttttagttactagtaatgctgatggatcttgttgagctctgtaattttgatgtaaagttttattttatccaacttcatttgacatatttgtaaagtggcaaactatatagaaaaaatgcatttaagtcccttcctgacctcttggagagcggttttcgcaaaataaataaaaaaataaaaaacgtctttacagagagagttaggggtatatttttaatttttgaagacaaaaagaattgtgtacataaaacaatccagtttactcgtgaggcccatattagtaggcccagaacggggttgggaggacgcggcccattacagagcagagaaatcgcccccagtttttaatcgatatcaagttcatcactcttcttgttttcaagttcatgctgaaattactccaccgagcagacagcagagaaatcgatcccagatgacaagcaagattatcgcacaataacgtcttgtttggtaacacaatgaaatcatgatgtaaaaaaaaaggaaaccaataaattagaggaaaacggagacccacagattatcacatttcttgcattctgattattaatcacctcattactcttctttaaccacctcgcttctgctcttcttgcccttggcggcggcgtaggcggcgccgtggaagtcgaggaagagcgcgagcagcgacgcgttgaagacggcgttgaacgcccacccggccatcccctcgcacccgccggcggcgaagtgccgccacagcatcaccgccgacgccgcgaagctgaagaggaactgcgcgatctgcagctccgtgacggcgcgcttccaccgcggcggccaccggaggccgaggctgcagcagaggtagtagccgtacatggcgacgtgcacggcggcgttggtggcgagcgcgatgggcatcagcgactgcctcgtggcgagccagaggtagcacatggcgatgacggcggcgtggtggtagacgtggagcagcgtcagcgggcggcggccgaggaggatgagcagcgtgtcgccgagctcgtacaccttggagaggtagaacacgtgcgcccagaagaagaccgggcccgacgccgccgtggcgccgccgggagggaagcagaaggcccaccacgcggagggcgccgtggcggccacggagagcacgcacccggcggccatggcggcggagagcgccaggaggaccgcgctgtggagcgcggagaccgcacggagcgcgcgcgggtgcggcgacgggagcgggaccacgcggcggtggaggaggaacaccgtggcgaggtaggcgcagatgacggcggcggcgaaggacggggtcgaggcgggcgtgcggccgggctcccaccggaaggaggcgacggcggggtggtcgaccagcgcccaccgggcgcgccgcagcagcgcggtcgccgccatctcgcagggcactgtgcacccacctccccgacctcgccggcctgtggagcgcactgtgtggtggtttgagtgacacgtcgagcctacattagcgggaagcttgggtatgggtggggcgctttgtgcgacagtgggagtgggcttgggtagtcgatgctgccaggctggggcaacatcagcccttctaagggcctgtttggcacagctacagctccagctccacctctcctggagctggagctcagccaaacaatttcagctccaccaaaattggaagtggagttgggtggagctctctcacaaaatgtactagagttgtagagctgtgtctaggcagctccacaacttcactccagactcaactcctggagttatatttaggagttggagctgtaccaaatatgccctaatgtttcgatgcctaaacgtgagtatgtacgtctaaatcagataacaaaaagggagtgaccaagtaagagcatctccaatagctttctaatatgctaataccaatcccaaaggataaattttaggaatttggtctaaaaccatgtcgccaacgtatgcctaaaccagctcccaatttttcagtactcccaattccggctcagcctttagccagatcttgggctcctcgcggagttcccaatctgagcaatcgttgcaatttaaaatgcaagggcgaacctaaactaaaaacttgaaactacatgcttgtttggcacaactctagctcaaactgcacctcttctagagttggagctcagccaaacagttttaacttcatctaaaatgggaacggagctgggcgaagtgctttcacaaaataaactaaagtaaagagatagaggtgggtttaggctactctacaactacactttaaacccaactcctaagataaatttaggagatggagctctaccaaacatgccatacatatttaaatccataaacttgcagaatgtattattgccagtcgtaaatttgatatggcccatcacatgggcactaaccccccccccccccaccacaaataaataaataaaaacttgagatgaaagtctatctagcaccctgaactttaacatcggacattcaaccccataaactttgcgataccattcatattagccctaagatggttttagattgtggttttgtatattttgaaagcttaaacgaataactttgaataactaatataacatatttgcatatcgtcggttgtaagtcatcaatttatacttatacattgatatcatactattaatatattggtagttgtttgtaagtgagagctaacaaggggtgaaaagaaagattcaggtggagattttaatatatatgtccaatgtgtatgtcacgtgatcaaacgcatccaatatatatataaattagataaaaacaactatgcaaaccaccttaggggttatataaatggtactgtaaagtttagggaaggttgaatatccggtttcaaagttcggggcaggggagggggggggtatttggactttttccctcctcttttttatccttctcatcctcttcttcccttgaacgactcatggacggtgataaacgaggtgagagcttgtgggcagcgaccgacgacaagctttaacggtagtgacttcatgtgaaaacgctcgaggccttgtggtggctagggatgagctcgacggcgccaagaaggtttcaggcagcggtgaggctgatgaggtgctggggtggatgcttagagggaggggatggttagagctcaaggtttgcagggagcttgttagcgcatggccaaatatgagtggaggctcatggcaaagtatttctacaacagtacaaccaaacctcatctttatctgaataagagttctccagggcctccaggcacccagacagagccccatttgctactctgaggcaaagaatgaggttctgcctgccacccataacaatatcagagaacatacaagagggtactcttattcagataaactaccatatcataattcagaaatcaactgtggtacactcatgggctcattgcctagaactgaacactgatacactagaagaattaaaatccatacagggctcaatatgcgtaaatatcaggaaacaatcagcctaattcaactgaataatgttgatgcacattcttgatgttccggccaacaataagctttgagcttcagtttcagaacagtggcaataccagcaaagtttctaggcattatcttataacgctacacaatacacattaccttttcccctatgatcatattcatatatcatctcaatttctcaagatcctgtgaactagtatccatctttctttgctgtaagaatacaccatcctctattcatagagatttgacatggcattagcaccacaaagaagtgatgtaaaacagaggtagataggtccccccaagttatcatccagtatcatcaataacacgaaccaaaatttcattccattagagcacaaatctaagcgcatgttcccaacagaatccatcaagcattacaaacatacaaaggatttgacataagaacatcacctcgagcacaggaaaacccccgggaaaaagctcagaagcagcagtcgcagtcgaaggggcagagcggggtgccgccggcgtcggacttgccgaacccgagctcgtcggcggagtatatcgccagcccgtccgccgtgcgccgccgcggccgcttctcctcgacttcgtcgtcgtcgtccgtgtccctgcccttgctacccttcttagccttattgctcttcttggccccctcggacctctccttgggcttcttggctcgcacagattcctcctccccctgctgctgctgctgcttgcgcttcttgccggatgacttggtggcctggaagatcttgtcgatctcgttggtcgccttcttcttcttcggcttctccgccgccaccgccgccgccgctttctcctccctctcctcctccgtgggtttcgaaggcttaggtttttggtcggaggacgaggccttggatttgatagaaggattaggcccggaaggcctcttcttcttctgtgatttggtggccatcggagtctcggagaatatgaagtcggaattcgcagccgccgccgacgaggaggagaaagattgcggtggctttggggaagggaaggaatggcggcgagaagggtttgcgagtggagactggacaggaagcttgtggagttgtggagttgtgggccttggattgggctcgttccaggcgtcgtctgacgctgaatttaaccagcccatctgacaggaggaaatttacctgaaacccagttactgcttttcatcatatttgttgttctaaaactcgtaaaaccccgctacaccgagtgaatttactccacaaacctttttgttcgaattccgatgattcccttgtttctttcaaatgattcctttgtatctttcaaataaagatatttgaaatagtaaaatgagaacaggagcgatataagttgaaaagaaatcggcttgagatggaaagagagaatatgtcaacttgtcaagcagatgtatcattatacagactcaataaacgaattcttccaccatttcacatttcataatttatgagttatgacgcttctgaacaaacagttcagaacaaaccataattcacaatttcacatatgtacaattgacaaggatagtttttgtatgtacaaattgctgatcatcgcgcatgcataatttcactgctttcacacttcacagtgccttcatgacgaatttggcagacacgacagctcccttggctgcaattttcagcacgtggcgactcctatacaacctgcacaaaataaaaggcaacagtcaaagaaagaaaggagatatctccgtatggacggtactgttgcatcttcaatgtcatttagctaaatcctactaaaaatagatcccctgaagaaaatcagcaatataacaaaacaaattaagataatgaaagtcaggtttgcattatgaaatggataggaacctcagcattgaaaacagaaataaaccaaaaagcagattgtaacaagacgtttacttgcaaaagcgacacaaatttagtatggagacaactttaccccactattgtgattccccatgttgccaatatgtaaagcacttttccagcctcccaaatactcatccatttccacttatcattaagggtgctcaatgccattgcaacagctgcacagatgttaaaagttagaacatgctacacagaattgaacagcacgtaaagcagactaagactctcaaagacagaatattttgtcaaagaaacttagtcatgtgatcaagaaatcttgtttattgtctcagtgcaatgaattactggtccaattaatttcatttgtgattggatgtgttaaaggggtcagtctcccataacatgctccaacattgagttcaccaagtactcgactagaacaatgcatacaaaaacttgttgtgataaccatatccacaccataatatagcactgttgtttagatccacaatgttggaaattagtaaatcacaacactatttcaaacagcatattgaagttcaagttctttcttggtcacacacacactgactcattgttttgaaccagttacctaagtaacagagtttagatgcaaataaacttcatctttatcaaatttaaagtaacagcatggagataagaagttagtatacccttttgcagctccactggtgatattgactgaagaatacagaacaacaaatagttagatcattgaggtagtatagagagtattcatcaattgttgaaaacaagataccttggactttggatcttcaagaatgcacctagcaataaaggaggtcataccatcaataatgtcatcatcattaacaagtacataattttcattatcaattccactgatttcctccatatttgccccgggtttatcacaggcaaccaagacccaagatccattcttcccgccaccttcagtgtatggaatatctgcaatatccagttctggttttgattcatcaatcaaacaaaaggttatttacattgttgttggcacaatgtaacgcaggaaacaaatagtcataaaagtatggttcacaaataaaatcgcagtgtttcacacagatgtacctgtcatgttatcaggagatagctctgtttgttgatgccttgactcatctcgaattttctcaagctgagccaagaagctagcattgttaactgctgctacaagacgattatgcagctgcatcatgaaatcacatccatgaaaagcaaaatcggtcagacattaaaaggtaaaacaaattgaacagtgatagaaataaaagctggataagggcatgtaatcacacaactgaatttctaagtcataagtgttttggtccatgcatattatcagtcagcaactcagcatcattgcatcacgaattaaacttaatatgtcctgttacaccccctcaaatggcatggattcgaatgattgttgttaaaaaaacggtgacctgataaattcatacaccgcaattcctgccaaatttcggatgctcgtgtttttatagtatctaacaaaacatcatctatgatcatgtcaattctcagaggattaaggttaatactcctaatctgaaaacataagagagcaacagggagttgcaagaggctcacatcggcagggcactcctgggaaacacagggctcgccttggagctcgcggaggatggagaggtcgtcggcgaggcgagcgcggaggataacgttctccgcccgcagccgctcggcctcctccccgtccaccgccgggggggagacgccgtcgtgggccgggccgtggccgcggcggtgctcgatggcgtagcgagccacctccgcgatctccacgagcgtgtgcgccacctccagggggatcttgtgcgccatcgccgccgccgcctcgatcggccgccggccgctcgatcccctggcctcgccgacgacgggaccgcgggaggagagggacgagaggaggacggcgaagtaaaccctagggccaaacacgcaacctgagcggagcacgaaaggattgtggtaaaccggggacaacccgtgctgtgctctgctcaccacagaagaaaagagagagaaaagaaagggttacggagtagtagtactaattaataacgggattcggtcacgttcacgtggcgccaagctgtgtctaaggagaaggaaatagaaaagattaggaagatacgtaaaacgaggtaagttattagcgtatgattaattgagtattaactattttaaactattttttaaaatatttttattataaaattttttttataaaaacgtaccgtttaatagtttgggaagcgtgtgcgtgaaaaacaatgtccctttctcacctaatctcctagaactaacgcacccaaatgtcacagggaccatcatagtaaaaatttctctatgtagaaagtggaaacgcactgaacgtgaaaattgtaggaaaaagaaaacactgtcgccacttttgcttccgtactccgtaggtccgttaacatccaaaatgttgtgcacaaaatagcgaatgaaaattttggcctttttcttctaacttacagtactggatatggagggtaaatgacacgtgtaaattttttattagttaattttctgcggaacaccatacataagcatacactcacatttattttagaaaaggttttgttacccggcctctacaaccaaccaaatatatgtagcatttttaaattaagaacttagcctattaaataagaaacttagccctcaaataacccgaatattttaaattatgaacttaactcggcctctacatccaactggatatatacttcctttttaaatcctcaaataacccgggtacttttttacatgtacatccaaccgaatatatgtagtatttttaaattaggaacttagcatatcaagcagagaacttagcccagcctctatatccaactggatttttaaaccctcaaataacccgggtatttgaacttagagccttgggatgctactcaagtcactgtaaccagattatatgacatttcacacactcacattcaacctactactatgaacaccttaacagatacatcgtctagaatcaaaagaatagttagttgtagacgcaagcacatgtattaagtttggaacttgaaattgagtggacatactccatcacaaggaccctttctagatgagctacgctaagttcacgacacggatagctgttaaacaaagtccaaaaattacatgaaaaaattagaggaaaaatttggacatgagaaaatagctttacttactactcccttaatcataaatgatttatattaggataacatttgataaaaattttaaaactttaaccataaatttcaaattaaaataagttaaatctaatagctttacaatattaggatatttcatttcaaggtgattttttttctgttttataaactgagcatttgagatgttattgatagtcaaaattttaaaagtttgatttaagtttatccaaaacatcaaatatttatgcctagaagtagtatattgtttagtctcttttttttttcttgccggcattatgaagcaaaattagtgatcaataagtattttgtggtagggcaaattttgaatgatgaactccactttcagtgttcggaatacaaccaaaatatcaagctaagtatttgtgggcacctgtgtctgcgttttgcaaaaaaaaaaaaaaaaaatcaagctaacattgtttgtttgttttctctaacaagctttgcttgtcgcttttgaagaaaattttgcttgcttggattaattgcgatcacgtcatatcggtgatacaccaatgcactccaaagtaatatcatagacacaggattcttaataccactagatcaagctttgctaacctgtgaagagattaaagaaaacatgagcatgttgttgggagaacatagggcaataagggatggggtagcttttagagggaaataaggattttgtccttaaaaaaatgagaaatgatttaccttcaacagcgaataatatgggagcgtatcctatgcacacaggccctcgcgtgtacacaccgtgtacaccaactaaaaattatcacaaaaaattctagaaaaattcatacatatactttcaatagtattacatctacgtgcaaagtcgcatcttcaaattcattctacatagaaaataacaaaaaagataaaattctgacaaaattgcaaccttaaaactgtcagatttttttttgttacggttaaaatataatgaatttgacgttaagattttaaccctaggtgtaatacaattaaaagtatgcgtataattttttttctagattttttggtgacattttttaagttggtgtatgcgtataattttttttctagattttttggtgacattttttaagttggtgtgcacgtgtgtacacatgagggcttgtgtgcatatgatatgttgccgaataatatgacagaacaagcaatgagctatcagaaggtcacacgaacagcccagaatacacatttcgctgacaggacactacgcaagttagagttgtacccaggtgcatagctgcattatgcagtcccatctgctgtacattatttgtacaaatatattccagctatcacaaggctaggcacaaaattagagacaaactaaccaggccctacttgatacaatgccgtcgatcaatttacagtagctcatatacttctctgataccgagatttcagagaagcctgacctttctcttcattaggagcatttggcaccggaccaacaaaatcagcatccccactgcttggccagactagaggaatcagcttctgctgatatgcattcgtattatcgcatatgccaagctggatgacaaacgttactgtgcagcctcttcctgttccttcgctatccaaccagatgtgccctcccatcaaagtaacaaacctgagataggatttttcacattttcagttaagtcgccgagtttacagtgagggagtgagtatatagcagcctcagcacaaattgggttgcagaaaaaggagctgataggtaagaaggtggtgatgtatagtaaactacctcttgcaa

SEQ ID NO: 47023 - DNA, 1462 bp, Oryza sativa
aggtgcatagtgtcatacttccgtacaattgtagatcaaacattttcccatatgattgtgaatatgcatgatacatcaaagtgcttcctattgatactctggtagcatgctgcatgctccttagccaaggaaagccattcaaacaattagaatctttacctgaactttcaaataaaaattgtcatcgcttgcagttgggtgaaaatctggggttctgaattctcttaaagagtcagccttcacaacagaagctacaagtgtgatgtggccctcctttgtaaacttaacagcattgccagagatattcaaaatagtttgcattagcctcttttcatcaccgatggcacataatggcaagtctggtgccaacataactgacacagacagtctcttgatggctgcgattggcttgatgaaactcattacctgtaagagtaagacgaagtaaaatttcaggcaagtgcaatttgcatatttagtcattaaacaaccataaatgatgaagtttcagagttcagacctccttgaaaacagcatgaagattgaatgctttaatctccaattcaaggctaccatcctcaagtttggaaagatctaacacatcattgatgagtgttgctaaaagattgctgcttttcaagactgtttccaccatcaagcgctgctcaggagtaagttcggtttccaaaagtaaggacgaaagggctattattgcattcattggtgttctcatttcatgattcataacagccaggaaatcattacgagcacggatagccatttcagcctcacgtcgagctaaatccagagcaacattttgctccattagcagatcacgcgcacgcatggactcttcaagaatagctgcatgagaaagtgcaactgcaacctgaaataaaagagaaagatgattaaaaaaacttgcttacaacactgcctcattcatatttatgaatataactaaggtgataaaaaagtaaagagggcacttttagcttgcttgctgcttctcagtatcctttgttttcaaaaaaaaaaagggaaactcttggaataatataatgatatttgaaattttccatgaatcattgatcaacagatcatagttgtgaatatgtgttgttttaggttaattggtgactgttgtctatcgattgaaagatcatgagcacacagcttttgaaacatattaaatatcacgctctctctcctataaatacccatgttataagtaaccatagcaaaagaaacagcactaacctgatcagccacgacctcaacaagctccaactcatgcacatgccattttcttgcgctatcagatggaagcatcagaaccatgattgcatagctctttgctgaaagctctggccaatcatttatttgaaagtttgaaagatgtagaagaggaactcgcactgcagccacttctggtggaacatatctccctgcaagaggtcgg

SEQ ID NO: 47024 - DNA, 2624 bp, Oryza sativa
  unsure (1)..(2624): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacttgtcataaaacgtgtaagtcggttctactgtacctttgacatttgtgctctccgtgccatgcagttttcgtaaacccacaccattttccttttttattttttaccttttgttctatctgctatgccatgtttttgttaattcagaaatcatttgtgcagggccaaagacaatctacaactctttcccttggtgctctgttccacgatcacctgttctcaatattgtttattttcactggggttttccttgtgaattatgtcctgatgggctcagcagcagttgaatccaataatactctggttacttttcaagattctgtagatttaatgaaccaggtttttgcctccagtttgcattctgcttgttttgagtatgaattctgcaccatagttccttcatgagttcctctgaatgccttctgcagatgttcatgaatccgatggcaccaattgtttttttagtgatccttatcttttcgagtcatgtcatctcattgacatctattattggcagccacgcaattttgaagaatttctttggtgtaaacttgcctcattctgctcatcatctgctactaaaggccgttgccatggttcctactatgtactatgcaaaggttgcaggttctgaagggatatatcagttactcattatctgcccagttatccaagctatgttccttccttcatctgttattcctgttttccgtgtttcctcatcaagagttataatgagcagatataaaatatctttgtacgttgaaatattggccatcctagcatttcttcttttgctgttcacaaatatcatttttgctgcggaaatcctgtttggtgatagtacctggacaaacaacttgaaagggaacactggaagccctgttgtacttccgcatgccattgtagttctaatttcttgtgcatcaattacttttacgctgttcctggctgtcactccactgaagtcagcaagtaatgaacctgaaactcaggagctatctgagcactctcagagagaagatccagatactacttatcaaagagaagcaagtaatgaacctgaaactcaggagctatctgagcactctcagagagaagatccagatactacttatcaaatagaagtaagtaatgaacgtgaaactcagcagctatctgagcactctcagatagaagatccagatactttttatcatagagaggagctttctctggttgaacagaaagaagatcatacgacttctactattaatgctattcccaggatttcatcagaaagttatcaaacatcagctttggagcataatgactttcctgacatcactgtggagtctggtcatggcactcagcagcttactgcttttgtgccaattattccggaggtctcatcgtctatcaaacataaggaaccaaaatcagtagttattgaccagacggaaccagtgccaaaggtttgtactgccacagtagtagaacataacactgctgagaacatcaaaatgaagagtacaacttcaaagcatgtccaagaagaagcaggagctagcatggactatgatactgaggcttcttataatgcggaagtcagcaagtcttctggaaacaaggcacctccaatttctgatgacccaacatctcttactttgagcaaggggagagactctgatgctggttatcgtggcagtaacctctcaagactgcctggtttgggtcgtgcagcaaggaggcaattagcagcgattcttgatgagttctggggacatctctttgattatcatggtaagctaacgcaagaagctaatgcaggaaggttcaactttctgctaggaccatacccgaaagcagttagaagtgataaccaagccatcgaagcttctaggagccccttgatgagagatgcaatacgaggatcagctaccatacagaaatcatgggactcacgtgctaaggaagtctctagtccaggctttaattttgtgcttcagatgggtcgcattggatcatcaaactggtctgagagcatgcgtttatctaatgctgacatcccaaggccaactagcaccttgtttgaacaaaatactcagttttattcaaattataatgtcccatcttaccctgacaatcagttctatcaacctgctaccattcatggctatcacctggcaacctctttgaaaagtatgaatgcaagtcacagcacgcactccagcatttcactagatccacggcgacttcctagatcatctgaatctgctggttctaactacgcagattctgcaaggtatgctcgtaaccaagatgtaattggttcacagggaaccgcttcgcaaaacaca

SEQ ID NO: 47025 - DNA, 2486 bp, Oryza sativa
tacctcgcgcgtcgtcggcggcggcggcggggagcggcggtggccgagaggcggtggagctagagccctaggggaaaggagagagaggaggacgcggcgcagaaaagggaggtaagatagccagccagatgcgcagaggcaggcggcacggcagggaggcagccagtggggagccgtcaagtccgccaccaccagtccaccacccggaaaaggcaaaagcggaggaggagaaaaaaaaatccaaccgcacggcgggtgcttgctatagtagcctagtatactacaactagcgtggctttgcttgctgctgctgccggtgcgggtgccgggtgcgtcccccctggtctttcttttctctccccctcgcgtttgtctccacgctacagctagcgctttgcttttgactgcctgcgttcggtgtggcccacgggggccacacggcccacacacctcacggccggctgagcggtatggcatcggcggggggaggtggtcgactggtcgtgatgggtggtggtgtgcggtgcgagcagcggagagggtgtaggagcgaggtgcgctgtcgccgttgccggcggttcgccagtaagacgggtgtttccggctaaggggcaacgttgccgtttttaccttcgtgctcactgtatcatttttgttggttgagtagcagagacagtgtttgagatatatgaaacgaaaaaaaaatcagcgtatacaaaacgagaaagccattaacgtataattaattgagttttaatctctactgttataaaaattaaatatgtttttatcggtattttaatatgtcatccgtgtttgaatctgtttttaagttcgttcgtttttgaaaatacatatacgtgtttaagttggattttaaacttgtttgtttttggaaatacaaaaggagacgtatgacgtatatgaaatctctttaaaaaaactcacgtgctaacttgagatgaaaatcagactcctaattgcagctcatgattttctaaaaagaaacatccaagcgaattctcacagtaaattttaccctatctaaaccgtataacaataataagattttttagttattataaagtttaaaaaatatatttattttatattttaaaataacttctatataaaagttcttaaaagacgtaccgtttagcacttgaaaataagtgttaacgaaaactaaggtaaaatcatcatcttaattacctttcatgaagatgaagataaagactaagtgtttcaggtaaaactaggaggtaataacgtgtgattaattgagttttaattattacagacttgaaaaatagattaatcttatattttagaacaacttttacatagaaagttttcacacaaaacacaccgtttaacagtttgaaaagcgtttctcaagtatccaaaagtttattcaactttcgttgcagaaaagaacatgccaaaagtagcatggtaatgcttccaacctcactcacagctcctcacaccaaccgagcatctatgtatagtctaggcaaaaaaaaaatttcccttcatatttctgaccacgctaacggtttagccaaatctcaatgactaattcactagctaaattttttatattacaaataaaaaacacactccaacaagctagccaaatcccactcatcaaatcacaatggctaatttcatactccctccatcccataatataggagattttgatttttttgctaaatcccttatattatgggacggacggaggattacaattgattatgttaaattttgcaataataacattttttgtacatggggctgctcagttcttgatgtatagattttgagttgaattactgagttttgtgattgatatgatatgttcatcttgatttttgggctagttttgtggcccatgttgttgttttattgtttttggttttggtgcagtcgaaataattcctattggtatgtttttcttttcattggatctagatcaaagggctgaaaaaaatctgtttgatttttgtcaaaaaaaaagtcaatgaatagttagacaatcccaattagtttatcaacacacattataatccatcatatcctttttgttaatctggccatttcttattttcgtgtgaacaatgaagttttctaaagtactccctccgttttataatgtaagtcattctagcatttcccacattcatattgatgttagtgaatctagacatatatatttatatatatccattaacattaatatgaatgtaaaaaatgttagagtgacttatattgtgaaacggaggaagtaccacataatgtaactatgtctctttggtgatttaagttggatctacttgtccagtgatttgaggcgctatttgtccattggtggagaaaccatctttgctcggttgacccaaatccatagtagtcctggttccattaaaaaccgggagtaaaaacgatttttagtcccggtttataagaacaacaatactaga

SEQ ID NO: 47026 - DNA, 3186 bp, Oryza sativa
tttcctgccttatctcattctgtttggatagatcgagcgagagcgctggcttatctctatccagatcgagcgagagcgagagcgggtcggcgcggcggcgcggatagcgcggaggcggcgggctgcgcggcggcacggaggcgcagcggcgtggaggcgaggaggcggcgtgcggcgcggcagcgagcggcggcctgcgcggcgggcggcgcggcggtggccagcggcgtggcagcgagcggcggcatggcggtggccggccggcgtggagaggaggcggcaacggccggctggcgtctctgtgaatttttttttagaatttgtgatttattgcatgatcctgtaatgtattgatttgtgtgtgatgtatttgcgatgaattttgtagaacttgtgatgtaatttgatttgtgtgcaattttattttaggatttgtgatatatttgatttgtgtgtataagtaactttaaagatttgtgatatagatttgggatgttaccttgatttggtatttggggtttaatttggaatacgcatctcacttgatttgggagaaaataaaaaagaagaaaaagaaaaaaaaaggagggggcatctagactgctgttatctcatctttagtcccggttgttcccctatctttagtcccggttggtgttaacaaccgggactaaagatcgatctttagtcccggttatttcactcgggactgaagatagcaatctttagtcccaaatttatagtcccggttgaataaccgggactaaatgagggttacgaaccgggaggaaaaatggtttcttcaccagtggtccttgatgtacactaaagttgccaaagaacaagaggcttcttgttaattgccaaaaagatcaggtatgctaccacacttgatagaaaatgctaagcacatttgattggatatcagtgcctgtcatgttgctgatttttcttatgcataactctcgtggtacagggatcttcacccgtatcaccttgttctcttttgaaaaaaaaaaacaacgcatttgattggatgccggtactagtcgcgtcacatacatattactctcgcagcagaacgattatcacccgcatcacttatcttcgttgtcttctcttttttttttcaaagagtttctgtagtaatagatcatgtttttgtttcctgagttaaatggatccatgcattgtaactttttcgatgttgaaagataacattactattcatttattttgagacatgccgttataattgatcaaaatttaaaatataccactacataccccttcaatacaattataaaacattttagattagattactcttcctccttccttcaccccttcttccttctccctctcactaatctctgtcatctctcccaccatttgatctagtgatcctatccaacccaccggttggacactccctttgttctcaactctcatcattcatggtgccacaacacaagcgacacaagaaactctggttcctaccggccaccgaggactcactccgccgctagctccatcgccggtggtgtgacttcatctagatcccagataaaataagagagaggaagaaggaagagggggtgaaggtgaaggatttctacgagggatgatttggtccaggttattttataattgcattgaagagatacgtcgtggcatatctcaaactttaattaaattgtaatatcatatctcttaataagcgaataataacgattattttcaaagtcgaagatattacgatggcatggatccaattaaccctcgtttaattatgttctcaaagtgtgctgcatgtttcattctcaggggaactttgtagtgtgtagtttgtgttctttctaaaaagattattactactgttgttttcaccatagtagaccgtggctttcggatccagttcctaagcagtttttagtgtgactataacttaagtagtcgcactagagctgttggatacaaatcaggtccaaattcaatatgacacagtttatccagggcattcactatagaactgttatagtaatgctgcagtatcatttaatctaggtcttcaattgaaaatttggatggatgagattgtgtgcatttctagttaagggaccctttgaatcgcatgattgaaaaaaaatataggaatagataaaatgtaggattttaatagaaatgtaagtgtaaaacagatgatcacaaaacacagaaaacacaggaatgactagttgactgaaccgcaggaaaaacataggaattagatgagagagatagactgaaagaaaagttaccaagaggttgaagctcttgctaaatttcctctaaaatctttataggattatctattctataggaatttcaaaggatttgataggattcaatcatttatttcaaaggccttcataggaaattttcctatacgattaaaatcttctaaaattcctatgtttttcctctaattcaaagggccctaaaactgcactggatctcgatatgtggctttcatgttctactaaccacataaaacatgacaccacaatattctctccgtcctataaaaaatcaacctagtatcttatgtgacacatcttattacaacaaatttagatatacatatgtctaaatttatactataacatatcacttcccgttctagatttacctttttttttttatggagggagtaggccaatagcccagaaaaaactgcagtccaatgcactgtccccaaaagtagagccacgggcccactcaacccagccacccccaattttatccaaaattaacccatagtactatgcatgagtaaacttcaaaaactcaaattaagtcgttcaaaaaaactcaaattaaaacccagctaaaatacggttctgggagcctgggatgtccaatgtaaactcaaaactaaccgggaaatctttcaccgcgctcgcttctaaacggatccgcttcgcaacctcaacctgcccccgagatgagaatcagattcccccgtcgccatccgccgccggtaaaaccgcgcgctccatgcccacgaagcaaccgacgccaccaccaccaccaccgcaagggccccccgcccacgtgcgccgcgccccgcgccgcggctcgcacggcgcaccgcacctgcgcctgctaccgctgcggtgaaccgagcggaaggaacgccccccc

SEQ ID NO: 47027 - DNA, 5336 bp, Oryza sativa
ccgacacttatgaaggtttctggaatgaaggtttacctgatgaatttggtaaatacacagggctgatggcaacgtatacattggaagatggaaatcaggcaaaatgaatggcagcggggtaatgcagtggataaatggtgatactcttgactgtaattggctcaatggcctggctcatggcaaaggttactgcaaatatgcatctggggcttgctacattggtacatgggatagaggactaaaggatggccatggtacattttatcaacctggaagcaaaattccttgtaaccttgaagtttctgactgtctaacaagtcatgatggtacaagtgcttcaagttctagtaatgaaaagatcactattggactgttatttctattgcaaaaactgtgcaagaattggaggttgcgtaggtttcttcatcggcccagacgtatttcaaatggtaccacaccagttttcgatgataattctggaagccatctatgccaagatgtatcaagtaaatcattttcagctgatgatcagtgtctacaagacagtgaagttgataaagattcggtttatgaacgggaatacgtacaaggagtgcttatcatggaacaaccaaaaaacgaagattcaagaatgtcggagagcggtatagcacaagaaaataactgggagaaacaagctaaaggaccaatggagactatttacaagggccataggagctattatctaatgcttaacttgcaacttggcatcaggtaagcttcattgtatgaatgcatcattgtttgctatacaagctttggagggttacactcagtgcttattatattttctggtttgttctggatatatccatttaggacaagggcaccttccatttagatcgatacatacgtgtaaagcaaactcttttttgacaattcaagcataaattagtgactgaagaatcaataatcatttcagtggggaaaaattaaccaccagttagaatgttctcactatgagtgacaacaaaagtagtttcttctttcgggaaaaagtgccttctctttttgaaaaatgacataagtagttgtattttgatatggagggagtatgtcataatgcatctagtcacgagccatctgttaattttttactagcatgttatttgtcttatcataatagtgattggatggtataatagccatattttatgaaaaacatcgattacctcatgaaatataattttttttatgttattttttatgtttacctcacgacatgtaactagttgatgttctttttaatgattaccccatttgactatacagtacttctatgcaggtatactgtaggtaaaattacccctgtgcctttgcgtgaagttcgttcaaatgattttggacctcgagcacgaataaaaatgtacttcccttgtgagggatcccagtatacccctccgcactactctgtcgatttcttttggaaagactattgtccgatggtcttccggtatatctctttccaatcttctcattgtgcgatagtctagtacttcatactgttcttttattatatcatctgattgtattacataggtggttcacgcattctgtactgaacatgggtggttgctcctctgtggttcacccctcccttgttaactgtaggaaattgcaaccatgatcttatgtatatatatgctatcactatcatattttcagataacactgcaggatgatacagacattgtttagaaatgcatcgacttgaaagttcgatcaattctgtcaattgttcttgtaattttctccatatcttattagctcataatttactctaccaggaatcttcgagaaatgtttcatatcgatgctgcagattacatgatgtctatatgtggtggtgatagtctaaaggagctttcttcacctgggaaaagtggcagcattttctatctttctcaagatgaacgttttgttataaaaacattgaggaaaactgagctgaaggtatgacccaccctcaatttttttcttgcaataacaatagtgttatttgttaattaaaaatgactaaaactgagctttacaagaacaacaaagatttgtgctaaaaaccgtgtatatccttgttaagtgataagatatgcctactgcagattggtttgatgtaatacgtgctgcagatactattgaagatgcttccaaagtattacaatcatgtcaaagcttatgataatacgctcattacaaaattctttggcgtgcacaggattactctgaaacctggaagaaaggtacattatcatatcatactgttgtgttgaatgttgttgtctatttgtacacatttgctatattaattctatgtatggtgttaataggtccgttttgttgtcatgggaaatatgttttgtactgaactgcgaattcatcgtaagtatgacttaaagggctctacacaaggccgatcaacaaagaagcaaaatataaatgagaacacaacactaaaggaccttgacctatcatatgtttttcacgtggataaaccatggagggaggcacttttcaggcaaattgctactttcttgctcctcttttttctgaacatcttactgtcgtctttcatggttttgtctatattggcttgaagtccaggttccataacttaccgtttatgatgttacttctggagattgtgttcactgggtagtcccttctggaaaattaaaaagaacagtagatttaaatgacttgtgcagattcctgcttcagtcccatgattggtggacatcaaaattattttctactattttgatattgattcttatcctattcttgagatctgaagaatacttaagatggacaatttttatttatactatagcaataaatagatttttttaaatataaacaactagattaaagaggcaaaccagattttaagcagtgtccgaccatgcatacaagagattgaattccagctgtctagttcagttttgcatattactgctccatttctgctgtgctatttttcttaacatggttgacgatgatatcttgagagccaacagttgtactattttcaggcagatagctcttgattgtatgttcctggaatcccaatctataattgactatagcatgctattgggaatccatttccgagctcccaatcacctgaagcgtatcacatcatgtcagaacgctcttgaaagtactggaatttcagctgaaacggaatgtacgtactaaaccttaagtacatctgagttctctttattatattcctctgaaaatttgtccttttactaaatctgaagtcaggactacaccagattctttatatcattacatcaaccaattgcctatcttcagcttttgacttccatttgttgcctaatggtaatatcttagtctttttttcaccttaatcaggtagtgttgcactgcatcatgaggagacaatttcttcaaagggatttctactagttgctgctgatgagccaggtccagcagtacgtggttcgcacataagaggaagcatggttagggcagcagaaggtggttatgaagaagttgatcttgttttgccaggcactggaaggtagattgacttgtacttaattatttcaaagttcaacttagcattgggtatatttgttgctgcacaatctgaacatgcatagaagaaagaatataaattgcgtagtatagctatcacactcttcaggaaagatttcttagtatatcagtgtgttctaaagtacaaagtacaacgaacttgttggtgacttgatccattatttgattttttgaacttttatatcaaccctttagctttaaaataaacattcacaatacaactcaacgttgggtgaaccatggcagctccaccagacaacacgataattttatgactattcaatgcaacatctacgtttgcaagttgatagttaagtgtgaattctcgaagcattcatagatgtagagcatataatagctcgtgcatttgaataggctgtgtcaaaagaattatcatttttgtgcatggtaaaacaaggtcaagtgtgtgttcatatatttggaaagaaatatcagtaatatacattgcctgtcttctttagtgcacatacggcggtggttttacacttttttgcacctgtgcccctgctatactaacttaaacttaccgttggtgcagttgcatatcataagtgcagaaaatcccaaccacatattcacacgttttacatgccgtcaatgtttttttctgaaactatggtctgcgtggtactttgttttcacaaagatgcattctgtttctgactcatttgttcgttattttcaggttccgtgttcagctaggggtgaatatgccagctcgagctcggaaagtgcaagaggacgtgaacgtagaagtagaaaacagggacaccattgaagagtatgatgttgtcctataccttggtatcatcgacatactacaagagtataatgtgtccaaaagagttgagcatgctgtcaaatcactaaaattcgaccctctttcgatatcagctgttgatccaaatttgtattcgagacgatttataagtttcttggagaaggttttccccgagcaagattgaacagtaaatagatattgcaagtttcttggagaaggctttccctgagcgagactgaacaataaatagcagcgatgcggccacacatctagatcttcttgtaaagaattaacatatacccccattggaattactttacagtcggcaagcttcttattaagctccaacgaatttcagttcaactgtgattttttttttcagaaaatagttctaaactttcgtatgtcaaccatcatggtaatcttaagacagtttgataacccctgtcgctgggcaagccaacattcatcagtaaattgctcgatttatactagaaacgcaaaggatgcaatgattaacagagtatatcgctcaacggcaatacatcccgcaacaatatatggcttgataacagcggggaaaatctcaagcgtcaacagacatacaacaagcgtcagaaaatgagggcagctgaaggatatcaaatgtggaactcctagatgcctacctcgcaacaatacaaaacaaattacctattgcacttcctcagacaccggaacaccatcagcagcttcttcagacggcttggtttgctcatcgctgattggctcgttaatgccaaggacttcatccatcagctcatcttccacggccatatcgtccatatcatcctcatcgtcattgccaccctcaagaactcgtcgagtttttggaccatgctccgccctgtgcgtgtccagctccttg

SEQ ID NO: 47028 - DNA, 21307 bp, Oryza sativa
aacattagacatgtactgttcttcgacttgcttttgaaactgagttagctcagccctgcgttcagatttccattcttgaaatgcctgcaacattgaatatgagttcatgatggatgaagaggacaaagaaaaatcggttgccccagattgtacaaaaaaggaagcccaggaaactagcaagcatatgatgtaaatggcaaaatgtgaaagatgagtattgacttgcggaagtggcattctcttaatatgttgcacttgaccaaggactatcccgtgaaaggttagatcaatatgctccatacatgcaaaggaagagcattgatgcacagttatcgaatacagccagtcccacccaaaccaccagagcactttcaagtataaagctttgtaaaatatgacaaattcatagcactgaccacgtactttcaagtgcccagaaatcttactgattcgatatgcattttttggtaagattttatatcatgtcaccaaaataatcataatgcgggggaggggggcagcaatttcatagctggctgatcagttagccgttgtacttatttgatgtttgattgaaccatgacagagcagaaaccaacaggactggatatatgcaggcaactggcattctgatggtgccctatgatgaaattagctatgccacacaaatactacagcagcaaaatagacaatttattatttgtagtaggcacaagtttgtcctcattgtgtacatctgtagtgttctgcctcccaagttgcatgtagatggaggtgtgtataaagggtcgcaattcatccttcaaaaatttgtaaacttagcgtttttactttgacttatatagggcagaaaataccttttccttgttctcctcagcaatagccggatcatcaattattggtttagctggcatgtagtaaattggtggttccgcagttgtcctgacaaacaacaataatgttcaaaaagatactaatgtgtaatttagcaaaatggatatagaaacccctatgaacatcaaacatcaagatttgcacaatcagaaacgcatcttccctcaatttaattgtcaatatggatacttttggaccaggaataaaaataacctgcagcacacaataagaccagttcataaaagagtaagataaatacagataaaaatattgcaaagtggcacaacaaaaggaaacaaaaagggaccccattcatggataaaaaaaggtgcagaatgatgcaaagaagtaaagcgaccttaagaaattggacagctttttgtgatgctcagcccactgcatgtataacagctccaacctcttttcttctgccttagcagctactcgagcacgcagcatctattcaagagcatatcaggaaaccatttgcaacataaactcatcaatttaactcaggtgaaccaatcataaataaatgcaagtcataaacactgatgtgagcttaccatatcacgcttacgcttctctattgcttgctctcgctcttgctgccgcaacctttcactttcctcacgagccttttgatcagcctacattcacgcaatctttttcaatattccatgctacatcagacctaatagcgagaataaaatcaaggctagaccatagtatatgcgagattactttgaaagaaagaactgagaccctagagaatgaaatcgatatctcaataatggaagatcacttagcctaagtccagcaaaagaatggtaataaaaagaatttaacacggtccattcaactcatggtactgtccaaagttctactagggcaatgcatatagcaacaaaaaggtagttgtataaagtgaatgtgcgctagatagttcctatgggaatagatattttcaggaccacaggaacagaaaaacataacactgcttgaaaaatgcattctacttatctaaatttcattgatgtagtatcaggagacaagacgttttctgttgatgtatgtgttttattgagatcgtttggttcattcatgggtcatggcacgggacacaatagttaaattccaacagcaatattacattcataattccatgtatgaaaatcaaatttctaattagcacatgtcatcatgtgaataaagtggatgcaactgacatcagccactaaatcatgcttaaatgtagattggcccaagaccaagagaaattgttagtacctttcgctgaacctctgatctgcgcatataagcctctgtgttggacagttttttgtcctcttgctgaaatttctggattaccaagcacaaggaaaaatcaattacactgatttgaaatattcacaatgaaggggactaagggtggcttgccactagtacttccattaaattcctacctaattgacaggttgccatacccaagataaagctagttaacaaatactgaaaattttcttttgtgtgtatcagtggagaggaaacactgaaaactgttgatatcttattatcgcttgacccatggattgttcctttgtatgtctattgaatcggttacctctaatgtaccgacaagaagcttccccagcatcctcttgttcctcttcacaaggctttgatcctcatccttgggaaattccctcgggagaggttctggcaatgacatatcaaactcctgcaaccaaaacaatacagttaagcaaactcaacccgcaatcccctatagttccagcctactcaccctcctcggcatgcgctggctcccatccctctgaacccaccatccctcctctcaccgccttcagcagcagccgaaccgccctccggcccctctgcctccgcttccttcttgacatcctccttagcttcagtatcctccacctccattcatgacaccaaacaaatgcacagaatattagggttatcgacaaacaaaccacaagtttgactaaggaaaataaaaaaccaaagcctaggcggatactttaaccactgcagatagaatcctccgcttaggcgcagactggtccaccaaatccacagccttgcaacacaagaacacggaaataaatcaaatcacgaatacaaaataaagggaaagggaagaggagacgcaatcgcgacgccgtactggtctagggaatccgcgaagtgggcggggcccgccgggtcctgcagcggcgggcgcgccgcggcggaggccgcgggggtctcggaggcgctcgctgatctgcgcacggggagaggagatcgtgctgagtacagggtggtctctcaggggagggagagagggagagaaaccgacctcgcggtgctggcgctggagctcctggagctcgcggcggatctcctcggccgtcttctccgtcgcggcggccatcgtcgtcgccgtcgaggattccttcggctgcgcggggggttggaggtggggttggccagggtttggtttgggttgccctattgtaagctttgctcctctgcaaaagtgcaaaggggccgaagcccgaaggcgatttccccgcggcagacctgggaatgggccgggtctgatcgggccgcgtaaaaaaaaagcccattttgtacgggccgaaaatccgtgcccaagtccggcccgtgaaggtattaagacaacgagttttgggccaagagcaggccgggcctgctgccttcctggttaccttcaaaataaggctgcattcggtagatgcagttgggaacaaatcctcctgcatacaaaatggagcggtccattagcgcgtgattaaataagtatttgttattttctttctaaaaatggattaatataatttttaaagcaactttcgtataggtttttttttgcaaaaaaatgcatcatttagcagtttgaaaaacgtgcacgtagaaaatgagaggattgacttgggaaactcaagtgttgctaggtgagaataagtccactttgactccctcaaatataggtccaatctaatttgtatcctttaatcgtatatcttgaaccccaaattgttaaaaccgatacaaaatcactcggtggttttgaaagcgattcttactgacatggctcattgacttagtctaacatgctggccaggagcaggccgggcctgttgccttcctggttacctgtcaaaataaggatgcattcggtagatgcagttgggaacaaatcctcctgcacataaaatggagcggtccattagcgcgtgattaaataagtattagttattttctttctaaaaatggatcaatataattttgaaagcaactttcgtataggtttttttttttgcaaaaaatacatcatttagcagtttgaaaaacgtgcacgtagaaaacgagaggattgagttgggaaactcaagtgttgctaggtgagaataagtccactttgactccctcaaatataggtctaatctaatttgtaacctttaaccgtatatcttgaaccccaaattgttaaaactgatacaaaatcactcggtggttttgaaagcgattcttgctgacatggctcattgacttagtctaacatgctgaatcaacatgtaggatccacatgtcagcgcctcctattccttttccattcttacttttctgagtgttcctacatcctccttttccctacatgaacacacacgacgacgagcagacctcagcgcaagcaaggaatagctgtcgccggcggtgatgaccgtgtggtagggattcaaattcagtgacattgttatggcatggcatggtgtgacattggagcgatctggagcgttgaaatctaatcgaacggtctgctgcgccggcccacctgcagcctccgttttcagcccacgctctccgtttcctgccgcccgacgcccaaatccctcgtggtcgcatcgccgccttgccgcttcgccttcctcgcccgcgccaggccgccgccacaccaggccggagaggcgccaggccgccgcgagtggggaggggactaggcggccgcctcgcagcttcgcctccctcgcccgcgccaggccggagctagctgggagccgccgccgccacgccaggtcggagaggtgccaggtagccgcgagtggggaggggaccgggcggctgcctcgcagcttcgcctacctcgccgctgaactttgttagtctcctccctttctcctctaaatttttcatctctctttttttttttacaaacatctacatcaacggttttgtttgatttaattttccatgcctgaagtttgggctttatatatgagctttgatgtgcttccacgtggattatgtgggactgtgggacagtgggagcagcaaaccatataaccaagtcagtgctgggctgctggctcacgtcgtgtattccgccgttgagtcgtacgcgtcggtcgaacgtatagcagctttcttcctgtaacacgcaaggcagaggtagagcaatctggattctatttcaagaacatggatatcatcgagcagacgcgggatgaagatggattctaatatcttaaatgaacgtccacccatttcatgttaactaaatagttataaaaaaattaaaaaaaacgataatatagattagtatgtaatatatcactccaaaaaatacaagttcaaatttaacttttctaaactgtaacaaaaacaacaaattaaactctaactagtatatgtattaaactctaacatgtcaattaaataacaaattaattcacaattaaatttgttattttcgctacaatttatagaagtcgattttgaatttgcatgtttgtcgaatgatatattacatattaatctatcttgttttttttaaaaaaattataactgtttagttgatatgtaataaataggtgggcgtccatccaaaaaacagtttccagtttagcacgggctgaaccgctcaaatatatgtttgcactttggagtcgtggagactttgaaagatccaatcagggaaggaactactttagttaagccggcaggccggcaccgccaccgaggaagtcaagcatttgctgtatctgcatgtcatccgacatttttttactgcaacttcacaatgcaactttgtacttttcttctttgcctaccttccaccctggtttgtttaagttaagattgtgatcgtttggagatgaaaaagcccgtgatcttgatatcttgcctgtacaatttgtcaagctgagtgcaaagttaagttctccaccaattaaagaatcagacgttccgctgccggctatttatgaactttgacgactgacgcccgcgtggagtagtcagtagtctcctaagtacagtattattagcatggtacacttgcatcatgcttgcctctcgccctctccgagatgccagataatgaataatgaatgttttctttggaaaatctcgaaaaaagtttcacatacaggaaacagtcctactccggtgttttctactcggagtagaaagtaatttgggcccttgatcatatttaattgtagggctgagatctagttctactcccaccagaattagtggaagtagaaatgtggaggggtgttttcatccaggaaaaataattcgcgtaggggtattatcgttttccaatccatagatcaatcaccatgtcatcctcgtcggagttggtcgtgcaagatcttaatcgatccatgtaatccatgaaacaatcggaacgacaagaagacgaatgagctgagacgatgccgccacgcaaatgacgttgcgtgcgtgcgtgatgccgccgccgaagcccatgccagaatttttactaccaccagaactcctgctcaagatcgtcgctcgctcggacgctgccacgctcgtccgctcctagacggacgatgcgactgaggaggcggacaaggcggcgacggcgggggatacagacggtgacggagggggcggacaaggcggcgaggccgggggaggaatagcgaggtgtctgcatgcgacggagtccggacctgatgcgatgcgaaccgaagaaaacatcccaaaccaaaattacccctaaacgatattaggagattacttacctgccctttaaaataaacggtcgagattaattctactcggagtagaatactgcaagtagattgcaccggagcattactctacaggaaatgagtatgttgtgcgtgttccatgtactataaaaagttttacaattaaatttcaactttgtctgggcggtatcaaattgataaataacaaagaaaaacaaaaatgaaaaaaaaatcaggattagaattttccccaccgttcggcctttgcatattttgggtaagtggactacaaaacaaaaatcattttattccaaggattttgtagttgcactgttgcaggtgtacatcctgagatgcttcaatccttgtaagatctcaattgctgaatgaatccgtcgatgtacctctcatggcaggccatgtccgcgacgatctcctgcagcttcttggctttggcttgaaacactttgctgctttcttcctccaccgcgactgcacgaatcgccgccgcgacgccttctcggtcgaacgatccatcgccgtcgtttcttgccacctgcaatccggcgttcttcgcctcgattagccgcgcgttcggtccctggtcgccgaagatcggcagcatgataagcgggtggccgaacatgagcccctcgatggtcgagttccagccgcagtgggtcaggaacgcgcccacggcggcgtgcgccagtatgctcatctgaggaacccatctcgtcgccacgacgccgcggccgcgcgtgcgctcctcgaagccggcggggaggaggtcggcgtcggagacgccagtgggcttcctaagagcccagaggaagcgcgtcccggcgagctccagcccgagcgcgagctcgtggaccttctccactcccagtggcacctcgctgcctagcgcgacgtacacgacggacttggccggctgcgcgtcgagccagcggacggtggcatcctcgccgtcctcgcggcggccttcatgcaacggcggcataaggccaaggaaggtaataggcttaccgcggagcgtcgacaggagcgggacggtctccggctcgaactccacgcagctccgcccgacgacgaggctgctcctcgagagcgtcaaggagaagcgctcggcgagggacattcccgatgagcctttggttcgtatcaacttcatcctcgccacctcgaacgttggcgccgccgctgggcgtccctgcccggcagccgcaggcgactctgtctccgcgcgctcgagccgtctgtctgctatggaagcgatcatatgtgcagagcccaacaacatcattgcacatggcacctaaggcgaataacgtagcatcaatgatggaattatgtaattaaggttagtgcaaagattgagctattagtaggacttggtgcaaccttgtgctcgagagcggcggctgcggcccagtggtggaagacgtcgacgatgacccagtcggcgcacgcggtgcccaagaactccgagaagggcgcggcgagcccgtcgaaggccctccggtggagctcgaccatgtccggcctgtcgtgggggacgtcgttggtggactcggcgccgtcggggagcccctcgacgcgcgggagcggcagcgccacgaaggcgacgagcggcgcgagcgcggggcgcaccggcgggaggcgggatatgttccgcggcgtggagacgaacgacacgcggtggccccgcgacgcgaggcgctgggcgaggtcgaggcacgggagcaggtggccgaaggcgagccacgggcagatcacgacgtgcatcccggcggcggcggcgtaggaggaggagtagccggagtccatgacggaagaagggggccggtgcgcgcgtggagcggccgagcgggcgggtttagcgtgcggcggcgtgggcgtcgatgtgcgggcgcgaccgatgaataccgcccggacgcctgatgatgcgatgggcagtaccgcccgtgggtttggactttgtatactttggaggtttaccaagcttgctccgatcgggctgattgcttcattactgcgcgacgtattaaattctacgtcagagggacgtagctttccgcatcgccgttgcttccacatccaacggcacaagttcagtggaagcgttcctgtcctcctcccattcgtctcatgcgcgatgttcagctgctttcggcccatttgcagaccaagcagagaccgaaaaacgtcgcgataaggaaggggaggggaggtaaaggcgagaagggaccgagctcgcgcgttttggcgcgaggagcggacgagcttctctgcagcgcgctcgagcgtgttcgaatgaggagtgattgggcaaaggaggcgaccgctgggcgccggggtgcctgggcgggacgagtttctctgcaattctatcatgtgcgtatgtcttcaatggttctgcctctcttcttccatctcatgaatggttcacgtggatgttagaacttagtgtttgcctaggtgcggacgacgtcggcatgacccagtcggcgcaggcggtgcccaagaactccgagaagggcgcggcaagcccgtcaaaagctctcaggtggagctcgaccatgtctggcctgtcgtgagggacgttgtgggtagactcggcgccgttggggagcccctcgacgcgcgggagcggcaacgccacgaaggagacgagcggcgcgagcgaggggcgcaccggagggaggcgggatatgttccgcggcgttgagacgaacgacacgcggtggccacacgccaggcgctgggcgaggtcgaggcacggaagcaggtggccgaaggcgagcaatgggcagatcacgacgtgcattccgccggcggcggcggcagcggaggagtagccggagtccacgacgaaagaaagggaacgtcggaacgatgcgctcgtgcacggtgctcagcgtgcggcagcacgggcgttgatgtgctggtaataatggtaaggggattctaaattctcaatccttatttacatatgattcaaatgattatgattttttttaaaaaataacaagataaattgttaatatacgataaatcactctatacacatacaaggtaaaatttgaattctataagttgcaacgaaaaagacaaattaaataatatctagttaacgtatatttgtagtcaaatttttttcagttgcaactcatagaaatagaaatagaatttgatcttgcatgttagtataataatttaacacgtattaatctattttttttaaaaaaaattcataacaacgagtttagagtagtttcccataataatgagatggttcgtataggatacgtagctgtcaaagctaggccgtaggtgagtttggactttggagtctggaggtttgatcgcttcattaggccggcagactatatattgcgtccatgtggaattgatgttaacaaagaaaaaagggatttttttatccggtatattgaacaagtttaattaattaacttaaaaaacaaaaaaaacttttttagggaatactaccaggcctaacccaatagtgtaattttacaaaagcataaaaaaatacttacaaggaaagttacaagaaaaaaaaacccaaaacaagattacggcgttgtaaaaccaacaagtagctacttcctccgtttcacaatgtaagttattctagcatttcccatatttatattgatgttaatgaatctagatatatatatgacttacgttgtgaaacggagagagtatttatttaagaggaggttggcccgagaaggaggagagagagaagaggaccccggtggcgggccgaaagagcaactaagagctttgggccggaaatggcctaaagagaaggagagatttatttttaggttttcattttaattaactacaaatttggtttttgttgctttaaaattatttcttttgctctagaaatcaagtaaaaatcgagggaccaattttgaacatggagattttaggaaaaatactccaagctcaatttgaaaaaaaaaatcacctggaaagctgctagggatttgcctagcaatgtattttcattaaagcagaaaatatttacagaggtttagtgcttgagatttcttttagatttataataatttctattcttttcttttataaagtgatttttaattcggggtggatttatcaggacatgataggggcccacactctcgtggactcaaagcgcgtagtggcgacgtcaccgggtccacctccgcaaacaaccacttcgcatttgtcgggcacgatgttagggattttgggctatttgccactctctcttcgatgtcacattctcaaatgttatcattcccaataacttttgttatttgccatcgtgatccaccaagttgtctctgtttcgttatttttgactgacaacttagcaaaactataagaaaataacctcattaccctctcattcatctcccttctaccttcttcctctctggcatggcatgaaccaatctctggtgtgagacaagctaagcagtagggacggctagcgccatggatgaaccggatagcaggacaagcaatggatgcgacaatggttgatggttcatcgaatgggtcatcggggccaaggtagtacatcttggttgcaggcccttcgcatagatcctgtgatgttgggagaaacggtgcaaatggatgtttaggagggggggagggagccggcatgggtcaagttgtatgctccagcgcgagtatctcgcttgtggtcgaggtgacctcgacatatcctcgctcgtcaaagacctcgccgtcaaatcgcggaggctcgcgccatccatccaactgcaacagtacatgggattctcacgtaggagaggaataacataggagagatgaggaaagaagaaaagatagaggagatgagaggagcagtaaggtcattttctgtttcttttagtgtgttggcagttaaaagtggcaaaatagaaacaatttgatgaatcacgatggcaaattgttgtcgaagcgacaatagcttcacgtcgaaagacgtggttctctcggtggagtggttgaatagtaaaacaaggtattaattgatgatatttttttggatcccctattacatgcccctatagggccttttatagtcttagtaaagactcatactcactagggtttagtgtgtataggagaatttatattgatacccttaagataaggacattagtgagggcacatagtgtccatcctagctatggggccctagtcgggcttcgtgggccagcccatgtgtggcgaatggccttcttgggccatcccgcactctcaggcatgtttggcgaaggcatctagctcatggtcgaacccctccggcttcgcctctgacagagacttgacgacaagtcctatggacagggtggcgaacccttctagcttcgtccttcggccttgccccctcggcttcaccccagtcgaaccccttgatcgtcgagcagcacttcataggtgtggtggttttggcatcctcgatcaaagcccctcatgacatactttcaacacaaataattagagttattagggaagatggcatttgagaatgtgctattgaagagagtggcaaatagtccaaagtcccgcgatatcgttgttgtcatcgccactttgcagattcaccatacgatctcgtcgtcatgagtttgctttactccctcgtgacaacggtatattctctcttctaaaacctttttgcttgtcatatatttctaagaaaagaaaattttaacggtatatttttcaattatttttggcagaagttatctcatgttttgtcggcaatgtatgcccttgcggccatgcggccatgcccgtctacaagaccacaatcacgctcccaaaacagacaactgcacctgtgagagcgcgatgcaatcgcgcagtggctcgacgaaagcagccatcgcacataggtttcgctcatgtgcaccatgcctaccatcctctgccattgcacagaatttttttcatttttagattttttttaatatttacagaaataatctatcggccaaaaaaattgcaaaactagaacctgccgccccagtggtgggcgacaagctgacgtggcagacagcgggtcgaccgcgccgtctgccgccgtcggcaaaaattgcaataacccccttgccgcccatacagagggcggcaaggggctaattgcaatttttgccgccataaagaggttgcgctcgtactttttgcatttgggccccttgccgccccagtagagggcggcaagggacccagatgcaaaaagtacggccaaacgatttttctatgttatgttaataataaataaagaagtatttattggtaaaacatgttaatattgttataaaaatgtattgaagttggttgtttcgcaatttcatatgttaagtaaggtattattttgtaacttattcgacgtattagtactcggataattaatataggcctatcgcagtctcggtcgtagaaacattatatggacttaaacaaggagagttatgtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatacattctctgtattgacatctccttggtggttcctgggaggaaagaatagatttaaagcgagcaaagttagtaaatgttgtgagaaaaaaaggattcatgtaatcaaaatattcttaccatgaaatcgtcgtcaagaatatttggacaaacaaagaaccttcgacccaatgttgtaggctttatggaatgaagaacctgacaacgatcaccacacctgcatcttggacgggcttcccatggagggagtgctatagttagcacctgccagtcgctctgttgttcacgacattgtcgttcataagccgcttttctctgtaagtattgctcagtacttttggatgcgaaataccagcgaccttcttgtaaacaagtggttaggtcgagaacgggattttctgtatcgacccactcgatgtatgcgtaagccgtagtgcgggtctgccgaatagagtagtgttacgaagaataaaacgattgcccatacggaatgaataagcatatgcagataataaaatacctcacgatcatagttagggcacctaaaaaagcgccttcctcgaatatcaggattcctcgaagccattagttggcatcgatcaccgcataggcagagaggacgctggcaccaaggtggtagtaggtatacacaagtattgctacgccagttcggatcctcaacaccccggcgtctagccattgacgaaagccggtaggatttgtaatgaagcaagtggggaagagagtactgaatgtgactgagttctggaagattgtgaggcctcactcgttaaggcgacttatatgggcgcaaaaaatcgagtgatatccctgacatgtgaacgtggcggggcatggtgggtacgcctgatcggcgccgaaagttacatgcctgatcggcgccgaaagttacattagtcgtatgcggcaaatggcgagcaaatactcgtatcgtacgcgaataaaggaggctgcatcggtgcggcagaaagtagtcgtgcatgcgccgaaaggtatcgtgcatgcgccaacaggtatcgtgcacatataacaacaacgtattcattacacaagcatacagtactggaaagtgaagcaaataaacaaagagaagactgctctactggccctgccccgcgtcgcgaccacgctcctctgtcgagcctgaagcgaagtcgaagtcagtgatgtcgaagagcaaggtggaaggcaccaagcggtccgacgaggtcccagcatggtccagtggtggaccctgactcgacgtgccggctgcctgtgacaaagtcccggtgtactgccagaactgcgctgagtgcgaggtcgatgcagctgcctgagacgctgaccctgcagcctgggagaagtgggcggcctgcgtcatagcgaactgggcgaaacctacacatcgacaacgggacccttgtaagctaagacataaaatgcatgtaaattgattgtcgaagtaatgttattttttaagtacctgtggggggcacaacagaaggcctagccgaggaaggcggggtgctgaacggtgcacgaaaccctgaagcaatcggcaagtgaaacggctcacatatatgtgcgaggcatgtgcagaaaaatccttaaaaatacttacctccgtgcggagggggagtcggcctaggaacgtgcgcagctggacggggaccagtcggtacgggtggccgctgtacagctacgtctgcccgagcaacgtcgtctgcacgacaggtgagcactcggagaatcgagcgcatcgactccaccatctgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtacatattcgtaaaatttgataaagagaaagacatgaaaacataaaggaatggtgtgatgcagggtactcacagcacgagcgaagtcctggtcccggtgcctggcgtagaggtctctagtgctcacaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgagcaaccagtcctcaacaaaagtcgccaacttggcgggccagtcgccagctgactgctgacccttgcgcgagtacctgcgaattaatgtgtcatattagtgtgaatcgacagatgttgcaaattattgtggacaggtagattttaatgcaacaactgaaagcatagtgaaagatcttaccggtgaacaacagctgggacggtcgtcggaaacggtactggaaagggctgacggaagccgaactgccgcatcacgtggaaaggggcgtgaggctcaacgcagatgtcgaagaccatcggaaccgtagtcatccagtacgcctggtccctggtgcagagtgtggactgacccaacggcgcacgagcctgggtagccgcgacactgtagggctcccacacgacgtcaatcggcagaaggcggtcgaactccataacaaactcaggatacgaccgcctaacctggacgtgagcccatcggtgctgcaatacgagacgttcgatgtgatgtacaatgaacttagcaattaacttaacaatacgagaagatcgatgtgatgtacctgacgacggcaccacagagtaccgatcgtagggtagttgacctctggtcgctccgcgtacagtgactcctcgtacgcgtgctggtccacctcagaccgatcgcaatcctctcagctgtccagataggaagaaagagagggcacccaccaaaggtcgcgctaggatccgtcttcgtgcaagcctcacaaaggccacgatacagagccgccaacaacgcggaaccccagctccactgaggcacctcgcctaccgcggcgtcggcgatgctcctggcctagtgcacgagtcccttgtcgaccgcgtgcccgtgaccgccacagaacatcactcagccaaaaagccagagcaagtacgcctccaaacagcggctgtaggagtactcgtcggcctctgcctgtagctgctcgacctgcaagcgttcgataaaatgttaggcaccttacttgtggactaaatatgtagtacgcttgtcatttcggtacaaaaaacactcacggtgaactgaagcagtcacctcttcgtaggtccggtgttgcggtggtgtgccaacggctcgagcgggagatgcggtgcgcgctgtactagtgcgaaacatgccgtcagatcgtcttgccagtccacacccgcggtcactggcccaacagcgtctcccgcgagcggtagccccaacaagtacgatacgtcctgtagggtaggggctacctcaccgcacggcaagtgaaaagtgtgcgtctctggcctcacgcagcctgtaataacaaattaatatgtcattataaaaattagtacagcgcaactaagttatagtaatacactgttcgtacctctcgacaaaggagtcgtgaaccgtaagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaagtactaatgtaaaacaaaagataacttgtaaaattatgaaatagtaataaaatcatgagaataattatgtacaactagagtacaggctatttaaatttatcaaacgttactaaggtgtagacccccgattttggaaatcggaaatcttctgtgtttatccgtaccaatccctggatcagtagttggtacacacatacatagttggatcacaacatatcacgaatgaatttagactaaaagagttaaatacttacattagggccaggtaggccaacaactatcagagaacaacagcagaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaacaacaatgcatatgatagagggtattcaaggaatggtttcaggttcttttgcataaagctgcgttttgcaaatattttcacaagcctaagacctatcatagactgatcaaattttagttccagtgttcacattaaacaacgacggttctgtccaccatccattgtgatcccaaggatagcttcccgccattgagtcgtcatggttttctgaggacgtccaccttccctcctctcaggaagtggctccatcagcataaaaatcaccatgcaatatcccatccaacacaagttaagaatttagagtctagccaagtgtaatacatgtcccggtgctcattaaccgcgagcacggctattcgaatagatttggtttactcacactgcagtggatgtacactttacccgcactccgcgactgcccaacacatgagcctcgtcccaacacatgagacgcgccacggcaaagccttttgataacctcgcattggcagtacccgctccatgaacttaaatcctcatgcactctaggcgtccatgtttctagcagtgagaggagttctggcgctcccgggaaagagaagtctcacacacatattaaattatggctcaagttaagttctctctctcacacactcatggcagtcctaccaatggcgacaccgatgtagggcacgcctctcggccctacctcaacggctgtcccaccgtagcgcacctgcctcactcaggggtgaaccatctatgcagggatactgcctccgctcggctatctactccgctaggtctatacccatacgagaagtgcggttgtacgagggtcgtttcatgcttaacttcatggctcggtccttaattgaccggggacggtactagccttttccagataccacccaaatcctccgtccgccccagtcgaaaatagttgtttaattttatttctcctttcacaaatcatgtcatcaacatcatggcaatgtggcgctcatgtctctacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaagttgctgacgttgcctcacgactatccgatacacaaagtctataatacgcgagaaaaaccaatattcaagcaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttgtggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacaataaattgtaaaaggttaataattatccatgctttgtatgttagagttgtttaggttaatcatattatggttacagattatcccatcacataattttacaatgaataatcctaatttacagttaaactataattataattatatgaggtcaatatttataactagtatttatctaatatacatgtttgtcatacactccctcttaatttcatatatgcaacacgcaaattaatactataccgtaccactataatgggatgtatagtatatgtgtaagcaacaatatcttattattggatcatatatttgagtagtttctttttactgtaagctatataatacatgttgattttaagatggctctatttggttaactaatggatatcaaccgactatatatatatatatatatatatatattctacttcacatgacatggtatcaactaattttttttaagtggtccaaatacaactagctctgtgattactctcctaaacaagttaaagattcatctatatgtgtttatagtttagttacaaaatatgaggctaaactttatgtaaataatttataagtcatggaattagttatatttggacataggctagtaaatggcactaatattttcctttacacccattaatttgaaggattgattataactaatttatttggttgctacagtgacaagatatattaaagataattatgctactgtacaatatccattttttttatttattggcacactatttaggttaattattatctaatcatttgatattaattaatttataattataaatatattttattgaatagtgaattatatatcattggaaagcttatgaatttatatgaatttaggttcaagtttcactcaaatccgagttaaaatgaataagttatgctagtgtaaagattcaaatttgaattaatccgagaaattacgaaaagctactgttcataaacgatttatttttaatccaagacatatccattgacaagtgggaccccgggtttattcctttttcctaccgaattattttctaaagggaaataggaagagctaatgacaagtggggcccacatgtcataaactcgagaccaaaaaacttctataattagatttttaaccacccggacccacatgtaatagattcaactaataaagattaagaaggggattactattcactaaacacgtggggcccactctaatctctcctctcctttctctctctcttttcttttcttttcctttctctctcttttcttttcttctcctttctctctctctctcttttcttttcctttctctctctctcctttccggtttctctcctccttccctcttctttctctccctcggcttctcccttcctttctctttctcggctccctctctacccggcggcacggcgacaaatagggggggggggcagcggctcaccgacggcagcggtggcgacgacggcggcagtggcgacgacggcggcggcgacgacggcg

SEQ ID NO: 47029 - DNA, 18406 bp, Oryza sativa
  unsure (1)..(18406): unsure at all n locations
acgggacggcgacgcggcgacgggacggcgcggcgcggcacggggctcggcgcgcggcgatggcgacagggcggcgcggggctcgagacgacggcgacacgacggacgcgacgcgcgggcgcaggacggcgtgacagcggcggcgcgaggcagtgacggcgacggcgcgcggcgcggcaacggcaacgcgacgggcaggcggcgcggcgtggggcgcgggcgcggggcggcgtggcagcggtggcgcgcggcgcgaggcagtgacggcgacggcagcgcggggcagggacggcgatggcgacgtcggcgcggtggcaggcgacagagagagggggaaagcggaggggctgggttaggggaccacatcgaacacctggcggccgatgaatagtgtcttttcctatttaatccccattttagcctatttcttgtgtaaatttgattctataaatcctagattttgtataaatgaagtttacccaatatttgtgtcattccaaccaatggatttattctagattaatattactcatattttatttatataatttatttgaatttttaattagggttaattcttattattattatatatttttcaaagttttcctatttttcttcttttagggttttggttgatttataaattgagaaaagttgcaaattaaatttgtatttactcctaagcatttaggtgaccgtattaagtgttcaaatgtgaatttgcccaaaatttaatattgtccaatatttaaggtttattaaagattctataattttctaatgagaccgttattaacacaatagcacattagctcaatttatttatatgttagtttattttatatggaggggtttaatatatcaaatttcaatccctaaatgcaattaggaacttggtgcaaaatcgatctacatatcgaattaaatactcccgtaattctattatatatacatagagctcagtttatttgaatgatcatcatttcatgtgtacacatattatggcacccacctacattattcaaatattttaatatttgataaaataggttaataataacttttcttttatttgattttaatatcttgtgcataattatttgtaggattaaatatattcccgtaaatcatatctattgcttaaatgtagttcttttctttactttcttggtgatcatttacggtttggcaagcaatagcaatcataacaaccagcatgatgcaaaagttttaaaaagttcaaaattttcgtgattttcattgtcttgaattttcaggatgttacataagggtacataacgatgacgtgcaatttaacatatatgtagagttcgataatataacataacataacataacataacattacgtgtcgaagtccgacattacatcagcatacctaaagacattaggtgccttagtctgacgttacatcacgagacctaaagacatgacatgccgaagtctgacattacacgacaaaacataaacacatcgataagtttgaaacaaattacaagcaaatccacatgccaacatagaacataagaactacaccacgtagctagacgtggcacgacgacgcctaggacgtggtcgagtggaggtagtgccttcacccgtagggcgagctccatctgctgctgatcctgatagtcctgcctccgccgcacttggtttctccttgtctttaggacagtgcttgtaggtgtgcccacgttcatcgcatttgctgcaacgcttcaccctgccagcctccgactcgtccatatcgttgtggatgcgacgagtcttcctccttccagccttgcctcggagcttcgatgggtcaggaatattgagtacttcatcgttagtctctgtgaactccccagctatgccgaacccataaatctcgccgctccatgtatgatatattgcttgcttattaaagtactgtgacacatatactgcatctggtatgccacactccgttgcggcagcaatgacatgggtgcatggcctgtggagcagcttcggctttgcataagagcaatgacatgtgtcgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagttccaaacaaaatgctgttgttcggtatagagggaagaactgcttggaaccgatccctaaaataactgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcataatctactgagaaaatttccgaatctccaatccagttcttctaaccaatgttggactattcgttgggagaggtccaagagcttgaggagggttagcaacggcggtcgatggagccgctgcacgctgatcactgcatttggctgtcaactcatctaatctcttccaaagctcattgatttttttctcctagttctgattacatagcctcttgaacatgttcatgagctccttgttcttgaattgcttgaagaaagaaattagctcccatatgatgcattcaccacctactctgtacatcttcccaaacaccagggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcactgcgtaagagctcctagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacagtatccaataatccttccatttccccttatacgcgtgcactctccagggacaaccatctttttccttaacacaccgaacttcatattgcgaccggttggacttggcaacccaaaactctctatgaagtgacactacaaaatgttttaccgcctccttcatatcttctgctctactataaatcgctccctggataacctcattttctttgtactcccatctcacactatcctcttcagagacgaccagcccagaaaaatcctcactagcccattctgctggattaatatccgtctcatcatctgacgaatcaccttcctctacacgctcgttgtcagaatcctccctctccatttcatccacaatggcaccgacagtttccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccatagctagaggccacccgcgttgcaatgcattttccacataccatctccacaattgagagttttgaaccggcattagttcccaataaaaaccctcagttgcccgacttactataacattgattgttatgtcacttgtctatggatcaactctcaagcccctcattaaccatccttttatagaaggtacactcctctcagccggtctatcaattcccctttctgatacaataaaatctgacagatctaccccagttggcccgtaacggacgtttcctgggccatggtaaacttggaatatttgtttgttcgacatatctgtcaacgaaataactagatcatattactctttcatgcaataaacatctacaacgtaatatcttcttgtgtatgccaatgcaacggtaaagtattgattccaaactagcagatctacgtagttaccgatatctacaatacgcacttctagattagtacagataaaaccctaaaaatataatgcatttattcaaacaaagttttaaaaaatacacaatatttaactctatagtcacatataggatatatgaatattacctgaaatcggcgtctgaatccggcagggcttcgccccttcttctcttctcctcccctttcttctttttttttcactggatttgaggggggaggaatgagggctgagggctggccagcatgccttttataggcagcgaggcctgccgcccggccaaagggcggcaaggggccgcctgcaaaatgaccggccccgactggtttttttgcattcaggccccttgccacctcaacagagggtggcaagggctttcctgcaaaaaaaccctccctccgtcaccgcccgttccttccccgtttgccacgtcagcttgccgcctcagagatgggcggcagggtctagttttacaatttttttggccgatagattatttctgtaaatattttaaaaaaatctaaaaatgaaaaaaaaaatcccattgcacataggtttcggtcccgaagaagcaactcctcggccgtaaccaacgtgcggcccagggcccacatgtcactaccgcagctgccaatctgcggaaaaaaaatctggtgcagacggggtgcaaacagcaggaattttttttatttataattttttttattaaaagttttacaaaaataattttccattttgaaaattgacggaagtaggctcctctcagcttggaggagctccagaggcgcacactcagagcagccagaggtcacacctgtacaggcaggacgggttagccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacaacacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgacctaaaaaataataaaattgtattttaccagtcttggagattttaatcttgtatagttttcaatataaaaagatttgataactattgatatttatacaaaaatatagagcacagtataaaatcgccctacccgagggcggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacggccggctgccgcgtcattttcgccgccctctgggagggcggcggtaggcgactacttccgtcaattttcaaaatggaaaattatttttgtaaaacttttaataaaaaaaattataaataaaaaaaattccaaacagcagcccgtgcagtcccgactcccgacgcggattcatgacgcgtggatgaggcgctcatccgatggccggcccacacaagcaagtaatcgacctgcacggctcagaaagtcaaaatctcctttgataccaaaataactcaatttagagcaagtttaatagtatagtccagcactagctctaattcatttatagttaatctagtagttaattcatacaatagttacttactatactattaatatatggtcccacctgtcatatacacattgcgtcttggagtccgcgctacagctggctacagatctgtagcccgctgctcttctctcatcttttatcttattaaaatatatttacagctggctaatagcctgctattgtacctgctctaagagcaagtttaatagtatcgcccgttgatgggctgaaaatttgtacacgtaagtaatagatggtaccaatagatgatacgtataataactagctgctaagttacctacccacacatccctaagcagttgatttttattattttaatcagacttgtttccttcttcccaatctttgagagcaggtacaatagtgggctaatagcctgcttatctaatattttaacatatatgatagagagagagaaagcaaagagagcaaagcggacgacaatccagtcgctggctcaagcacaagcgcctaggcactctggccccttgcagctcgggacaaccaatagaaaattagaacttgaacatgcagaagttaccaacacctgacaggatgccttggttaaagcatgggtgtagccaattgatgtatctactggggtttagttatctcttaaatgatgtggtgaattttagagccggcagttaactctactattgaacttgctatgatggagtaatggttgagtcattgggcaaaagctaggactaggactgagggctggttctcaggactttgcatcgtttcctgtgctggagctcgacgattgcattggcgcccgctgccttctctctccggttttctctctcttccacctatgatttctataatatggatgcttgtatcgctggcttatcatactctattatacctgctctaaggaggggtttcctcctaaaataatgaatctggataaaagttttttttttttttgagggaggtagtagatggagggaggagatgagtagtcccggctgcctcgcactcggctgggctcgacaatacgcatcgcgttcgggaatctttcctcgttttctcccctttaactagcacgatttgcatacggagtactccctatacactcatgactggatcatcagagccaaacttctcacacacacgctgacgcctgagtgctgaccggtgcgcgccggccgaaaatggacgacgcccattcctcgcagtcgccgctgcacgtcgtcatcttcccgtggctcgccttcggccacctgctcccctgccttgacctcgccgagcgcctcgccgcgcgcggccaccgcgtgtccttcgtctccaccccgcgcaacctcgcccgcctcccgccggttcgccccgagctggcagagctcgtcgacctcgtggcgctcccactgccgcgcgtcgacgggctccccgacggcgccgaggccaccagcgacgtcccgttcgacaagttcgagcttcacaggaaggcgttcgacgggctcgccgcgccgttctccgcgttcctcgacaccgcgtgcgccggcggcaagaggccggattgggttctcgccgatctcatgcatcactgggtcgctctggcatctcaggagcgcggggtgccgtgcgccatgatcctcccctgctccgcagccgtcgtggcctcgtctgctccgccaaccgagtcgagcgcggaccagcgcgaggcgatagtccggtccatgggcacggcggcgccgagcttcgaggcgaagcgcgccacggaggagttcgcgacggaaggcgcctcgggggtgtccatcatgacccgctacagcctgacgctgcagaggtccaagctcgtcgcaatgcggagctgccccgagctggagcccggcgcgttcacgatcctgacgaggttctacggcaagccggtcgtcccgttcggcctgctcccgccacggccggacggcgcccgcggcgtcagcaagaacggcaagcacgacgcaatcatgcagtggctcgacgctcagccggccaagtcggtcgtctacgtcgcgctgggaagcgaggcgccgatgagcgcggacctgctgcgcgagctggctcacgggctggacctcgccgggacgcgcttcctctgggccatgaggaagcccgccggcgtcgacgcggacagcgtcctaccagcggggttcctgggccgcaccggcgagcgcgggctggtcacgacgcggtgggctcctcaggtgagcatactggcgcacgccgccgtgtgcgcgttcctgacgcactgcgggtggggctccgtcgtcgaggggctccagttcgggcacccgctgatcatgctgccgatcttaggcgaccaaggcccgaacgcgcggattctcgaggggaggaagctcggagtggcggtgccgaggaacgacgaggacgggtcgttcgaccgaggcggcgtcgccggagccgtccgcgccgtcgtggtggaggaagaggggaagacgttcttcgccaatgcccggaagctgcaggagatcgtggcggacagggagcgcgaagagaggtgcatcgatgaatttgtccagcatttgacgtcttggaatgagctgaagaacaattcagacggccaatatccgtagtagggtatatactgtactcggtgaaagctagccaacttggctacacatgttttgaggttttggttatgtgcttgtttggttcagatcgaaaaatactcctactatccagaaaacacaaaactgtgtgcttctacacagtgcaagtgtcgatttttctcgctgattcgacgacccgagtgtagcggggccggcattgcttgtctcttccccattcgggcggctaccggggtgaacttgtaaatgacgcggggaccggctgctcgtgggagttaattcggtggggatccaccgggactgcgagtcctatgcggcgaaggaggcaggcagccagccagccagccatagttttcaatcggttcccttcgtcggccgtcttgttcccgttggtgggcgttgtttagattttgggcctaattcttttgtgaaagctagcacaggcccaactggcggcctagcgcaccttcacgttaagtgaagtacaaacagaactactccctccggcttgattatacttgtccttttttacaagagcacggtatccaaaaaaaatagctttgataattattttctatttagtatatataggaatatcaacaaatatatgattttattgaagtactttttaaaactaatctacacatatggtttccatatttttaacataaatattttagaaattatttatagttaaagattttaaaatttgactttatccttattcaaaacgactaatattatcagttcgaaaggagtagttctaaatgtatccatgtctgactgtgttctaaatgtatttgcatattatttgtactaattagttttggtatttcttttatatcttaataacaaatattactataattagatgctttagagaaggtacttaactcaacagatcaaaatggtgtacagttaattatactcgggcaggcactcgccaccgaggccattggcgcctttgctgtccaaacggtaaaggccacatgctcattagtctgattcagttgatttcaggataatcttgattctggagagcagggcatctcatcttcggtcgcactttgcgcgactgaagatgtctgtttaagaagcatgtatacgtggaccattacatatcaaacatggttttaacaaagagcattagttgagcttgcaagtgaaaaaggcaagatgaaatcagtcaactattacactcaaaatcaaagaaactcttattaaacctgatcgttggtttaagataattggcggcagtgttgtagttgtcttgctgtcagtgaatccactcatttctcttcttcaaactgatcatccacaagaagaacatgacatatttgcttagttagctgcaataagtatgtagctcacctgaacctccataaggaccatgtaacgctgcagagggacctggaactgccgtacgttttgcagcagcctcttctcctgtaggaggagacatacttcagtgatatataccagcaaggcagcaatattatcagatcaaatatgcgctaaggaggtggagaaaggagaatacctgaagttcctgaggcaggactacgagaggcagtaaaacccaagggtagtgcgtcccgctctttcttcatgaatgagagcccctttttgtgttgtagatctttcagaaaagagtgcttgctaaaaaaacaccaagtagcaattgacacttttctttttgaattttcaagaatttgtagaaagattaatcagtacaacattagagattgcatgtatatgtagtgctaaagtattcagccaacccgtcatcaattcaaagctctttgacaaagttccatgtcctatttggaacatataatcgaccttctattgaaagttatactaataatattgttcagacttaacaatggctttgaaattaagtggttcctttatctcgtttatgttcttttgcactattcagacaaacaaaaattcgtgaattccacaatcagcatatttttgcggaagagctgtgcctctgtttccaacaactgtgactgtactgaagttttttatataggaatctcctccacccatggtaggatcaaataagaggctaattatagaatctacatatttgtcacacgcacaaaagaatggtttcctccatcttgagttgagcagcctgcttcctcctgtgtgactcagctaacaattgaaattgaactaacaccattttgacatgaggccagcatgagtttagcacttctagatatatattttttttcaactcaataagtgagaagcactgtcccttgctgaattaaattgacgaattattgtgaggatgcgtatgttctttcttgcaccttaaaacatctttcgcttagacaaatgtttttatttctaattattatcaaagctgaatgatatgttcttagtgcttccattatagtatgatatagaaatgctaatttcagctcttgccctttattactcatcattatagcttatataataaggtctgaatttgtcaaactgaagcgcgaagtagatagttttccaatatatatcgtgaattaatggtcataaatattgtggtaataacagaaaaccagataggttgatatgaatcattcattgaaaatctgaatatgagtttacaaaggcaaaaatttaatcagcaattggctggtgccccttatcgacgttttcaggttcactaaaaagaaagtaaattcaatagaacaactttgctgacagtaaggagctatgcaaatcaaactatgctgtaccttatcatggctaatttggacgacttgatactgtgaatatgtgttgtcagtgctgcacatgagtaaagacttgtcaagaatgatgatatggtattaacaattcaatgccaatccagcaagcatacgaaacaattagtctgaatatcaaatatgtgttcccatacaacaattggaagggttcgattcagtcatctccttggaaacaaagatatctcttcttttttttttgttcctgtatctgaagtaggaaaaatcagcaaaccagcaaaataatctatttgtagaaactatagagaaaaagaattgacagagatgataatacacttaatgattcacttagattgcagcccgccgctcccaacatcctacccatggtaggactgatatggcgggagcaagtacgtgagtgtttcggaggcagagccaccgggagcgtcctagagaccttgggaggagatgccttagtgaaggggatggagaagatatgtggggagaaaaaaaggggcgagcttccaaatcgtagagacaagacttttaaaatggacagtaggatcaacatacaagtagatacaactatacaaattagcaaaaagaaatgattaaactgtaaacatacatggtattatggacaaatttttaggaaattagcatccgcatccgtagccttcggctgaagtcgtccgttgcctccttgtctttggcctcctctgtcaatatactcaccggcgggctgcggttgccaagcgcaactctgcagcgagccagcgatctacgttaaccggagagtctccagggccttcccgccgccgccgcgccgcctctcccagagcgtcggcgcttcgtcgtccgccgcgggccgcctgatcaccaccggcaacggcgggtcaagcgtgcacaccgccgccgcgccgccgcggccgcaataaatcttcccccgcgactgcgccgacgagcaggtcggcacgtccctgaccttggagcacgcccgcgacgacgtcctccccctccgccgccgcccgaacagccccagcgtgagccgctccagtagacccgagctaccggccctcgcggccggacggtcgccgcggcgcgcgcccgagcatctcctcggcctccccttgacctgccccatgcaggtgatcctcggtgacgccgggagggcgccgtcgccgccgtccgccttgcccttcttggcgtcctgcgccttctgccacacggacggcgacagcaggagcggcgagtacgccgccgcggccagcttcttggccccgtccctcggcggcggggtagccttcacgatgagccaagtcggcgccggcgccttgatctggtggctgtggtggtggtggtggtggtgaagcgccgccatggagatcgatcgatccaccaacgtgcaccggtgcgagcgtgcaacactactccttctatgcgtatggggctaagaatttatgagcttgttaatatgcaacagcgctaggggttagtggattcagtctactaatccgtactctaaactgaccgaggaaaagaaaaggattaatgagtggcaattaggcgggttcccaggtcaagtccttgtagcttacggagaaactcgcgctcgcgacttgaacacgacgagagagcggggggacgtgagtgggccgtggcggtacccggtcgttagcttatgtggaacggttgggccctttctgagtcggagtcggagtcggacggtaaaatattcggaggccagtgcttccgacgtcactgctgcttacttttgttgcactccttgagtgatttttcttgattttttttattataaaaaggagtgatttctttagttttgcaagtctgctgcactctcgctctggttcgaattccggtagttggaaaacttgtgtgtaattgtgtatggagtctaatcctcggtcatgtaacccgttcgttagatctaattggatagatgtgcattgttagatttaatgatcgaaaacaatttggtaccgtaacgtatcggtacctcgaaatactttttgttggatgatttatgtgttattaattgaatggacggtcaataatctttcttgatttgcttgcttaattcaattgttcacggggaggcaactcactctcttctctccggcgtttctgctcatattttgtcgacgaatcacaacttagagacaataccatgttcagtgctatgactatgacattaaggaaaagatgaaacctgcgacctcccagctcccaagagaaccttaggctcttaatttgctttatttttttgggcctatttgaaatatattaatataataattcatatggttctttctttggcctcctctaaatacgagaattcattatgataaaaatcctataaaattatcatgaaatttctgtgttccaacttcctagtgagggcggaaaagggctctagcgtaatagattctcttttggatgttctaccggttcaaacaccccctcattcgatgctcgatggtccgttctccgttgggtacgttgtataaagtagacattttgactacaagattaattaatgtttgacaacgaccacactacttagtctatgtagattagctagctaacggcgaagaagtgatatattattatggccttaagcatagatatatagaatatcttcagtcatactagtagtaaggacaaagactaaccaaatccagagtgtgtggctgtagcctgcagactgtgttagagtttgtgttgaatatgtgtacatagtcgattacagtttaggacttggagttgtaataggtattaggactagagtatgagtcggactctatcctaggttctctcataaatagagggccgtgcctgttgtaaccgcatggtgacttagcatagcgagagggagcggctgccggcggcgaccggccgtgagtcgttgtaactctgatacgttgtatatgctggatcggggaggagtgcccgtaatcagtgccccggagatgtaggctacggctgaactccgttaccaaatatcgtgcctcggtgtcgctatcgttttggatctcctatggcgttttcttccacgtttagctaccgatgtcgattttggggctagttttataacagactacagtacagaatggacctgaaaattacaaggggaaatggggtgagttgctctgccgactggtctattgttagagggcggaggttgaaactccacctccccactcataaaatgaagtgtttattattgataaattaaacactagttaaataaaataaaataaaatattaacatgatttttaaaataactttcaaaaaaacttaaaaaaaacactccgtttagcagtttagaaaaatgtgtaaacggaaaatgaggaagtaaaggttggggagaggtggtaaccgaactcggccagatgatagtgttgggagtcttcccatttcccaaccattattccattgtttttcgcgtgcatatctttccgaactactaaataacgtgttttttagaaaaaatatacatgaaagttggtataaaaattatattaatatatattttaagtttttcagataacacctaactaatcatatgttatgttaataagtaacctgttttacatagtggcgtagccagctaggtggcatcgtggtccatggaccacctaaaaatttaaaattatagtatatgtgctagttaatataataaaaattgtatagttgaccactattttaattaacatattacatataaatggaccacatttactttaaattctagctacgctactggttttacatgcacgttgagaggttcccaacctctcaccccgaaacagagagtatctagtccagtcagtgtgacacatactctattgttgacggacagtggaaaaaaaaatcatgttcttccatctcctgatggcgttgtcatgtgtggattttccacgtggaagatgatgtgctctgaaaacttttgatctggactatcaactgtggagttggcacgtctttgcgtcttgtgtttattggcaaaatgggttgtcgtgtcttaagggataagttataacaatatagcaaactgcttatactttggtaaaattttatcgattttgtcacaaacttttaaggtaaaatacttttcgcagactaaagatgtataagccataagattacaaattatagacttaaaatcgatttacagaaaatctacttattttagaaattttatgtattagttttatgttcccataaaaatatgataaaattggttgaatatgggcacttaaatattaattgctcaatccattatttggtactccctccatccacaaaagttagacctatttcatatttgactttttccaaataagttattcctatttgtagtctctatgcattcaagacttagatgaagagataaattaaatgttttattagaatccaaggagtcatctaaatactcattgattacatgcttgcattcactctttgattttataacatcaaaggtaatttaatttctccttggtctttgtgacaatagtaatatgtgtaacttttgtgcatggagggagtattatatagtttcgtcatgatagtcttatacacgcatatttaaattagagtagatttcaccttcgaccttctttagttaaaagaaaccttggattccctttattccattttttttacaatggatctaattttcttaccttttagtttcaaattggatacatttcttctcttgtttccaccgccatgccaaaatcatcatcgtctactagatgaaaacaatgttgagaaaaaaaaatcaaagtgaaaaaaaggagggcctaaattgaaaatatgagttaaacggttcatattttgagacttatggtaacaaaatacatagagttcaacgtgaaattcactctaacctatgaaattttactccatccagtgttatcatcgcacgctgcaaaaggtagggagcaaaacaaaacaaaacaaaaataattccaaacccgtacgcaattttttaggcctgcaaaccacgacaattatccccctaaatcctaaccaccgcatagtcaagcagaaaacaataaattagaaacgcgtggatcagtgacagacatgtgggcccgaaacagcactgcgctaattaatcccactttttgcagaaaagaccctgccaggtctcccaccatctcatttcagtcctccccctgaccccctccccctctcgatcccttccttccttcctcccccaatcttccaatccgagagaggcgccgcacgcgtcccagatctatggttcgcgcgcccactccactcctcccccaccgccgcgccgactcgccgccgcaccggccctccgccgcggccgccgaagccgcctggccccgggagtgaaccgaaccccaggaggaacgcgaggtgaaccgggcgccggaggcgggggcgatgatgatcagcaggcagctcgtgctgacctacctctacctgctaatctacgtctgcctctcgtcgggagtcatcctgttcaacaaggtagggcttctcctccttcgaaatgccggttgcgattcgctctacctgcgtgtatgcttttgcttttttgcgtttgctctgggctagagaagaaatcgaggaatgcgatgatctgaggtccattttgttcgcagtgtcttttgtgtagtgtttgctccttgaacgacttcacttctaatgtggtttggagaactgcaatatgagtgagtgctactttaattgctatatccgttagtttggtggacggtctattacaatgctttgctttctgtaggattttagggttgttaggtgaatcagggttcttggtacagcacactgtcatctgtagtataatgtgggctcaaagcgtaacggatttgacgaatgtcggtgatggatgctgataatgcagatctggggctttgcatattattttttttgcggtgctatatgcttgcttggatgtaagtagatgtttaattatgagaggccacgctgactatgaacttaatgctctcatttttcctatttttgcagtgggtactttctccaaagtacttcaaatttccctttcctattacccttacaatgattcacatggcgttttctggagtcgtaacgttcttccttgtccgtgtgtttaaggtatgcttctttgtgccaattttcctattacctccttccatgttcgatgcacactggattacttgcttgttgtaactttcaaccaaatggcatacaaagtgttgattgtcgaatagaaactgttcttatgcaagaataggcaaggtagtttctgtattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47030 - DNA, 848 bp, Oryza sativa
cattcagtatgttgcccttctatcactaagaaaacagaagttccaatcaaatcagatggatccacttaccaacataggtgtcaaatagacggaaagttcatcaaagaatggaaggaaataagtcttgaacgtcttaacaagagtgcccaaacaatcaccaatctgtgaaaatcacaaaagataaatctgtataagttatttccaataaagcttggaaagtagaagtcacagctgtgtctacagtttaagttggaagtacaataatcatgcttgctccttttggtgtctaaggtactaccgcgttcaactttacaaggcaagatttaacttagcatggtcttctagattggactttgaccataaatttcatttgaatatgttcttactaactagaaaatcacgatcgtgtgaaagcaaaatacatttgagtagctgcatcaatttggatcactaaacctaattgttgatcataacttgcaaagtttgaaagtagaaataactgctcgccttataaatttgaatggaatagttaattagcatgtgtaaatctttcaatttcagtagtgcacagaactgcatacacttgtcaattcttgtatcaggaaaaaaattataaacaggtacatctaaatatactatttttttccagaaatattagcagtctagttttcaatagcttacttgatcgaagatttcatcctcctgttcattttcttctctgagtagatcctcttcttctgaatcaaaatcttcagcttttgccctgtctgttcgttctctccttctgagagcactcgcagttattacttctttaattccatctactatagatctgacctggccttcct

SEQ ID NO: 47031 - DNA, 8274 bp, Oryza sativa
  unsure (1)..(8274): unsure at all n locations
acaacatttctcctcgttacgttcatggggaatcggggcataaagaggggcaatcttgaatcctatggcgaaggccatcatccgcaactcccggacaaaactctcaacactgaacaagtactctggcctgtggagtggcatctaaagacatgtgaaaggagagagttaaggcatttatccaattaacagcacaagttttggattaatttgaataaagcaagaaaaccagagtgaaaaaataaatagataaaataaactacttaagagttaagctgcaacagtcgaaaaccagattttttttaatacgttgaataacaaattttaagacaaaataaaagagagtcataaaaatgctaagttcattatactgtgacatcattatacaagaaatattgtaaaatttttctagtaattgagtcattagtatagtaatcgatgtacagtactaacaacataggaataataaataaattttgaacaaggagcaaattaaagaaactataaattgcatgtgccattaatctggtttaattagagaagaaagaggagaaaagttctaatttttaaatatttttagagggcttctaacggtaaccatttggcataacctaggatcaaggaggctctgataccaacttgtcacgcccggaatttctatccaaaactccaaactcttacatgtgtgtaaaccctcgtccagcaatcagccgaggcacacaataacaaattgataatagagtgcaaatatttatctaattaataggcgaatataaagtcattacagaggtagatagtccctctcaatcattaaagatctaagcagcggaaaaataaaataaatagcgtagacgacgacatcccacaagcagcttgaccagggctacacctaatcctccacaccttcagcatcactgtagaactcgtcgtctgattgcaaggtgagtatatgacatactcaaccagcagcgcagcaaatatgcaagtgcaagggataacaaaggatggcataatatagtctcatttgcataaacggtatttaacaaacatttcaaaatttagaaagcagtaaagtatttaattcagcagtattaattcaagctatacaacatacccgttgcataggctctcccatcctgaacaaccacacccggctgtacagatctatccccaaaccaggaatataccattccaaaccaggagctaagcaaattattaccagttataacatcaataattattgtgagaggtgtgagactaatcacgaaaaacattgttagaccccccataaccgcgagcacagctattcgaatagttttactctggcccgatgtaccactgtacccacaagacacagtcccacaaaatgtcaccatgcgcctgaataccaccacggtaccacagaaaggagctatggcagtacccctcgcataagtgcataacacaattcacagcagtggaccgttcctgtgtcataatcacccccttagaaaacaaggcatggactccctagcgactcccccaacaacccccgtgggtttatctctgccacttcttagtctggtgccccacaatgaaccatgctatacaaaaggtaaagccattgcccacgctggcttgtggttgtcacggttaatgtttcacaaccgaagctcgcgaccggtccttaattgtcatgagcacgaccaacaaaaccatgtgctcacaacccaccattaatcaagttttagttgacatattaattaattaaccatcacgattaaccatcgtgagctacaattaaatatctatcattacttaatagtgaaacattaattatcccaatcatgtgctaatatttctaagcatggctaagcatcctaataaatttagctaaaaccatagaatgttctagcacaaattttgacaatttgaccctttgaaaaaactaattttacaaatgatatgccgccaaaacttattttaaaaatgacccttttttcagcgctaaatcatgtggcgctgaacttaaacacctcggcgccacgtcaactggcgttgaatgccgtgccaccacggatggaggctaagtcagcgtgccaacgtacattcagcgccatgctatttgactctgaggtgtctaaattcagcgccacacaatttggcgctgaacaaaagggtcggttttgaaataaattttggcagtggttcatttataaaaaatagtttttgcaaagggtcaaattgtcaaaatttgtgatgttctagctaatccaattattaaccatgtgacaaagtacagataatcaataacaaggggctataacaaaggcaataggtcattcccacccggtgacattaaaaaataaatgcaatagttgaatagaaacaatagctttaaacaggatcaacgtgttcaaagggtgtttgggatttgtgtggcttgccttgctggccttcaaactcttcaaaatattctcctgaaaagacaaactctccggaaacgttggaatctaaacataaaagaacaaaatcaaccaaaacagtacaaaaacaatcataaacagtacatgtgaatatttttaacatgtagatctcaattttttaagaaaaaatagagacttgaaccaactaaatccgagctacggtgaattagttatgaatttttgaagtttaaaccgaattaaattatttatagagattttaattgaattatgacgcaataaagaattattttgaaaagaaaagagttaggacatgttaaccgaggagcgcgtctgtggactccgggtacatgtagaagtcagtggcggagaacggagaaaaaaagtatggcccatacttatgtgcagagtcaatacacaataagaacaacgaaaaaaaaactccattatctcaatgtcagatattatacggcactaattaaacctaataaatcgatattcacatttttaacatgtagatctcaattttaggaaaaaaatagagacttgaaccaactaaatccgagctacggtgaattagttatgaatttttgaaatttaaaccgaattaaattatttatagagattttaattgaattatgacgcaataaagaattattttgaaaagaaaaggagttaggacatgttaaccaaggagcgcgtctgtggactccggttacatgtagaagtcggtggcagaggacggagaataaaaatgtattgcccatacttacgtgcaaagtcgatacacaataagaacaacgaaaaaaaaactccattatctcaatatcagatattatacggcacttattagacctaataaatcgatattcacgaccgcgcaacaagccaacagtcacaaccatagaatatctataaaacatgtgtacataagagagtaaacactgaaaaatacctcaaccaattaagttttagcggtacatcacaaatacatcctgataataagtagagaatagatcttattaacatgtatataatctaccaaacaaagagcaaagatagatttttaataaggatgaaataaggaagaacaagtgcaatgggatgtgaaagcatactacacttgactgcattaattgccgcggctgcttgttggcttgctgccgcagcgtcgctgaagttgaacagcccagttgccctgcgcggctgcactccaagagtctgtcgcggcgttgttaaggacctgcctgccttgctcgacagcgaattctcgcgctcgcgtatctcagcagcggccagcaaggcagcaactgtgccgttcatgcgccaaccctcgccctaccgagcgctagctccgccattgtgtagaacgataagttgatctaggacaccaaggatcaaacgcacacaaaatgttttggctaaaagtcgcggtgtatcataggcaggagcagcacaaaatgctttcgaccaactgaaacattaggacaaactcattatagcctgttattttcgtttttcttcctagtttggttgctttattcattacttgggtaacaatgccacatcatatctgatttcagagaatcacaagtcatttttctaccactgcacattggctaacaatatatttaagagtgaactgcggttttaccgcatttcattaccaaagttaagaccactatgtaacatttttattttaactggttaaatttatctttatatcactttagaccaccgtaattcttttctccatccacattcaacttatcctatgtcaaatgtttgggtttacgaacagcttcgaacatgggagtatctacatggtggtccggaaaatttccagcctaaaacccttatagaaaaatatatttaaaaagaaaaaaaactcatgtcatgtgaagcgtaaagtagaaacgtggtcgtctcggtcctatatcatgtttttttttcttcctcgccacatcgtgttgtcatagcagtagtcatcatgccagatgacaactacaagtctaagacagaggtagcaaattggcacgacaaggacactctgtcatagcaatagttaccacaccacacaacaactaggagtccgatatggagccagcaaactagcacgacaagggcgcatcactctattatagcagcagtcatcacgccagacggcaactaggagttcgagatggagacatcaaactgacatggtaaggatgggagattatcaagccgacatgtcagtaaaccaggaagggcaaacaccgtggcatggcgtccgtgcctctgtggcagccaactgacagcaaggtggtaaggatggcgcacggtggtatgttggaccacccaaatctgaaattctagatacgccactgactccgatgttcattaacgtgcaagagttgatttagttgatattatttatgtacttgaaaagagggtcagggtgatctaaatcacaacaaagataacataaaaattattaagttgggaggtaaaagtaaaacttagacagtaaaaactaacccaatatacaatatataatcttgttatttgccatcccctttacatttatgacatcttttgtccaccgttcaattatgtcagctaaactgtccaaagaccacaccaaatgttttaaatatcatgttttcaacttttctgttgatgaataataatcctaggaaaaacaaattcacttttcggtagtctttgttcagaggttacgtttggatgggtagttgaaatgggattcggatatgaggtgggatatcatggattggttatgaatagtgatttcaattgataggctattgtttacgagtatttgggtggcaaatactaccttcctctatcgaaagaagatttattttataatatccagattcgtatttaaaaataatttctttggaattgagggagtacaaagctagtaatcggtttaccatattttgctatttcgtctccttccctgttgacccaaaactgggagaaagccttactacaccccaaaagctaactcaagaggagtggggctccctcacttttaagttagttcaactccctctagataagtaatgtgggactattcctaacaatctcccccgtcacacattggtgccccttagccctgaccagccccacacacgggcacatacgggcctcacacccacgggtccactaaccggccccacacacaggcactagagattgtgggtttggctcttataccacttgttggcccaaaaccgggagacgttggcccaaccgggagaaagccttgttacaccccaaaagctagctcaagaggtgaggggctccctcacttttaagttagttcaactccccctagataagcaatgtgggactattcccaataatcccccaccccacaattcctacaggtgaaaatggatagtggtcctacagcatatttgtttaagcgtattcagaacggatacagatggtgttgatacatagcagattgtttcagatatcagaaattgtgtggaataggtgcaaactcggttcaaaaaacggattaaaattatcgaatgttacttgtatatgcaatcaatgcaacatcaagttagcaatggaaagaatgacaatagaataatcaataaacgatcaatcatagtatatgcttaagtgctagcaacatgaatatataattgtggcgggcagctaagcagcaaggccggtcctgggttttcgaggccctagggcgaaaacttatatagaggcccctatatatatatacacataaactaatatatatatatatatatttatagtcttataaaaacacaacatttaatattcgatgtgataaatttatctatatataacattttaaaacttcaaatagaaatattttgatgagcaatggagagattaggataacaatccacatctctaacatgcttgaacatctcaaatgctttttctgtttccttttttcgctactggatgcatattttctcgacgacatgattaatgttgtgttgaaaaaataatcatcaattattaagtagtacgagagctaataattttttatctatgaaaagaaaagatggagaaaattacctcgagcagcactgcagcaggctgcagcctacaggcgtggcgccgagccgtcgatcgaccggtgaggacagagggtgcgccgccaccacgcggttggcctgatggcctcgtctccttgcaacgcaagaagccgagaggcgagagctcaccccagcaggcagcaggcagcagcgaccgagcgacgtagcgtctgtagcgacgagcgatcggccagcgccgtgatcgaggcaagtaggcgacggaaacgggagtcaaatcgcttcgcttttccttcgctcctcttcgtttcgtcttccgtcttcgataggaaaggatcccaggcctgggaagtagcgatgcatatggggcaccgtgggccatggcccattagccatgggggccctggattttaggggcctcgggcctgcgcacgggctgaacccccccccccccngnnanaggaggccaggcctgctaagaaagtcagcaggcacgcaagatgaaacggttagagccttggacaaagaagtctaggttaactgatgaattgggttattggatgggccagctcatgctctatggaacagatagattggttgagcaggcctgataattttggattacccacaaaacaaccgatcggataatccaataaaaatatcagataatccacatccgtcagattttagggattgtacgattcctgtttggcatagctctacgggtctaagattttttttttagttggatatttcaaacttcacaattatgtggatctagatctatgtttacgttgataatatttagataaatcattttgttcctattttaaatgaattataaaattttaagtgattataatataagaaaacatataaagtttatatggatgatttagagttgtgagtcgtcacaccatgaagttcttctcccaagcctaaattaattaataaatggcctcaagaaattatctgtgtaatggcaagagagaaaccctaatttaataaatgcaaataataatcggaaatggcatgtggaatttttcttgggttttatatgtcaaaatatgccaacagaaatttagtggaattttcagagctctagaaataattttaactaaataaaaatgagcacaagcaattattaaatccctggaaatccctttttcttttctttttcttttcccccctttttccttcaaatgggccgtcggaccattctcccctcccctccccgcccgctagctaggccggcccgaggccgaggcccagcaagcggccgcgccgtgcccctcatccctccgggacaccgacaggtggggcccacctatcgggcccgtcccctacctccggccggcgccgtccgcgcccgcaaccgccaccgctcgcctctcgcgcgtctctcgggccacgtcgcccactccccgcactcgccccgcacgtcccgcaaccgtcgccccctctaccgcccgcgtgcccgcaccgagatggccgggattcaatttttgaatcccgcctctctctctctctctcctccccacctccccacgtcactagccgattcgtgcccctcccagccacgtctcaccccctcgcgcctatataaagcacccccgtcccctcctccacctttttctcattctcgccgagctctcccgtgcaatccaccgtcctagcgccgcgcaccacccgccgccatcgatttagccaccttggccgctgctcagctatgccagagcccgcgccgagccttcctgttgccgccatcggattcgcaagcccggggtccacac

SEQ ID NO: 47032 - DNA, 6776 bp, Oryza sativa
ctctcgccctctctaatttgccccttttcgttcccaaggtctccccagagctcgtctcgctgtcgccgtcgctttccgccgctcgcagtcaacgatcgtcgtcggtgaggcccctcccccttttcccctctctctcccacccacctagcgctgctgcttagccgcctagccgcgccgccgccgctcgccgctggttgccgccacgcgccgccgccgcgcaccagggccaccgggccggcttaagctgcccacgcgtgtacggccgcgcgccgcctccgccgtccgatctactaccctcgggtagatcggggccgtctgttgccgcccgcgtggcagcccacgtggccgccacgtcggcgccacatggcgctcccctctccgggtccccctggactcggtccaccgtggaccggcgtccccgagcagatgacatgtggggcccgcatgtcggcaccgcccccctttgctgacatccccagggttaattattgcgcaataaatcaattaaggtttttctttttatagtaaaagcacagtgaatcttctaaaattcatccgtgctccgtttaagcccattcaagtctcggtaaatcaagaaaaatgcaaagaatccattaaaaatggttttgttctctgtttcagtagtcttatagcctgtttgcattgtttgccttgtatgtcgcatagattccggctctcccgatgctccggtgtacttcaagatagtcgccgaagtttctccaatcgtagagcaaggcaagtcatgcttgtcacttgaacatattgatcccatattgcaaatgctctattgttttcctttaaatattgcatcgttttataatgttactatttgttatcctgttcccaagcgctagcttgggttgtaacatgactagatgttggattagggattgcttagccatgcttagttcaactagtacacaatggaggaatcacattaatgcatagacttcagattctagtattgatgttggattagtgccaccgctttggtgttggttaattaaaatatattaaatggtgggctgtgggtgcatggttttgatggtcgctgcaaggtgggcgtgatagagtttggatgggccctgcgacggcctttgcggctttcggattcacctaggcacgagaggggactgcccgctgccttgcgaggagtgggggtgaaacctgaggtgtggtgtgcttggttaaagggggttatgcgaagggtcctgtcacggcctctttccggtatgtcgtggtggcatgccggcgcacgggaacatgtcgtggggctgtgtattgtgggtacagttgtacatcgctgatcagagtaaaagtattcgaatagccgtgcccacggttatgggcggtcaaccaaattcaccgtgattagtctcaccctagtttagcttaatggaactgattagttcaggtggtagtttgggcctgtctcaacgtggtgtagcgttgagcagtgattggtttaatattgattaattattacaactgtttttctgctttcaactactgtttataaatgctagctttatgcaaatgaactcctttagccctcctttagttatatcttgcatcataccctccattccggtatgacttgctgagtacagtgggtagtactcaatcttgctctatctcccaaccctcagagttcgagtatgtgtccgatggtggtttctccgaggagtaggcttcgtccgtgccgtcgaagatgcctgtggagtggtgttcccgctgcaatccaagtcaaggcttagctccagttatctttttttttccgctgcatttatgtaagagttttataatgtttgtaagacgtggatctgtatgtcaactttgtcgtttgtgtaccatggccgatcctggacagaggttttaatgcacattctgcttaaaattctattcgggaatttctgggtgtgacatgagtccacatccgtacccacatccacgtacatatcggtcgcttttatataagggttaatttgatccatacaattagaaatactactatttcatataaatgtcactacaattcgtctatttgtagccgtgccactgaaatttacaaaattaggactgtgccactgccgtcacgttttccatcatctccttcgtgcgtccccctgggcggcgtcactactttgtctccccccgcacaggccggcaaggacgacaaggacgaggtggagatgctcaatcatggtggcggcctcgaggtgagccatccgcagcgcggctaggacgtttcagacagcgccgcaggaggtggccgtggagcagacggtgaaggagcagctacagcgcgtgctggagcgcatcacattgcagtcgcaggcgcaacatggggacggggagctgcttgtccaggtctgggtgccgacatggtggtggtgggagcggcggtgggtctaacgatggcgggggacatacaacatggggacgggaggagaagggcggtggggaagggctcgggggcgtccaggtacagcttgcggtgtccatggtgaggagaagacatgatgagattgggtggaggaagaagaactagtggatgtcctgcgcattgcagcgggatttgagaattcttactgagaaacattattgatcaatctttgtgtgtttccttcttttactcattggttacgtgttttcttttcgacaaaataatatggattacgtgtttatcaagtgggccgctttcgtccgttggttgctaagaaagaacaataggcggagacgtcaagggagaggttcgtttcctttttttttttttgccaacagcaaactggatacatgcgatgtttgaaagccatccgatcaatacctgacagttaaaatatgtagatgacgtggcaagctgtggtgtaagctttataacaattataacttagtgggtattattaactatataggaaaaagagatgtgccgagtgagtctcacgtgcagacgaggaagaagatgaaaaacgtgactacagtgacacggtcctaattttaaaaaaattaagtgatatagttacgaatagataaattgtaatggtatttattcgaaatataatatttacaatggcatggatcaaattagcactttatataacctcctcatttcatttcaaatcaaacgagataatctgatccattatcgcccgctccattccccattcccaccacggcaccacctgtccctgtcccgcagtccaaaacggcaccaagaatattgctcctacctttcctgaatcttcctaccgtgcgtgagccgtccccagtaccagtactcaccacctacgcggtcgcccaccgcgccgtcgccggcgccggtcagcccctcaccgccgcctcccgttcgccaacgacgtcgtcgccgtcggccctatcccccgtcaggtacgcccacgcaacgccgcccccccgtcttgtatactatttctcgattttgtttttcttttttaattttattttagcgagctctatcctcgcccacagctccgtcaaaggcacggagaaacgaacaaacgcgagagagaaaacaagaagaggaggaggagccgacgcaaccgaggccccagttccgattgatctccggttcccagatcggccaggtttgtcctccccccaattcgcccccctgaatccttctccccccgcccggtttcgtcctgatcggtgcccgtttcgtgctgttccgtgcgcggattagggttcttgctaggatctttgggggtgggctggcgacctggtgttgggtgcttgatgggtttgttcgttcgtgcgtgtgatccgccgtgggaggaaagaggaagagattgttctcctgaagaaaccttaccatttccgttggtgttttgatgaatggatatgttaggattggtttctttctgttattccctgcaagtttcgtcaagctcagctttgcgattagttactatgagcttattacaattttttacctttctacaagttattcattaccgatttttgtacctaataatgtggttcaatttgggatttggaagtatgcctgcgattttgtctggtattaacaatttagctctcaacaagcaaaagcaaccttttgaggctagttgcaggctgcagcagaagcagagtgaattaagggcattcaagtgtaaagaacagagggtatacttaaaatcattcttatatttttaacaactattatgtctcatgtggtactataaatgggaacttaaatgagattagttgttaataaaaatttctgtaggaaatatctttgcattttagcctgtttttccttatgtccactattaaggttggaataggttaaacagtgtacaggtgcaaatcagaacctgaaatgctgatagttaccttccccgtacatttgactttatgaccggacggtgcatttctttgctccgaaatgctgatggttgtcttcctcgtacttcgttaatacattccaccattaacatgcattcctcataccttagtagcaacagttttgtgtttatgtgaaaatatcaaagagacataatacactagtttcctgtcatgatatctcatggttattttttacacgtatccatcctattagagatttttatattatatcatccttttgtgtgcctacttgatgtttatgccattgttttgaattaaccagcaatggcttcatcttcggacccatggatgaaagagtacaatgaggcatctaggcttgctgatgatatcaattccatgattgccgatagagggtctcttccacaatcaggcccggaaattatacgtcacacatcagccattcgaagaaaaataactattctttgtactagactggatagcttggaagcattgttgtccaagattcctccgaagtcactgtatgttctgttgctactacctttttctttatataaaactgaagataggtggagttttttcaattctggcatatttccttatgctaaagcctaaatttattccgaaagcctatatactggcaaattttgtacaaactgttagctaacctgtttacttaatgtgacgtatcttaaaattgaatttatcagctattctttaaaatggaggataatgatgtttttgctcgtttataactgatgtgtggacttctgacgcctctgcttcaccacctatggggacccagactagatttaaaatgaaatacttcctctgtacaaaaatatatgaactacaaaggtaactatattttgggatggagggagtattgtaattgtatgatcaggttttgtgttattttttcaatgaccttagttggtgtagaaccataagagcttgtgttggttgtggagcatgaaaccaactatgctagagatgttataagatgcaattatttggcatatgttagaatttaagggctgtgcatgtagttcctgtttgaaaaatatccattgccattatggtaggaagattgcaccttatctcttacgtcagttgtaaggacatgttttgcctgcttatgagaaagatatggtgaacgccacttagcaagttaattaatgtggtttgcagtatagatatgctgatagaaaatggtttgtcattaactagttaggattttttttttatcgaagttatattttactaatgcaggaacctgcacattttaacactgacacatagttttatatttatatggcatggcagtatggtgtaatggttattggaatttatacctgccaaaagttctcaattcctttacttttgaattcatgcagcagtgacaaggagttacacaagcgccaagacacgctttccaatttgaaatctaaaacaaaacagatggcaacaagttttaacatgtcaaactttgccaacaggtgtgttcttcgtatcagtaatgatcttagtatggaataatgctgtaccaatgctttggagaagtatcaatcctttatgtcatccaaatatggtcatgtaattattgttgggaacttttatttctaatgatcatagtatcataccaaatttgtacttatccaatatagggaggacttgcttggtcagaacaagaaggcagctgatgatatgagcagagttgctggtttggataaccaagggattgttggccttcagaggcaaattatgaaaggtgacaaatatgtcacttaattattccattttttgtttccctatagcaggatcttttgaataatggcattgaaatttcggtaaaagaaaatgatggaattgaaataaaacatgaaaaaaaaaggtgcacgagacccctgtttctttacagtacatgcattttgtaattgtaggcacatatcattttatttccacaaaccacagcaatttgcatggtgactaactgtttggcatattttacaatttgcagaacaagatgaaggtcttgagaagctggaagagacagtcctgagtacaaaacatatcgctttagcagtcaatgaagaacttaccctgcatacgagattgattgttagtacctgctatgacagctgtatgcatgcgtgtttctaaaactagatgataattgctttatattcacctattgcaggatgacttggaagatcatgttgatgttacaaactcgcgtcttcaggtgagtctgttatccttcttcgctgttgttaatagtagaagctctataactactgtttgtcacgaattgtttaacactcacataaattaaacattgaacgaacttatttcatccagcgtgtgcaaaagaggcttgcaattctgaacaagcgcaccaaaggtggctg

SEQ ID NO: 47033 - DNA, 15792 bp, Oryza sativa
tttatcagtgtgtgtacgtcatatgaggccctggcatatatgcccaacaatatgtctgagactaccactcacgtggaatttgttggattgcaatgagaagtatatatatgtttttgtgtgtggagatgtaactgctgtagcattgtcaatccttggcatgtgcattcagaaagtgtgtgcgttcagataggatttcatttttctgtgatcggttgctgtcgatatgtacaagctcaatgtcagccactcgcacaaaatatgtgaaaaattatagatatggcgatggtttgggattttgcttatttgacaggaatactctcttctgcagcatgtagattccttgcttacgctcattgattcctccgtaattttgacattctagcccatccataaaacttatttcaaaaataggctgtgataaaaactatataaaaaaatatctttacactgtgggctaacatctcaccagtagggatgaaaacggtacggaaacggacggaaaccatctttatcgttttcgttttcataattctttcggaatcggaaaccccggatacgaaaacggaatcgaatattatcggaaccgaaaacggagcgaaaacgaaccggcgtgaatacggtaataaaaatttatcagaatacaaaaacccctcaaactgataaatccaattctcaagtctcaacggtcgacaattcatcataaaacacaatcatataagtccaattgttaagtctcaatagtacatcacaaaacacaatctatagaataaattatctatatttaagagagtaatgttgttgataaatcctaatgcatgaaaaaaatattcttatgtaacttcagatttgcataacaaatattttttaaaaaatagcagccaaacaccgtgatattcactatttagtgcttaaaaaaataatccaggatatttcaatcacaaaatttctgaaaattccgagaaaattttcagaaagtttccaaccgattcaaagttccgatggaaactgcccttatcatttttgattccgtttccgagaaaatatttctgaatttgttccgtttccgaaaaattctaaccgacagattcgttttcgaaaataggtccggcatctgaaaagtttcataccctttttcacccctactcagcgctaaggcctatggcaccaagacttgtgatatacaatttaaataaaagatgaacatggttggtggtggctgccttcatactagtgatctgtgttcaaatcaatccttgccgtgccacattttcagttcttttttaatcctgccgtgactttttctctagcggaaaagacacaaacttttcaactgaaccgcttcaatatgttgtacatggtaatgctcatctatattttttatagcttaatttggtcagcgccagaccctgctacgctgaggcccaaatcttagcgatgttgggcgtcagcaccaaggtctatggcactaagatttggttatagttttcgtccggtctacttatagaataagttttttgtgaaagggctaaaatgttaaagtttcgcttgattcctggagtcacgctctacacttacgttggaacttggcagccattttgcaaggaagctctaagttgccgtatgaataataattcctcgtttcatcgcagcacattacagtgagaaaatctgaagctgatctgtatttcaagagtttctctttgtcacttgcacgcctcctttttcatgatcgctaagaaaacaagtaaaaggtttatctaaatttgttcctgaaagtcaaactcaaaattcaatcactttatattataatccaaggcagggccaagcatagcataaacttagcttttgaattttgatagtctcattcaataatctacggtcatataattggtaactgcagaaactagggaagtagttttcaagacacataaagaaagtggcatttttttttttgaatctagagagcttgtattaacgatgaaaataggaattatacattcctggtctaacaaatcaagaatcactgcatgagcacataatctctactcggtgcaggacctcgacctcattgttagctgagcaagaacacgagtcatactattagctttcctctttgtttttgtgtgcacctcgacattttggagacattaatttcatcacaccctttgtttcagaaattgttcctgcccaaccaaaccgatacggtagctttttcacaagggctgttgcgacatcaacattatcagtctccaaaattatcggcatatgcacccaatcaattaccgcatacaaagccttctaaacagactagaaaatctcttctataccccaaaatttttagctaattctttctatgtctctgaattttgcttacttctttgtataccccaaaatttgattttgatctcttccatacccctcccgtcagttgactgtctaatttctataaaaataaccattttaccctttggatgaatatagaaattcatgaatcacattattaaaaatgtaaaagtttgccacataagactattatagttatgagtttgttatgcgatacattatttatcacaatttatttttagataaataaataaataataagtatttattttttaaaacaaagtcataaaaatgaggagcattcatacaaagataggactaccaatgctcacaatgatttttttatgaatgctcccaatcaaaaatatccatcgtcctattaaaatttcaaataaaaatttaaatttattacatttgttttattttcaaatttatgtcaaaattttatgcactaattatttagtctcattagtttcataaaatgcacatactgtacactaaaacaaaattttcaatcgtttttcaagtttatattcaaatctaaagcatcaaggacaaaaaagatatttgcaaccaaacgtaatagtaaaatgaaggaaaatgtaatggtaggagcatggaaaggatcaagttgaaattttagaagtatagaagggatcgggtaaattttaagggtatgaaaaggattgagtgaggttttaggggtacagatggaatttactccaaaaacttcagcctgaactgcctcaccgcaatgatgaagtgctttgtgagccacaaacagaactaagcctctataatccctcactattatcccagtactcgcttcccctgcctcttctctaaaccctacatcagcgttcacctttgcagagtctataggtggagcttgccatttttccttctctttgccgcagagtggggagtggtagcgggcagcagcgagcggccggagcaggtgggctagcgcgcggtggctgagtgcgcggcggctgagtggttatggccaagcgcgctgtggccgacagagcggaccggcggccgcggcggtggctgagcgcacctgcagagctaaagccatacgcgtgggaccggctccagtgccgacttagagatggtaggcgctctgtggccacggccacggcaattgctgctgtggcggccaccatggcctctcggtcttgtcggtaggtggaatggagaaggcggctaacgagagatgagggaggagagtggcagccggcgaccggcgtggcgatggtgggaggcacgttgaagaggacgagcccaccccaccacggatgaattgtcaatttgtcatgcgtccgacgacggattggcttgacgagctcctctcgccggtggtccctaacaaggcgcccagcgccgccaacaccgcctcctcaccgcccctaatcggtgtcacctcctcgccggcccaagccgtcgaccgtcgtcggctcgtcgttggcgtaggccccagacgacgcccccacaccacctcgtagcctcggctgcaacggctactaccaccatcacgtcgtcgagggaggagagattaagagcagaggagagagagggggaggagggagagagagcaggggaagagagaaggtggagactgagtatgataggtggggccattttcgtttttgccacatcaactcgagtagaccgggtcaaatttccacgtcagcaaaaccaggtgcctatattgctataggacgtaaaatggatggtcttgtataatttaggggtgaagatttatggtattaagtataagggatgtcaaacaaactcgttgtaaagttgaggtatggcaggtgaacttattccgatgtaggtaagcccaaggagctaacgtagccaacgagcccaagtgacctagtgaagtagctaagcccatcacgaaaataaaggcaaaaaagctcattagattagtcccgtacttgtctgaaccctagatcgaatcgatcgattccattctcttatcgttttcctcccgagccgcttcgtgttctcatcccctctcaccgagccgaggagagccgagccagctcgttatcctaacaagccgagccgagccgagccgagctggctttttgggtcccagaagcccaaaagcccaaaattctgatccgccgccggcatccctgctccgccccaccaccaccaccacctcgcgcggcggcgatgcttccggcggcgctgaggcctctccgccgcatccccctcgcgcgcctccggagccgcctcctctcctcctccgcctccggagagggcggccctcccgccgttgcctccaccgacgaagcggtgagggcggcgaagctgagggaggaggcgtacaagcaggtggctaacctcgactggtccagcaacgccgacttctggaaggccgtcgatattgtcaaaaccttgccacccaagcgcaaggaattcgggtcagcaccccctcccatcttctcctacattacattttattttggctttagaactggcggtcaatttggagaatggagctggttgttatttggggcaatggttgagagctgatgccaatagcccgttctgttgaaaagctttcacctatgatttgctattcgtgatgcaaatgtttaaaatgaatacaagtgcgtattgttacttcacactgaatgctagtatcattactaaaagatgtctattttgtatctgaacagtcgtggcgagtttcaaatcgattttttgaggtttagataacgctgtgtggtccataaatattttcgaaacccaaattccttgtcctaacactcatagtgaatagtgggaattaatcatgcggtcatcctttgtgcaaggttatcactattttgttcacattcagttgtaaccaggaaacatgacaaatttgaaaaaacgaaactcgttcaatatcctgctgaccccgaactttatgaccttgtagtccctggtaagtttgtaaagagatccaagaacatggcaaccagattcaatttaacacgaacactaattcagagaaagcacactatctactgtattctcatgacactcctcgtaaacatgtctatgaaacttggaatgccttccaaaattcaagatcatgtgatgtgtaatatatacatgtgttacatgttttggagatgaatttcattacggacatatcctatggcaggattcgttgattgtacatttccttttgagttttaggctggacttccacctggtgcaactcttctttgtgtgcctgccttctctaggtttgttttgttataaaaatcctcactttatggccttgttatttggaatgtacaatgtgaaatttcagttcttttgtgacaatatttcgtttgttttcttgtacagccgtttatttggttgctcagtatgcacggagtgagatcaaaaggatggaggcagtaataaactatgcttctctcatgcaccatttccttttgagtagatcccaatcagaacaatttgactcttaaacatcaaatgcacagaattctcagtttcaactatcttgttagtaaatactaaaacattgtgtttcaacttattttcgtaaatgattatgctactcatctgatgtattttatttttatatgctataactgtgtttggtgaaaaaagatagcttgtgtaagatttagttcttgctaaaatgatctcaggcaaaatcattaaaactgagtccttgggttggtggttgttccaatatcagttttgatcaagctctgttgtagggttgtcacctaaatgcatcaacgctggaacttgtcagggcatcttaaatgagtagttggttcattttaggtgttcaaaatatttgcatgattacatttagcaaccaattgatagcagcttgcctcgtacatggtgtagagagaatgataagtatgtgccgtcaggttatcactgtcactttttttcagttatatatgattctgaacatttaattgcgaagctgcaagtgtaggctgtattttggactatgtttccttgaagtgtcaagtgtcaacatagttttttttatccattccagttgcttttttcttccactgctataatagtatgtgcaacaatgcatttgtctcaagattgttagcatttcttattactgataatacatggtttggggatagtgattgttgataaattgaacacacttgaggttgcctgtttgctttagacttgcattgtgtcgaatattcaaatacttcatatgatgtcggcaacaatattactccctctagtctgaacatgactttttggatattgacatggtcttacaaaaaaaaaaaacaatttggaccataactcctgttgcagtgtctacctttaactctttatgaaacctgataatatgtttgacagcatgtgtgtccaaactaatatgtatttttggtcacagtgagtatagcccgagacattagtgtccatgtgtagttcgcaagaaaattctgttttcagatggtccaattcgccgtatgttattttgtactcatgatattcttatgataaggcatgttcattaagcatatgatgattgattaatatgatgcttgcttcaggaagcagaagagaaaaagaaaaaggatgaggaactggagaaagaaaaacagcttgaagcagattctgttaaggatgagactgattcaaagctgtcagcagttttagtccggttagatacactggagggagttgttaatgagattgtggatgacaaaaggaaaggttccgcccctggtttttccaacaaggaggaagccacaaagaaaggtgagagacaaagcaattccactgatggccaggtagtgccagtcaagagtaaggacatcatcaatggtgctacaaacgcttcacccaattctacgcaacagagccctacagggaatggagacaaggcatcttctgaccccaagggttgatgaatctcgctggttttttacgcttggagtgatacttggaatgtgctgtatgcatcagttgagttttttgttgatcaagcatgagcatcggttccatagagtagatgcagtcataggttcagttgcatcgcaccattttccaacagtgtgggactctctccgggaatggttgactccctacggtagagtagatgcagtccatagagccttgcagtcttatggtcagttttgcaggagaaaagacgccaatggtggatgaacatcagggctccctgctcaactttggggacttgaaaccccaaattttgtgtctagacattgttgatagcagttctattccaccttacaaaaacttggcacattgaggcttgaggtctgttgatgttggatgtactaactcaggattcggtttataaattactgagaagggctaacttccagaaataatgaaaggtgcttgttctgggtacatgtgaattgtgatacgtgacactttcactttcctgagctggtctatttgacaagtgtatctccgctttgtaagtaaacactaacccatttgaaggttccaatttcaagaatgcagatattgtttcattctttaatgccagcaggcagcagcttcaaccattaaatcgcctactaattcagtttgcaacggttcgtaaggaacgtttcatactgatgaagtgtctcgagcaaatagcaaatgttgtgctagctgggtgattgtgagacttgggggtagtttgccattagttaaaaaaaaaaacagtcagtggcaaatagtttcatcttttcacttatttgtgggtaaaacttttgtatatatattcttaatgatttaaaaataaatgctataaaataaactacaatgataaaatcacaaaagcaacttcaaaattaaaatttaaagtttggcttataaacataagggaaacgatggagcttaaaagtcgtaccatttcgcaggcgattagtccctcccctccgcatttccgccttttgaatggttctgtcattttaatgtgctaagactctatttagaatggactaaaacttttaagtcctatcacatgagacgaatctattgagcctaattaatccatgattagcctatgtgatgctacagtaaacattctctaattatagattaattagacttaaaaaatttatctcccaaattagctttcatttatataattagttttgtaagtagtctatatttaatactttaaattagtgtctaaatacagagactaaagttaagtccctagatccaaacaccacctaagaaaagaaaaaaggtctatgtaaaattgctagcgtttagggtctcaaattgataactttttcggtggttaagcagcagcagaaagtgttacacggtacttgtcacctttatgcctccttatgaccttacaacatctccaacagcctccttatcccattctccaagttaaactatagcaattttagctcaaattcgcactccaatagcctggccaaccggatggccaagccatccgactggccaaagtagcgctcgcgctggccaaatttggccagccaaacagcctagccaatcatgggccccacctctattctctctccctctcgtagcttctctcctcccaaatccaacgccgcccgtagcatactctccgccagcgccgcccctccgccggcgaagagagctccctccctgcctgccgcgccatccgcccagtgccgacgtcgtcgtcctcccggctccgccgtcatcatcgttgtcctcacggcgctgccatcgtcgtcctcacagcaccaccgtcgttgtactgccagtgttggccgccctagtgccccatcgtggccttctctcaacgtcgcctcgagcccgccttgcgtgcgcacggatttgcccagagcggcaccaacgggcggagcccgagcggcggcggcggcggtgaatggggacgcagcccgagcgatggtggcggcgggcggatggggatggggcggcgccggcggatgggatagggaaggggggtttggagagaaggggagaaagatgagggagaagaaggaggtgtagagactgacatgtgggtctaattgtcatagactcagaatagagaggacgaatggagaggcagttagagtaaaagacagtttgacttgccaaattaaatggagagttggccaaataaatatttggagagtcaaatttggagaaactgttagagatgctcagcctctccaaatcaaactctccaaacatttatatagccaactctccatctgatttggctagtcaaactagttactcactccaacaacatctccatttacactctctataataagtctatgacacttggggtccacatgtcagcctctcatatctattattcttcctctttctccccttcttttcctcgactcccactggagccatcctttgctacgacaacgatgtccacgcgacagcggatggcgaggggaggcataaattttacaatatttttttaaaaagtagtttatttcacataaaaaaatctataaaatatttatattccaaattcaggtgcgagttatttggaatccatagggcaaccatacgagatcggtgatgaaatggcaggtgcagtcgttgaggaagacgataggacataggttcaatttgctgttatgtgctttttttttttgaagctatggtgaaatgccaataattatttttgaatattagcaatattcatctcacgtctgcaatcatttttttttcgtcttgtagagcatctcccaaggcaaaatcgatttaaataaataaaaaaaacgagccatgtacattgcgccagtcgatttgtgattatctgaaacaaaataatcgaactctaatttggagtcgactcagagagtaaaaaaatatttattgtgcatgcatgtatggagagcagacatactgattggtggaatccttttacgtaggtaccacaaatggattttcacttcagccattgaaagaaatttacttaaatcgtaaaagcaacttagctttgcaatagaatagaagtaactaactatagcattggaagtagttatataatggatgaggactatgtgaaataaattcatatgtaaaatggaaagaaaaattgcaagtaaatacaactacttctaatacctttaagagttatttatattttattttttaagttacttcccttctggagtgtatttacttctaatattacgaagagttacttctatttttttttttaaaaaagttacttttctccagtagcgttgttacttttaatatcgtgaaaaaagttaatttttatatgatgcaagattttatttttcaaaaaacattatagtgattactttaaataaataatatatgtatttacttgaaaatcttctctacactttacttgtgaatttactccacacagtttcttattttatctcactcataatataattacttataatgctataaagagttactaatattgcatagctaagttacttctacaatttaaataaattacttttagattaataaaatgtttaaatatattcaacgttgaacttgttttgtaacatatttttgagtgtggtacaatggtgcaaataaatcttaaaaataatatacagtttaaaagataaaaaaatatacgttagtgatcaatttatatatataagtgtttgttgttgctatttttagatggtaaaaagggatttatacgtcatgtgagataaagtggtcgtgaccgtgcactacgtagccgtgtcctttttaatgtgctctaaatatgtttagaccctccattggtgtttatagtccaataggcgatataatctatattcccttgttacaggtaagaactcataataaggcaagaacagacgtggaactaaggcaagtaattagtagtaaattgatctcacggaaatgttctattgattcgaaatatcacgttgcaacactactacagatccgggcttcagtgacgggtcatctgtgacgggccaacgcaactcgtcaaagatgagtcatctctgacgggccaaaaaaatatcctctttaatatatggctaccagggaggacccgtcacagatgtgaagtcatctgtgatggcttgcacttgtaacccgtcacagatcgtctgtgacgggtcacaaccatggctcgtcacaaatgacatgtcatctgtgacaggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaatatgcattacaagtgagtcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaaacatcagatgaagatattttctatgtaaaagttataaaacacgatgagatctataactatttagttgataatattttcatttgaagtcatttagggtgttaaatatatgttaaatgattcagacaagcatagacaaaataataacattgggtgactagtcaatatgtgttgagtaggtgagttggtaagggatctcacgtgtagcatgcaagttatgttgcatgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgatgggtcgtaagttacaacccgtcggtcaggtagttacgacacgtcactgatgactcatctgtgatgggtgacaagttttaacccgtcagagatgacttatataccagtcagagatgggttatttgtgacgggtgtttcatccgtcacaggtgattttgtcatcagtgaccactaatcactgaccaagaccaaacccatcaaaggtgagggtttgggcccgtcagagatgacctggtccggcgtagtgtaatttcatgtgtgtaaaatcatatgtactagtgtttgaaccatgctttaaattcagctaggatactgcatgcagaatttgcaatctgatgccaaaaatcaaaacgtagacgtttaagaaagtacttataacatttaaatgtattttttggtatacattttgtgatatcaggatttatatttgaaaaaaagttgtcacttcaaacttaattacatgcaagaccattaaattacggccagccgttgccaaattagtaccccccctactttctggcattcattcatgattaattgagcattatgttttatagaacaattaagagtgttgatcttttttttttcattttctaccgtaatcagtcaattgagaggaataaaaatatttttattagaagaaaatggatgaatgatcaatgcttaggatttattagagatcttacctcccagagcaggtcaggtggagcaccaaaccataattcgaacctctcctgtaattcaaacaagatcatcataagctaccacaatattaacgagcctttgtttaaatttgcgaccactaaggtaggcaaggaattttcgaccgacaaggggctcatggagacgggaactgttgccaatgccactactagaaaaaccactagaaaaatcatttttccaggcgatgacatttctttttccaggcgggtagacatctcggagctaaatggccgcctacgaaaataacaaccgtgggcgagatcgttgttcgtctacagaaagtttataagttataaaaatcaccacctacaccccttccctcactcacctcacccccattcctgcacccccatgatcccccatcaccctcccctccctccctctctccctccctccctcccagtcccgaccggaggaggggagggcggcggcggtatggcgtggaggtggggcggaggcggctccccctctctccctccccgctcctagatctagacggaagagggggagcaacgttaacggcggcggtggaggaagcgatagtggaggccactccttccttccccggtcgtagatccggccggacgaggggggtgacggcggcggcgcgtgatggtggcggtgcggaggtggctcccctcccctccctctcccagatccggctggagtaaggagatgggagggtggtggcggcgacagagacctcccctcacatatctggctagaggaaggggagcgatggcagaggcggcacagagacagtcagcgacggtggagacctccctccctcccatatccggctggaggggggagggtggtagcggcggcggtgtggccctcctctccctctggccggatctttcgctgcatgcagttgcagaggatgccgccggcagcacggcactgcgttgcgacgacgatgacgttgtttttgttagtagttttcattgattgatgttaatttgcaagttgatgttatagatttgaatccaatgctcttgtgttgatgtatggatgtttgtgattggattttatttcctggatgaagttgtgtgagagtttgtgatttgtgatttgaaaccctagggagggggagagggaggggcggggctggcgaggattttttttttggcgccgagattattttcgcaggcagggatactgtagcgcctgagaagattggaattgccgcctatgaaaatcattttcgtaggtgcctataaaaaatggggatttttacatgcctgaatttggccgcctatgaaaacgtgttttttaaaaaaaggccgcataaaaaatatttttgctatgctactctctgctagcaccagaggactccatcatactaccatgcatacgactggctgcaagtgttgttgcttcattgctaggcggatacaggcatggtcttaaaaataactcatgtacaacaaaatgctatatatatgccatcatattttttataaaaaaatagtcaacataacagcatttatttatattgtaaatccccaaattatatatatgcaattacactgcaagttttaaaattatatatatataagttgatgtaagtagatgaccatatacggttcaaaacaagaccgttcacaccttaacaggcccatcaacgatgatggtttgtaatcctcttcatcgtgtaccatcttcgtagcccataagacctaacctattttttacttatttcttcaattctatatcagctcactggtgaactaccgtatatgcggtggcggtggagccactgacattgttaagcctggtgaatgaaatgacttttactagcgacctataattctttttgggcattttaggctcctaaccatggcacacaccaacttacatagacccgaccacacaggtaccatcgtcgccaccttgttccaatgtcctatctctgccacaacttcctgcacgcctccaaatggttgcccttttgtccatgttctacaaatagtctaaggttagggttcaaaattagaagagatagtctttatatggatagaagttgtcagctgtctatgtaacatttgcaagaaaacccttcatcatgttggtaacttttagatggcccaaatcacgctaaggtttgtgcacaacttatctcctcccatctcccatctctttttcccctacccaaccctaatgctaggtcttttcttcgtcccaaccctgacaatactagatctagaggatgtgtgctgcctcaccaagtgccgccacctcccctgctccaacgtgctaccagaaggcgctaatgactctcgtgaggctccgttggccgtccacctctcctcgtctccatgtcgagcagtggcaagatgcttccatcccgtcgtcactactgcctcttaatcactccagatctagtgcccccgcctccaccgatggtcccactgccctactccaacccgcggcttcagaggagccattgccgcctcccaacccacatgtgtccattgcccagtactggttcgactaccacccgcagccatccctctaagtctagggaacccctctcttcccccctaattggttggagtgatcatcgccaccgtcatcagagttcattaatgtcattagagttggaggagaagctcactggagtacgaatcgcgaagtggatccgttggtccaaaatctgtatgagatttcggcttcggaatgaaggttagaaatgctgaataaaaatattgctttcaattactactagaaaaagcatttttcccaacgtaggggtctcattt

SEQ ID NO: 47034 - DNA, 1837 bp, Oryza sativa
attttcgcaggcgtgctgttgccccaactgtgaaaatcgttgattttcaccgtcgttgtgctacaagcggtccaaccctccgcctgcaaaaatcacttttgtctgtctgcgaaaatactttttctagtagtgcaatcttcgtactgagaactaaccaggccatcttttttcactgttgtattccttcccggtctagctgtgttcctttttgtagttttgctgttccttccttgacatgttcatggacttctacagttttaccagatagataaattctcagccgtcaatcccattttttgtcgacctatcgtttaggcacgcaagaaacctcaagcatatatatatacaactccatgcttaaaaaataacttaacccaaaaggcaactttatgagattagagctagcagatacaaggaagcttttacaccgtcatctcatattctttacaagcatatatacaaggaagcttttcccattctctttagaaaggcactatgtacagtacccctgaagataaaagcagaaggtagtagatgatgatgatatcgattaatcaatcccatttaccgctttggatctcaagcttaattcccatgattaacaactgagatctcgacagcttaaatgttaatttgtccagtttggcaacagctagctttcagcccaacggcatggtgaagatcaggatacatatatacatggaaagttgaatttacacataattaagatgcgtattactgcgtaggtaattaagcatggcgacatttcaggggtttatatttggtgtgagataatagtgatcatcaagatatgcatgcgacagtctgacagatgatgagaaatgtgaggatatgcattcatacgtgtcgaaactcaaatggaagtattttaaatgattgatttgtaactgacctacattccaaaatattcaagaaattctaactaagaagtataaaacacgattaagataagtattactaaaaaccaaacactgacagatatgatgaccatgcttttgttccatattttaattagtctactttcaaaaacattccttcattttgtctaacaaagtaccaagtactaactctttcttccacactgtcactgacatccaaagtcaaactcaatatttcacaataaaaaaaataacgaaggaattgcattctgatacttcatgcaaaaaagatagattttgatcagttccatacgaaggaacaatggaacaacaaagatatagaacccctaattttccaatggggaaatgaaggcagcatacatgaatgcatatagaaagaatcgaacataccccaatcaagccttgcactacatcacatctacgaccaaccaatttgcaaggggcttagctctaatcatcatctgaccatatgcatacatgaatgaataaactaaacaacaattagacgacgaaattaagaatttagcttttctctaacaacacgagatcagattaaggctgcaataatctcaagaactggaaaccctagtgagacctagagcttgagagtcaggtctatcttgctgcttgacatctcctcctgcgccttcacttccgccgctgtgtgttgctcgccggcggcggcggcggcggcggcgctatggatggtgccgctgccgccgccttcggcccaccggagcccggcggaggcaggggcgcctgtggccctggacgacgacgagccggcgccgtagccgaaggcgtcggccgggtacacagggcgttcggcggcggcgtgacgggcggcgatcccctgcagggaggatggcggctgggtgctccacccgtggtgcaccgcgccgaagaacggcgccgct

SEQ ID NO: 47035 - DNA, 5261 bp, Oryza sativa
  unsure (1)..(5261): unsure at all n locations
ccgcgcttggcgagggagcgctcccgcttgtgcgcgttctggtgcccccccagcgcctgcgacgtgtagaacttgcgctggcagtagttgcacttgaacagccggcgcctcgcctcgccgccgccgccgccaccgttcgccgccgccgccgccacagcagaagccctctcctccacggacggcgccaccgcctcgcccaccatcacgacggcggccttccctttctccgccggcatgacctcctccgctcgcagcgcgccaagaagatcgagctccatcgccgccgcagccgccgccacctcctcctccttcttggccaccacctcgccttcctccccatcaccaccaccaccaccactcccctcaaccttcatcgccacctccatggacacggtggtctgcgagctggaagccatggagctagcaaaacacagcacaagacaacactaatttggctttaaaatttttgctggcacgagatcgagtgagatcgagagaatacgcgttcttgggatgaatcggatccctacttatacaaggggattggaggggttaaacgcggagatgatctgagaggaatggaagcaaagttgccaaatgaaacaagatatggcgtgatcacaggaggcaggcgtttaatgtagcagagagagagagagagatgagatatgctccatatcatagccccttaattcgcatgcattaatcttcttctcttcttgtgatgatcgatcgatcgatcagtcagtactccatcttagccaacgatatttctctgtccatccactccatttggttccctttctcactagtgtagtgcaaatctttgtctctatctctctatccttactgccactaaaacacagagcaacaggggaacggtttcctaacttggacagatatgggtgtgtatgtatggagtttttgaactggagggatgccttgacgttagttcaagatgtgataggatgtgatatgtatgcacttaagttgtgatatgtattgcactctggcagtagaaattaatttaatgccaacttggcagaatgtgaacatggcatgacgtaagggcatgaagaaatggtgtgacgtcagtaagtcacaagatattttgttttaaaatgttgacatgaaaagattatatggacagcctaaattaggtaaataccctgtgagaactggtatataccctatatgaactgctacatgcttactccccctgtttaaaattataaagcatctccttattttccaaaaaaatcaacatttaaattttttattagtaattaattgaaccaaaaatgcatgtttttatagtgccacgtaatatcacaaaattgtattaacaaatattttatacgatcttaaatctgtagttgttggtcaaagtataatacaaaggtatcatccaaatattccatgacaacgcagggttaatgtagattatgcagtaggagcttaattttagggatttccaattaacttgtcttcaattatttcgatttgccacttcatctagagttctagaattaaatttccattcctcttatggcttcatcttcagaatgttttgtcaacctcaatcaatttaccgttacacaccactctagtgctataaaaacgaaacatcgacagtatggtgacactatcatatatatcgaaaaagtccaaataacccccaccccctagactatgacagaagtccatctaacgcactatagtttgaaaccggacattcaaccccctaaactgtgcataccattcatatatatatatatgcccccctaaggtggttttacaaattggtttttatttaatttgcatatacgttggtggagctttgataatgtgacatacacattgaaaatatatgttaaattttcacttaaatctttgtttttaccccttgttcgctcttacatacaagaaaagtaccgacgtaacaattaatagtacgacatcactgtacatgataaattgagctacaattggtggtacgtaaatatattatattagttgtttaaagccatgtgtttaacatcccaaatacgcaaaaccattatccaaaaccatcttaggggggaatataaaatgtattgtaaagtttgggagattggatgtatgtctggttttaaatttaaggttccaaatgacttccatctaaagtgtagggcgatatttagacttgtccgtccatatattttaattacttaaaactggcatatgaggcatttatcattcatatatatgcctagtccagagtttaaaaccaacacatatgaatccatatatatgagctgattttaaacaacattgtatctatatatgatgtttgcaatcttatatgtgccgccggttttaaacaacattttatctatatatgatgttggcaatcttatatgtgccggtggttgttagaaccgacatataatagaaaggctaccgcaaaaatcaatcaccaccatatatttgcactaattagtttcttttctggttccagcttacaatgacgacatgagtacaatggtctgtgcgtgttgcgtcttatgtataattgtaaagaatacattagaatttgtaataaagggcaataaattatgttttgtaaataatgaagagtaaataccggtttgttttcccgataatggacatttgtcctgtaatttttttcgtgaagctagattttaaaagtatagttatgttatttctcataaataaaattatacttataatcaactatatatattattttataatttcatcccctgaaaagttttttccccattttgtaggggggtgactactattccgaaactttgaaggacctgacgattgacgagttcaatagttcaaaggttaatcccatccctaattcctcgacccgtctccgttgagttcttgtagatggttgtgaggctaccaagctatccatatgagtggtccaagtttgcatagaatccctgggggttctatatatctcgatccatgtgttcaagaattatcagaaaattttgtttaaaaggtttaaggtaaaatggtaaagtataagcataattttaaattatggatagagtatcaaatttgggaccggagtatcttcatgctcaaaaggatgatgtcctagattacgtatagttaaacctcagaattttagataatcaatagatgcaaaaatatcaagatttaatatattaatatgatattggtacatttatcatgggatttttatatcatattttgcaatacatattttatcactatatgaaattttaaattatattagtaaagtgatcaatgtattgcaaagctgaccagcatgcagtacattcttaacgggtaatgaaagaaaaagatggaatctttttatgatactagagaatactatgtgccttgctgcgggatttgttaaatttatcatgacaaagattgaaatttaaaactatcaggtgaaaatgttgcttcatggtttattaagtatcctttcatagaaaatgtatgagaaaattccttccattcccctaaaattttagtagatcccttccataccttaaattttcttcactcatttgttacctctgaattttaatttggatccctctcataccctcaccgttaattaaccattagttgaccatttaataggtgtataaaattcagttttacccttcaattatgaatataataaaactatacgtttccaacaatatagctactatacaagttttcatgtttttttcacgtctaagggtaaatggtccttttataggaatcaaacagtcaactaatggtcaactaatggaatggatatgaaaagggatcaaaaccaaaattcaaggatagagggagtggacagaactcgagggtgtagaagggattgactaaacttttaagagtatagaaagaattttctctaataattgtagaacaagctgtgcactgaaagaaacaagaatgataaatgaaagacagaagatgataggaaatggaaacacaagacaagacgagctttttttgaggtattggagattcagcaatcaccattaatcttcattggagcactctatacaagagtacaagagtatagctcccttccataccacaaagtccatagccactctcatcatggtggatcttttccaccccgtaaccttcacaaacataacgggtctcccacaaacttcttgagagatcatcggatcacctccgagattggctaggcacgctgagataccaagaataataggaagaaaccttaacttgaagcccttaagaaccatactcttggtttcacagtgaaccactctcaactcaactagaactaaactaatgaagaaaatgatgaaaattaacgcaatgatgctcttagactatctcttcagttgctcaactcaaataggtttcaaaagacatcaacaagtccatggcaaggggtatttattactgtttgaaataaacaaaccaaaattgcaaggggtcgaacaatcttgtacaccaccggactatcccaccctttatatttttccaacggtaactaggcaagtagccattgggtcattaagtgttggacaatctggcaccatcgagattgtttgaaactctttgtctggcatagtggtggacaatccaccgcgttcaaaaccattttccaaaccagctggatgaacatgcggccagattgtcagacaccctatcggattgtccaattgttgccagatcaacttagtctcggacactccgagggctgtcggacaatcaggctagttcaatttctactatccgatcaagacatgaccatagttggacaatgaactagccggacaaccacactgaattgttcgatcaagttgctctagcaacttgcccagggtttttacccaattgatctagtaaattgatttaagtcactagcaacctagatctaatgtcaccgcacatagactctagcacttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47036 - DNA, 1175 bp, Oryza sativa
acgaatcaagctgagtatgaagcagttcttaaagggttgcaattgctcaaggaggtcgaagccgatgctattgaaatcatgggagattctttgttggttatcagtcagttggcaggagaatatgagtgcaagaatgatacttgatagtttataatgagaagtgccaagaactgatgaagaagtttcggctagtgactttgaagcatgtatctcgagagcagaatattgaggccaatgatctagctcaaggggcatcaggatataagccgatgatcaaagatgttcagattgaagttgctgccataacggccgatgattagagatatgatgtgcatcaatatttacgaaatccatctcagtcggcttctaggaagttaagatataaggcgttgaaatatgttttattgaatgatgagctttattatcgaacgattgatggagtattgcttaagtgtttgagcgctgatcaagctaaagttgcaatcggcgaagttcatgagggaatttgtggtactcatcaatcggctcataagatgaagtggttactttggcgtacggggtatttttggccaacgatgttagaagattgtttcagatattataggggctgtcaagattgtcagaaatttggtgcaattcagagagtgccagcgtcggctatgaatcctatcattaaaccatggccattcagaggatggggcattgatataatcggcatgattaatccaccatcgagtaaagggcatatgtttatattagtggcaactgattatttcaccaaatgggtagaggcgattcctttgaagaaggctgattctggagatgcaatacagtttgtccaagaacatataatctaccgatttggtattcctcagactattacaactgatcaaggttcaatctttgtgtcttatgagtttgttcagtttgccgatagtatgggtatcaaattattgaatttttcaccgtattatgcacaagctaatgggcaagccgaggcatctaacaaaagtttgatcaggttgattaaaaggaaaatttctgattatcctcagcagtggcatacccgtttagccgaagcattgtggtcttatcggatggcttgtcatggatcaatccaagttcctccttataagcttgtttatggacatgaaactgttttaccatgggaagtt

SEQ ID NO: 47037 - DNA, 26216 bp, Oryza sativa
tattgcccttagttgtttcatatttttatcaatgttcttgacattgtaaaactgggggggcatatatgtctatcacaatacagaagacaatacagtgcaaaaaaattttttgcaaaaatttttgagcaaagcttatatgtcatattaatcggcaaaattgagataagtattgctggatagccgatatagctctctgcctaatttgttgtacttcttctatggcttgggcatcttgagcatcggttccaggaatgaccttcagagatttggtcatatcagcaacattcttgatagccgattttaactttgctctttgttcttcgatagattgtgggagatcggctaacttcttgtgctctaaatccagtttggcattgcattcttgaagttatgctaagagttcaatcttgcgagcttcaagccggtcaatattggatttgatcgggacttcagataattgatcgagtttggctttttcttcatgaacaagttgccgattagcctggattgttgcttcaatgtctttgcgctctcgatgttcggctaatctcagcttggccttttccagcttaaattgatgttgttcaagataaacagctggagtaaggatatcggctaactcatctaggatttgagtttggacctcatgaagatgagtcctaattgatccacagtcgactactaggctgtctagtgacgatgtctctagctgatgagagatgtcttcaagagttttctttacgtcatcagagaaaggagctagagctttgctagtagtgtcaacctctgtctcttcatcaagataatctctgatatcaaaagagaaaagatcggctaagacctgcagtgatgatttaaagagagttagagatcaaataggcataaccgatctgcatatgttggttataagaaatttactgggatagtctgagcagttagttgaacttcttcttctatgtaatgactccctacagccgatggggtccgatcgcttgatgattgttgaataggaggagaaggagaggaaggaggctgaaaatagacaagtgttatataaaatcggctgagattaactaatgaaagaattaaggctattgcaccggtgagctggtttagatgccattggagccgatttcttcttcacagcagccttccttttctgcaattaccaggtatgtgagcaatcggctataaagtaagatgattacaaaagtggttagagaaggttgcttactcttgtaaaaggagttggagcagaaggagttggaggggtctgcttaggtgaagccgatggtgttctttcagtatcgcttacttcggctgcggcttgatcaacatcttctccgatttcttctttatccagagcttgttcaatggatggatctagggcaggcagatcatcagctggtttagctttctttttgatcttcttctttggagccagggctgaagtatctacagctgatgatctggttttccttttcttgccggcatcggctggttctctgatgagctcttgaagaagagctgaagtcttgggggcatcatagccgatgacaggaggagatggcccacctccattaggaattaagcctggggtgtaggtgatgtccctgccactgttgctttgacgaggaggggaggattctgttgtctacaaatcaaagaagagattagttaaggtaaatcggctaagcagttattcaaatgaaatcaagtaaagtcaaagacttacctgagggacaacatctggaaagaggtttgtcatgtacattgaagctagttggtagaatagatgcaacttccattcaccccaccatctatcaaagtttttgctcctgaacattgctagctctatgttttcaatgctgcccagagggggtcctggaaggctgagcagccgatccatcatcaaggttgatgaaatttctcctcggcattggatcttgtcagcaaagaataagccgattgggagttggcccattccaagctgtctagctgaactcattgggtgatagaattcataagaggcttggatgtttcttccttgatggatgccgactggaagaatgcatggactgattgcagctatgaagacttctctggatgtttggaatctttcatgattaatgtctttgaatctgaaatctgatgggagctcgaggtctgctgaatcttcatagggaaaccaaactcgagcatctttttgaaagccttcatagaaactgcagaaccaatctttgagcagatcggctgataactttgctccagcatcggccggtgtggatgcgtatactctatatgacatacatcggcgatgagtgcgttcttcgtcatcttctataatcggctctaatctcggaaattcagcttctgtgacggatggccgattaacgactttcatgactattagattcaaccaagtctgcagcagccaccatggtccacctgctccaactactgagccgacagctaacttagccgaagcattattcagcatttggtacaagtagccgaggaggattttgcctaaaggaaattgtttctttgcttccaaggcttcggctatgaactgccagttggttgtagggccacagcttgatccataaaagaggaatttttctagccacattagcaaaaaggccacatgttctcgagggtgacagaaccctggctcatgtatgctgctacatagcctaaccaacctcgtatactcttggttttgaagtcgtattggttcttcatgttcagattcatggggttagccgttgaggtgacatccagacccatgatcataatgatgtctatgagagttagggtcatcggtccttggttgaataagaaggcgttgatggtgttggaccagaagtaagaggcagctgccattagaggttcatccttggctgagtttgctatggttaggtcaagtgcttggccgattccgatttcatcccagtgaactcttttgctagccgacatgcgcttgaaccatgtaatccaacttttctcgggtgatgttttttctagagacggccaagatttaaaggtgttcttccaatgacctagatctggattggacagtctaaaaggaatcctattggtctcaccgatgatgaactcagtggggtcggggttgccgattgggccgagaaagtagtggttttcatgcgacaagcttggaattgcgactaaattggagagatgctacaagttcagagtaaccgagaaaagaaagcagtatgaggcgagagaaaaccgatccaatgatgaaaaaggggatctagccgatggtaacttacctcagcgtattcggctgatggtgcggcagatgggctggcggaggtcgacatcgtcgcaggcggagatctggccggagatgaagtcgcctggggatcgccttgcgcgtcggaggaatcgccggagagagagagggtaaagtttcgcttaagcggggaaaacggaagtcacggtgtgagatttctcagggataacggttagtatttgaagcactagagtaacaatcgggaaaacggcagagtgcgaaacttgctcggagtctatacacggtaaatccggaacattaccaaatatcccggacttggggggcatgtgttacgaccaaatttggtaatatcagcatcggagatgaagatgaaatcgaagcggaatcgaagataagggttttttcggaaacagagtaagaatcggctggagtccggatcggctacgactgggatcggctaagtctgagttggactggttaagtgatacagccgattccgacaatacgacccgtgtgcaacattgggttcgagttgatgtgcttcaagatgattgtcacgcatggatagagtcctgggaaggcaattgtatctattaattaggatattttatgtaaattccttagagataaaatgtgggcaaaagtctgccgcaaagacttatggtatcttagagtttgttagagataagagtcgtgtccaatatggacatatcttgtatttctcgggtataaatagaccccgagccctatgtaataaaaacatacacacgttcaatacaatttcggcgcatcgccaccctttttgctttcgttttatttcgatgagttattgctttcgggttgagctgcatcagtttcgatcttcaacaagaggtaaaacttgttatggcggcttgtgttctcgagattagcgcttccatctttatgatactctaatcttgtttatgtaatctgtcaagttatcatatatcttgcataatccttgacaatatcgtcatttaacctacaatcggctaacatctgctaccagaaggcagccgattaggttaaataacgacgttggcttagattatatgagatatccaccactctatgaaacatccagcggcttgattgtctagatattgttcttctttttatacttaatgctgtatcagttgagtttgatctattaagtcgtgcttagaatttcaatctctagcctacctactggttgccgattagggtagtatcggagtttcagccgatcttatctgatccaattgcttttgttctacatgctcaattaacatgttagatctgccctttatgttaagatcttgttgcatttaagtatattagatttctgtttagtatattctatttgctttaatatcttaatataaagtagtatcgcagtattagccgatacacgctagatctatctgatcggctatgctatgaatatatatataatctcattattaatatatatttcgatctaggtgatttatactgtctcggcaaggtgatcgatctatcccaatcacttgattcaagtatatatcgatataaggattatatatcattgatatctacagccgatcgagtagatttagttctgatttgtttacttaaacaattgccgatcgatttacacatgacatcggctcaaagataaatgatatgtcatcggcatctagccgatcggctatcatttatgaatttaatcacggtttctttgtctttgtttcttgttgattgcaggatcaaatcaactgacacgctcatacatccaaagacgagttttggacctgcactggagttaagcagatctcccaggcctcgtgttttctatcaacacaagggcggccggatccggtggctgctccgctccccattgcgtcggcagatctagagagggaggcgctgcggcagcggatctggcgccggcgatggcgggagcagcaacggtgggcttggccgatgcagacgaatgagcgagtgatggcgggagaggggggcgctagggtttgttttttttttgtgattttttatctttgcatgcggtccgcataaacacccgcatggaaaaatcgctaattttaaagaccttttgatgcaaacggctggctcaacggcgtggaaaaattgattttgaccgtttgagaaaatgtcttttgtattagtgcatggagcaacctgaccttgctgttctagagccccaagcacgtggtgaccgtatctccatgctcttccacctttccctccctcggtccctcctgagcagatctcatcaacattgcacacgtgggggaagtaatagaggcggaacaacgacagtgaagaggaagaagtggagcagcctaggagactccttctgctcatcccatcggctggatctgatggccgtcatggcagggagaagaaaggccttgttgtgccactaaccaggtgtgggtgggaagataggaaaaggtgacgagagattgggaccggagggggagatggaagatgagagagattgggaaaggataagaagcggaggaaacaatggacgggggacttattaggatgtgtttagttcgcgaaaagaaaatttttaggtatcacatccgatgtttgaccggatgttggaaggggttttcggacatgaatgaaaaaactaatttcataactcgcctgaaaaccacgagatgaatcttttgagcctaattaagccgtcattagcacaagtggattattgtagcacttatggctaatcatggactaatttggctcaaaagatttgtctcgcgattttccatgcaaactgtgcaattagtttttatttttatctatatttaatgctccatacatgtgtcaaagattcgatgtaacgtttttgggaaaaaaattggggaactaaatcagaccttagtggctttctttttctatttttcccactacatgctcggcctcggtttggctccatcctaaaagtgttgttttttcaaaactactacactttggttttattacatatcagtgtcacattttttaaaaaaaattgacacctatattattattattggtatcgttttttcaataaatcagtactgcatcatatatgcgggttttaaagccgcctagaggtcgggggatgggaaaggctaatatgtgccggttctgagtgactagggtttttagtagtgctattaggctattaattagctgcaaatgcaactaccgcttgcatgacatacgatcgatattcatacatgactcaggtcatctgatgtgaaaccacttaaaattaattaatctgcaaatttaacaaatagattgaactcggaatcttattaattaatctattctctcacgtcgtcctattcctcaatgcagtgatcttaatattcacatggatatcatcaatgcagagtaacagtgcatgttagggaaggtgcatgtgtgaagacgattagaatattaagattaataatctctggggccttattaattagctgcgaggagtactaattttttttttaaaaaaaagagacgttcatttgatacctaatactccgtacatattaattatatacgtgccttatgtttgactcgatcgtcgccggccacaattaatgttctaatttgatgcatgagattcagttcacattgttgcttggtctttgaatttagtccacttgcattggccttgcaagtgttcgtggaaaatgtgtggcaaatcccgtgtacgtacacaggttgaaattatcatggacgccgttcacacatggctgaaacataatacgcctgtgggagaatgtagggtatcttataccatctaaagctggcaggattgctgcaagttgaattggtttatagggatgctcaatatataaattgttgacgcgtgttgcttttaggagtcatcactcaaaatacttcaagctcatggaaaagaataaaaaattaaaatctagagaaatatagagccttcaaatttggtttgatccaagtgacctaggagtaaacaaaacaatattaaagctaaactaatgataaaaaaggttgaagacacctgtagcattacctgataaaatcaaataaggggataaaaatataaatgaaatccagaaaataataagttaaattctagatgcttcccaactatatgtcccattgtaatctgaagataaatcccctttcaatttcttcttgttcttcaatcaaagaaaagtacggaattacttgagagtaaaatgaaaagaaaaatccaaacaacatcgtgcaagtttcaaaaaaggaagagaaaagaatttggaagaaaaaatgcatttttgcccgccgcaaactgccgccatcttcgccctcccacaagccactgccctgggtcacgagcaagccttgggagcccaaatctagctctaatgaagtggggacgagccatcagggtgagagagggatgacaaagtgacatgagccctcatctgccctcctccatcttaggaccaatgggttcaatgacatcctccacggctctatcctccccaacagccttatctcatgggctacagtaggagatctcgccagcttcttagtataggggagagaagtgcaccaacggtgagggtgagcaagaggtctatcgcatcccatccatggtgtagggcctaacacggctgtaacatcacctcaccgcgtagctgcatgtcgctcttgtcatggcatgtgttgtgagcccaacggcccaccctatagctagcgccaccaccgacaccaacattacgagtgccagagaagttgttgcacgcggatctcacctctacgcatctcgcaagaagttctcatctttctgagagagtgagtgaatagccatgatgacattggcgcgtgaagagagagagagaatgtgcgagtgggaagcggggatcggggtctagggagagaaagagagacagctcatgtgccaatcaccagtgtcacacgaagagagacggcactgtggccgagagactctaatatcatgatagaactaaaagttttcatttctccatttaaaatacttcttcttattatacactacatcaaataaagaatgtttacaaaattacacttatgcaccgtccatgtaaaagtacaggcgacttgcgagttgttatccagaagctgaacaactttcaatgcctccttttaggaaaactaaaaactgcagattcccctgaacagcaaattaaacacgcctttcctcttcgagaagtaaggcaggacataaacgaggaatgcacaccctaaaacgaagtttccagttaacagatgattcccaagttatggtcaaaacaaaaacaaatagtacaaggaaaaccagcatagaatattagcgaagaagagattctctcatagatacacgctatctgcgccatgttaaccccaagaagacgccacaacgtgacacgcatgtggccacaccaaacccccgggcggccatcacgcgtgcatccgccatatacccccggccagcactatttataccccctctctcatcgtttgtttcgatcacttcactacttcagcacacactgaacttgttgcaaagagagacatatagtatatagttagtagcttaatttgcagcgctaataagctctagctttctcttcttcctagcaaattataattaacactaggttctagctagcatgggtgtcgagaagacgacggcgaacggcggcagtggcgccgcggcggtctccggcggagggcgcaccgtctgcgtcaccggcgccggcgggttcatcgcgtcgtggctcgtcaagctcctcctcgagaagggctacgccgtccgcggcaccgttcggaaccctggtatgtatatatattgttatcggtagtttttaagaaatccatgtagattaatacgtaattatgtgtgtattatataaaagtatttttgcagtttgtttggtgttccagatccacgctagctgggtttaatttttttatgttaaatcatagtggtttaaaaattatattttatttaaaatgagattaaaataatttattcaaatgttaccaatataattatgtatttggatttgtagagttataaatatccaactctgaaaatcttagatcaggatatgtcgaacaggaccttcatgttgaaacacatgataaaaaaacatactccagatcttatgagcaaaacagcgtacatacacatgccgttgcagcaatatatcggggatgctgagaaataaagaggcaacgatcaactatcacaatctcctaattttgcaaatcccgatattaatatatctcaaccgtttgaccctcgatcgattaatcttataattaagtaattagcgaagaacacggccggcccatatggctggctgacacaccgcgctcgatcgagaaccctggtagcaacagaaagggtagcaaaattaatcactaatgatgtgattagtcagcgctagctaattaattctagtttctttagctaactcattaactaatgaattacttctaattaattgctgcagatgacgctgccaagaacgcgcatctcatggcgctggccggtgccgcggagcggctgaccctcgtccgggcggagctgctcgacaaggagagcctcgccgccgcgttcgccggctgcgagggcgtcttccacaccgcctcccccatcaccgacgacccggtacgtgactcatcacctgcaccagccggccgccggcgacgacgagacgacgtcgccgtacgtgttcgacagtctaagagagactgaccggaatgcatatgctcgcaggagaagatgatcgagccggcggtgagcggggcgaggaacgtgatcaccgcggcggcggacgcgggcggcgtccgccgcgtggtgatgacgtcgtcgatcggcgccgtgtacatgggcggcggcggcggcgaggaggtggacgagacgtgctggagcgacctcgaccactgcagggacaccggaaactggtactgctacgccaagacggtggcggagcaggcggcgtgggagctcgccaaggagcggcggctggacctcgtcgtcgtcaacccgtcgctggtgctcggcccgctgctgcagcgcggggtgaacgccagcacgtggcacgtgctcaagtacctggacggctcggcgcgcacctacgccgacgcggcgcaggcgtacgtgcacgtccgcgacgtcgcggacgcgcacgcgcgcgcctacgagtcccccgccgcgcgcggccgctacctctgcgccggccgcacgctgcaccgcggcgaggtgtgccgcatcctggccgccctcttcccggggtacccggtgcccaccaggtgcaagggcgacgccggcgagacggccgaggggtgccggttcagcagccgcaagctggcggagctcggtgtcgccgtcatgccggcgagccagtgcctgtacgacaccgtcgtcagcctccaggacaagggcctgcttcccttcgtccctgccgccgccatgccgtgagctagcgatcgccggcgcgccgcttttgttttacataccgctccggccggccgatgatgaccacggcgacgtgtcgccaccggctggcctgcgtgcgtacgtgcctgtatgttcgtcggaagatcagaagttgtacaactgtatttctcctaagggccggtccttttcggagcacctataaatcgggcaccgattagtttgtcaaaaatagcgtgctgtttcactaattaaaaaaaatgtttcaccaactaaatcgaaaatgtttcaatcttttaaaacactgaaacacacaccgctagaaaatcgcttttccaaacggaaaaaggaccacctacacgcaaaggcatgtgaaaatagatgattttcacaggcggcccagcgaaaaccatttttgcaggctgcatctattttcgcaggcagtagaaccaccctcctgcgaaaatatttttagcgaataaaaaaaaatccgccgccaccaccctaacccgtcggcggcgccgccagcctcccctcccctcccaggatccaggcggcaacggcggcgtcgtcgttgttgttatcgtcgtagtcgcggtagtcgtcgttgtcacggccgggcacgaaggagtagagctgcgggagaggagagggagggggagccgcacctcccctctggccgcgcgccaccgccaaagctcccctccccttcccagatctaggtggagtcattgtcatcgtcgtcgtcgcagcgaatgtcattgcggctggccgcggagggagaggagagggaggggagccacgccgtcgccgctgccgcctcagctcctctcgctgctgcctcccctcccctccccggatccaagcggcgtcgtcatcggcgttgtcgtcgcggccagcagcggagggagagtagatctgagggagagggagggaagccgcacctcccctccggccgtgccgccgccgacgccctcctccagcaccgccccttccctccacccacgccgctcttatgagaaaaaataaaattagagatttgtcacaacttatacaatactccttctaatccaaaatataagccacaaccacctttaacccaaataaaagaacaacaattatcgcctcctcatttggaacacctcctcatttggaacaccttaaaagatacaatgcatgcaaccaatataattagagattttgaaagtgaagtaaataataattttaagggcccccttgaatcgtaaaattgagaaaacataggaataggaaaaatgtaggattttgatagaaatgtaagtgtaaaatagaggattgcaaaacatagaaataaccatttgattggaccacgggtaaaacgcaggaattagaggagagataaaaactgaaaggaaagtttccacaaggttctaccttatgttagaattcctccaaaatttgcatggtattatgcattctatacgaatttcatagaattccataagatccattcccttgattcacagggctatataggaaaaattcctacaggaataaaatcctctaaaattcctatgaatttcctttaaatcaaagggggccttagtaaagaagaggtgctagttaattacactcatgtatgcacgtcttatattataaaaaaatttaaaaatatagttggaccttatttttttaatggagggagttggatagtaattaacttttcaagagatgtaatctcattggaacgtgagatgtgccccattcttagtacttatataaaagccctctactttttgtgaaaatcacaaaatttcagactaggctttaccatacgatgtaacgggtgaggcttgatccgaccaacctctatataagggccaaggccggttctattggaagcaatctactttcaacacaatatagccaattgaatcatttttttcgatattgcatctacttttcgcctagtttagcttagttttgtccatctttatctatttgcgttatgaatcgtccgcattcgctgtgagagtgcgaaatatctttgcaggtttgtcccatagaccttctattcgcccatgaaacatgtattcatctttagttccatctaaatcgactccgctggccggttaatatatcgaaacccatcttgatctagtttttttgctaggttggggtggttagcgactccataccaccgcaaggctttaggtatcctaatcgtgattgtcttcttgccaaaaaattccactaaaaattcaattggtgtattaaagcatagggaactcaagaaaaatcccaccaagctatttccatttattaaataaaattattaattagggttagctcaaggttaaacttaaacaatttcttttagcgatttattaaatgaattaagaccagaaaaaggaaaacttcagggcatgacatgcattatgccttgcctccgagagcggtggcaatggcgcacgagggacatgggcgatgccacagccatacaaattagtcaaaataccatctttaaaatttcaactaacttttcagccactcctgcaatttcaatttaaaggtttaacatatgtctacaatgtaaataatgatacccgtgcaatgcaagggtcaacaacgactagtgttacataattctccatacagtgagaactggttctccttatacgcttattctttgttgaaagtccacacgagaaattccacattaccacatagcatgctaaaggtggcttataggaaaactagatgttttcccgaagcagattattcaaacaacctctcaagaaacatagagaaagcatcaaatagtgaaccctgacccatcaaacttctcgttaaggattgagtccaggtgttgtcccatctcgagggtcatatggttcagccaatctcctgccactccctttctgaagtaggcatcgttcgagaacgtaatgccgacaccctggtatccttccctgttgatcttttgtttcttcatgctctctaggctgcaaagctctacgatctctgcaacaacacccgtttcttcttcggcatcagaaatcggctgcccaaggaactctgctaattgcctaattgtgcccatcggatcttggagcatctgttcatatgttaggaagagtaccctacttggctcttttttgcttgcgttccagtagccgaggatgtgatcccagacaggcccacaggcagaagtgccctcgcagatagacttgtacacctcggagaatggcacatctgatccaatacgtttgatacgcttgatgaagtgccatgtggagactgctctgtccttctcatctctgcaaattagcatgtcagcaacaaattttaattcaagagatgcaattaactcttaaacttttctaatagtgaaaaccaaaagcacggcatgcattgatccacgtcatccaaaaatcatgaacgttggatcgcactagtaggaaaataatttttgcatgtcccctaccttaattccagaggtggacgaagatacgaatcacctgctttatgtttaccatggtaggggaggtccacgaccgttatgtaaacaaaataccatgggcgactaccttaagcgccctcccaaggtaacatgtttttttcaggcaactgtcttataactctacctatgaaaacattggtttatttacatgtgtgatgcagttaataccctgctcatatcatgcaatttttcaggttgtgccgttaaatgcccacgcccacctagggtcggagctagcacaaaataaaataaaggagggttcctcttgcttgctttaccctggtttgaatcaaatttagcttaatacgggtgcctaactttgaactaatagagtatttatatggtgaaaatagataaactataagtaaaaaaatttttgaaccgggtttctaggcacctcctagctgtatgtagctccgcccctgtgtccacctatgtcatgtcttgttcatcttccttgtatgagatgggtaatcgactagtcgtggggccatcgcatgaggtgaagtctagggcatcaaccagctgggaggaggaggcacctgtagaggtggaggagaaggtgcagccagagtcctcacatgaggacccggtcgtccccattccccaagcacgcactctggtatgggccgaccactagcgccatggcaccggctgaccgggccctagagtgtgctccgacaggggtcggccataaacgttggctctagaggcaaagagattatgcagcaactaattagttagtcttttttttatcatatgcccagggtatgacaagtagtatgtaattagggataaacttttgctttgtattatagtatcttgtttaatatattaaatatttagtagaaactaatatatatatgttaaatatttttttcgaaatataccaatgttccatctcgaaaatattttatcgcgggctattgacatgtggaccggtacaagtttttggcttgtcaatgacatgcatcccaacatctttctaggtggctttcataagatatttttaatagataataccgtcgacttttagcatgatatttgactatttgtcttatttaaaaaattatatacatgttatttattttgatgtgatttgttttattatcaaagaaacttttggtttgacttatagtttagcatatatttacagtaaatttttaaataacacgaatggtcaaatgttataacaaaagttaatgacatgatatgagaaacatcagacattgtatttattctatgttgaaaatgttgctatatttttctatgaattttaccaaattgaagaagagtaacattgctgcaaaaaccctaataaggactggcatataggtgccgatttatttaaaaccggcacctatgccccccttttccaccctgcgcgcaatgaaaaaaatataacctgtacctttaaacactataggtgtcggttcaaggaaaaatccgataccaatactgtatatgttggtttctagataaaccggcatctatacttatattataggtattggttctagaaaacaaccgataccaatactataggtgtttttttaaaagaaccgatacctatactagtatagatgccggttcttttaaaaccagcactataggcgcctgttcttttaaaaaatggcacctattaaaaaaaagtccactgacgcactgcaagtcacaaccttatcccctctccgtctatctctctctcaagtatgccgctcctctccgtcttcttcgcttctcaacaccgttgggtggttctcgtcaccttgaggagcggcgaggtgatggtgggttttctcctcccagccttcacctcctccagatcctcctccgggccttctcctcctctagacgcaccaacggcaacagcttttcatctcctctcctctctgctgccttcttctctccatccgacaacagcgccaatgatggagaaagccaacggcagtggctacggtggtgaaggtggtgaggtgtggggtggcggtggccgggattttttttattcggtgaaaactataggtgccggttccagatccggcacctatgcaccctggacataggtgctgaccaattggttgaggtctttggaacgggcactgatgattatttgtgcagtgtaaacaaatccaaaactggagggagtaggaaaaagaaggtacctgcaaacatatacgatcttacaatcatcattgtcggttattgaagaaggcagcagcgagagtggcaggtgcgtgttcaagagcctcggcgacggcagcttgtccagcacaccctcccgcccacacgcgaacaggccactctccacggtaggcacgcagtcgtgcgagttgaggcggcggagcgggtggtcggggctcgccggcgggaacaagccgcgcgccatggtggcgaacgcgagggccttgagccacgtggtcccggccttgggcagcgtcgcgagcacgacgtcgccggggcgcgccacgaagccgccgcggcgctcgtcggccatggcggccgtgccccgcgcccagtcctccagcagccagaaccccctgtaggagaggatcgggaggctgttgttgtagacgaggcgcctcggcatgccggagatggcggcgtcgtgctcagtgacggggcgagccgggatggcgtcgacgccggcgacctccttgaacgggacgggccctgcagcttgcccatcacggtcagggagtagtgctccttgcacttttgccatatttggagccacggcgagagctataccaatctgagctatatgcatatggttgggacttggagtctaataaagtactacctccacattttaatgtatgacgctgttgactttttgtttaacgtttgactattcattttatttaaaaaaatttatgtaattattatttattttattatgacttgattcttcatcaaatgtttttaaagcatgacataaatattttcctatttacacaaaaattttgaataaaacgaatggtcaaacgtcagtcaaaaagtcaatcgaaaagtcaatgacgtcatacatttaaatatggaggaagtagtatatattgtccacctttgctgacccgatcttatcaagtacagtactagttagatgcattaatttagttagctcagggaaagcacgtgcttggcagatattgtacccttatggatcacactgtccttccaatctcctacgcgtactcccaccagatattctacgatgctgatctagtagtaactagtaccacgtaccaacccgagatatagatgaacagaccgaaaatgtcaagcaagttagatggacagatgcaagcccgccctagctagggattaaaacggagcggatagtttctattcgctgtggagaaaaataaatacggattccttttgaagcggataattctcgaaaagtccggacacggctaatctttccgaatgcgaatacgaatatggtatcggggtttctaacagacacggataataatatgtatatccggtgaacaacactatttgatatccgttgaatccataagacatatcacatttctttataactctacaaccttcaatctatctttttagatttttaataggagaccatctcttaacactagtccacattattaatattatttgaacttttaatatctttgataaattataccatattttaaggaggtaactgctggggcgaccaagatgagcttacatgtggaagctggggcggttcggccgaatttgtggtcgggacaaaccactttcgccgcctttagaaataattttaaaagcctaaaacaagagatctaattttaagttaataaactccaatataacagtaggctagataattttttaaaacacttctattgtttctatagttcctaaatttttctgggatttatttgagccaaggaagtatttttaataaatagaattgcatttcatgaataatttaaatagaaaaagttttaaaatctctcttttgggtttggcctttctctctctccccggcttgcgcgcgcttggcccatgccggcccagaccgccgcacccctccctcctctctcttttccgctgataggtggggcccacctgtcagtcgtcttcaacctccagccgccatacccgcgccgcaagctgccgctgccccttccaaatccggccacccctttccatctccggccaaattgtttgaggggaaatgatcccccggatctcctcttccttttcctttttggaactatcgcaaatttctatggaaatagcccggattcgaattcgattcttcccctctaaccctaaatcttccatctcgccgggctcgccgtgggcctagccgccgcgctttgccgctataaaatgacccccgggacctcgtccattcgccaccatcctcgccttggcttgccgtagctggtagagccgcctccgccctagctcgtgcgccgccgccgttgccgcgtgtccaaccgtgccgcgccaccactctagtcgccgtcgtcgctcggggttgccgtcgccggagcggcaaggtcatcgccgtcatcgtcccaccctccgttttcaccgaagaccgctggaccgccgtcgtcgccaccgccacctcgacccgaagaccatcgccgttgacccgaagaccatcgccacctcgacctcgccaccgtcgccatctgtcatcgttcgtgtggagattatgggtaccccatacccacacggcatggttattagactggttataggagataacttatatctatggaatatgtaacggatcatgacttgggtattacgtttccctgtatattatggaacggcctaaagtcctagtttgataagattgtaaagtagatttaggaaaccgataccgtattgattaaggtttctatcttgtagtcctgccccccatcctatataaggtgggcaggaggctctatatggggcatgacacacaaccagatcgtcagatctacaatgcacttggcggattcaaatccccaaacaggagtagggtattacctctcattgagagggcctgaacctgtctaaatccttgtctccgcatccatccacttttaggtctcgtgcgctaccccttttattattgctgaattcatgtttcgacagttggcgctccaggtaggggtacgtcgagttcctatcaaagaagtgtgatggaatcaattccaaaagcagggttgagattaatctcaacaatttcgaccactccaaacgtctactggtttgtcgtttcaatatattgttattagattgattcttctaatcatggattgctcttctgtgagacgctttgtttgtgtgcatgcactggcggctgatgagatctgctgatcgcctccggataaccatatgcaccatggctcggcgttggcggagagcttctgcgtccgatcttgccctgcgatttggctgaagtcggccaatattcaatggctgatctaatagagatctataatgagatttcggatagcatcgcttactgccgtgtcgagttctcaaccgatcatctggccggttacggcgattatattaattaattaattattatttttcactaatcacaagttaatttgtgatatatatttttgcatgtctaatgaacggttgagtccgattcataagaagacaagcttcccaactagattgcacgagcatggattggtcaggcgatgtgtggatgcatatcaagcgttcatgctacaggagattaattggccaatcaatatatgcgagctgcatatacgcattgataaatgcaaacgtatatacacaagcttctttatacctgtatttattttatgtggtactgaacagattaatctgttagttgatttattttgcatgtacccatgccaattgtctctgtcgccgctgctgggcatccacatcttcaccgccggccccctcgtctgccgccgactggtgtcctcgcctgcacggccggcctattatgccgccgtttttgggcgtctacgtcttcaccgccggccgcctcgtctgccgccgactggtgtcctcgcctgcacggctggcctattatgacgccgttgctaggcgtctacgtctgcactgttggcttgctttgccgctgccgactggtgtttccgtctgcacggcctatgccgccgttgatgggcgtctacgtcttcaccgaccggctggccttgccgccgccgactggtgtctctgcctacacggctcacctattatgccgccgttgttgggtgtctacgactccaccgccggcctgcctgcgtcgccgccgactgatgtcctcgcctacacggttggttggtcacaccaccgttgttaggcgtccatgtcttcaccgaccggctcaccttcgccgtcgccgactgttgtctccgcctacacggctggcgttgttggacgtctatgacttcattgctgcccagcctcgcctgccgccgactagtatcctagattatacggttggttggtcacaccaccgttgatgggcgtcttcgcttacactgccggtttgcctttgtcgctgtcgactggtgttttcgcctatacagttggcggactccgccgccattgatgggccttgtcatctacaccaccggcttgccttcaccgccgttgcccggtgtcttcattgttattgatggacaactttgctcccacatcagccacctctgccgtcatcaagaggaatattacaaagctaagtcattattttttttctttatatgatattttccttttcctctgtctcactatgtcaactggttcgccgttgactagcgaatcaggggctacagacgttatatcatatttttttaacaaatatcataatatttatcttgattgcttgcgacataatctgagtacaaaagtgcctatcgagttatggagttctatcttcctatgctttccgtttggtttgtcgatggatagttgcctttgggctgattcctagcacccgagggctcgttggatggagcgagtaacgcaaggtgctaagtattattcggaataaatcaaaagcatagagataagataaatttaatttctgctctttacaattgcaaaagtacccgagtagtaaattatgattcgtaaaactttgttccattaatgacgaactcatgtcactcatatgcatgtttgggaagtgcctagaccgactcccgatgcttgggggctatgactagtcggacagagtgtttaaacgtacagagtcatctgctcggggaaatcgaaattgagtagaggagaaatatatatttataaatattttaaaatacttgaatattatatatacatcagatactactcatcctatatgcttgttctgtaggatccagatccagatatgcataaaagggattcatggctttaagcttatctcctacgcttcaggattggatcagtcagaacatcaccaccggcttgccttcgccgctgccgactggtgtctccgcctgcacggctagcctattatgccgccgtcgttgggcgtctacgtcttcaccaaccggcttgccttcgtgccgccaactggtgtctccgcctgcacggctggcctattatgctgccgttgtagggcgtttacgtcttcaccgaccggcttgcctttgctgccgccgactggtgtctccgcctgcacggctggccttttctgccgccgttgttgggcatcatcatcttcaccgaccggcttgccttcgctgccgtcgactagtgtcttcgcctgcacggctggcctattctgccgctgttgttgggcgtcttcttcttcaccgaccggcttgccttcgccgccgccgactggtgtctctgcctgcacagctagcctattctgccaccattgttgggcgtcttcgtcttcaccgaccggcttgccttcgccgtcgccgactggtgtctccgcctgcacggctagcctattctgccaccgttgttgggcgtcttcgtcttcaccgacaggcttgccttcaccgccgccgactggtgtctccgcctgcacggctggcctattatgccgccgttgttgggcgtctacgtcttcaccgaccggccacgtcgccgccaccgctaataggcatcatcatcttcaacgcaagctgtctacgtatgatgccgactggtttcttcacttccatggctgcatggttctgctagtgttgattggccttatcgtcttcatcgccagtcgtctcgtctgctgctgactagtgccctcgcctctacggctggtttataccgcaaccactactgagggatgtcatcgtcttcattgctggccgccttgtttgacatcgactatttttttttctggagctgaccggagtatctatcttcacgactacacatcttcgccaccggttttcttctgttgctgccaacttgtgttcacgtcatcacggctatgcaactttgtcaccatgtggagcgacttcaccttcattattttcgacattggcaaactctattgcctctactttgcaagatttgctactttgtcacaccctgaaaatcctaaatttatgaattgttgtttaaatggaattattagaaatgattttaaaagcctagaagaaaagatctaattttaaataataaattccaatataaaagtgggctagataaaattttattaaatacttctcttaattcgatagttactagatttttctgggatttatttgagccaaggacgtatttttaataaatggaattgcatttcatgaataatttaaaaagaaaaaggttttaaaatcctcttttggctttgggccgaaagtcggcccaattcactccctctctctccgcggcctgctagcgcctggcccatctagcccgccgagccgcgccgcccgctctccctcctctctcccaccgacaggtgggcccacctgtcagggccgtcgtcttcctcctcacgccgcagccacgccctagcgcgccagccgccgccgcccccttccaaattacatcgcccctttcccgatccggtcaaattggtagaggggaaatgatccccttgatctcctctatcttttctcctatagaaacttcatctaatttcgtttggaaattgttggattcgagctcaattcggattcgttttctctcctctaaccctaaaccttccatcgccgtcgccggttgccgtgggcctccatcgccgccctctagcccctatataaggacccccgggacctcctctcttcgtcgccaccctcgctttagctcgccaccgctcgtagcgccctagccactagagcccgtgcaccgccgctcccgaagggagtccagccgtgcgccgccgccgctccgttcgtcgtcgtcgctcgggaaggtcgtcgttgggatcgccaagtcgtcgccgtcctcgtcccgtcctccgtttccgccaaagaccgccggagcatcgccgtcgttgtcgacccgaacgccgccgccgcttcgacctcaccgccgttgccgtccattgacgtccgccgtcgtccgagccttcggtgagttcaccgcgtcgccctctacccgtagatgccctccgtttgcgcctccgcgccgtcgttcgccggcgagcccgaggtgccgagccgtcgccggtgatgacgtcatcgctaacgtcagcgccgcgtcatccgtagacccgcggtggatcgaatcgatctcggccgtccgttttgtttagattagatctcggccgttcgttccgtagaccgtccctgtgcacccggtccaccgtgaacccgagccgatgacgcaataaatcctttttccttttcaaaaatagttctttattccgtcataattcaattaaaatctatataaatgatttaatccaatttaatctttaaaaattcataactaattcatcttagcttggatttagttggttcaagtctctaaatttttctaaaattgagatctacatgttaaaaatatccacatgtgctgtttatgattgtttatgtactgttttggtgattttgttcttttatgcttagattccgacgttcccggagagtccgattttgcaggagaagattttgaagagttccaaggccagtaaggcaagtcacacagatcccaaaaaaccctttgagcatgttgatcccgtttaaagctattgtttctattcaactatcgcatttatttttgaatgtcaccgggtgggaataacctattgccttgttatagtctttttgttattgattacctattctttgtcatttggttaataattggattagctagaacattatatggttttagctaaagtgcttaggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcacatggttttgatggtcgtgctcatgacaattaaggaccagttcacgattttcggttgtgaaacattaaccgtgccaaccacaagccagcgtgggcaacggctttactttttgtatagtatggttcattgtagagcaccagactgtgaagtggcggagataagcccacaggggtcgctggggagtccatgccttgtttataagggggtgattatgatccaggaagggtgcactgctttgaattgtgttatgcgaagggtattgtcacaatctctattcgggtacttgttaagtatcgcgacgcatggttgacatgatgttgaggttgtgtcttgtgggtacagtggtacacctctggccagagtaaaactattcgaatagccgtgcccgctgttatgggcgggtctaacaatgtcattcgtgattagtttcatacatctcaccataataaatgatactgtaattggtaataacttgtttagctcctggtttggaatggtatattcctggtttggagatagaactgtgccgctgggaatggttgttaagaatggttgggcctatgcaacgggtatgttgtatagcgttggattaatattgtgtaattaaatactttactgttttattaaattctgaagtatttattaaatgccatttatgcaaatgagactatattatgccatcctttgttatcccttgcatttgcatatttgttgtgtggcttgttgagtatgtcatatactcaccttgcaatcattcatcagaggaggagttctacagtgatgctgaaggtgtggaggattaggcgtagcccttgtcaagctgcttgtgggatggagtcgcctgcgctgtttatcttattttccgctgcttagatttttattgtttggagtaataattgcctctgtaatgactttatattcccttattaattagagtaataattgcactctattatcaatttgttattatgtgcctcggctgattcctggacgagaatttacacacatgtaagcgtttggaattttggatagaaatttcgggcgtgacatacttcaccaaccacaacgtctacaagagcttcgacatctcagcatgcgtgaccaaatatgatgccgtgttattttactactacaagtggttttccaatcttcaatatttctactcggacatccccaatgcatatcttcactcaagtgatggctactcgatgacaagaagctacagttcgcgactctatgttcagttgtttctcaactaaccaaagagtcgggggctacacaaatacaagactcaaaattcgacaagctttatgtcaagacaaagcaatcaatcagccaacgagttctatggaatctacttcgggagtcatcagtttcgtcttcacttaagagttggcgttctacttgagaaactccaattatttcaccggcaattttggcttctccatgctgccacaatatactccaaatttctcaagtatcaagtttgagatgtaatttacatgtctgggagtttgatggattattatcattg

SEQ ID NO: 47038 - DNA, 3603 bp, Oryza sativa
cctcatcgttatcattgactgctacaccgctattgactggatcaatgatatcatcgtcttcatcaacatcctaccatacctcttcggctatgtctactctactgtcgttgatgcacaactttgtcatcatagtcgatcatctctattgatgctaatcatcattaccgtcggttgcatttgccatcgtcgactattttcttcatcttcatgattggtggatttcgccattgccattgatgagcgtttacgtcttcaccaccggcttgcctccgccgccattcatggtgtcttcgctttcatagctggtttattatgcctctactgatgggcgtcttcgtcttcttcaccgggcgcctcgtctgttatcgactgattattttgctgtcgtggctgcacaactttgtcgccgttgttgggcgccttcgtcttcactgctggctgacttgtctgctgtcgactggtttcttcgccaccaatggctatgcgacttcatcacctttgattggtgtcattgtttttatcatcaccaacattttcgtcacctctgactggcgatatcatccccatgttcgtcatcttgccttcatgtcgactacatcagctattgccaatggataattttgactatggcagaaggacaagttatatatgctcaggggcttatgaactcaaacacgaggattatatcttcaatttggacttgttccggatacattcaacatgaatttatggtcatgagtcgatttcttatgctcaacgactggactattcattatttcccatgagggccatcagctgagtgcttgcaccagtcgggattcaattatcacatttactttggtattctccatgagggacaattacgcttgatctacatcacccaggatatttatcacttgggatcatattatttggcgtgttctatgcgtcatcctttaaagggtgtcgaaggcatattttttggcctaggcctaatatgtctgcagcccatattatgagatgtggcctgtcacgttcttttagggacttaggcactttttgcttaggccaaagtgcgcgtgatccagtgcccaataccttaaaatccttttataccgcaattactcaactttttaggagttggtacaatgcatcttaaaaggtgtcaaacagtaaagctttatatagctgccccgctgacttttttatataagtcaaggtgatgtttgagtttttaagcaattgattggatacaatatcgttgctttttgccacgtaagtgtgcatttttatttactaatattatggcttaggctgattatatattgtggtcattttccaagcggttggtaaatcatttttgagtttatttactcggatttcataccacatatgccatatatttccaggtgtggtgaaaccatgtgtcttttagggacttaagcacatctgttaaagcagtgtgcgcatggtgtgtgcccaatactttggaaattttttattcacagcatataagcttctttatagctgttttattttcaatgatgtagtcaactttaggttgcactcatcatattttacaaagcagtcggtatatcacttggatcatgttatttgggggattcacaccgcatatgctatatattgatatcaagtcatttggttgattacaattatcaaaaccactcggttggttggattatttattccttgactatatgcttagtttgttcagctaaccacatagtcgagggctacacctattaggtgcatctagtcgatgcacctgactttatttttcagccctccatagtcttcatatttggtaaaagtactcgggagaccatggcaaagatgattgaagaacttggctttggagtaatctggttcgagagaagattatcttttcgactatgaaggtctcaggggctactgtagagattatgggtaccccatacccacacggcatagttatccgactggttataggggataacttatatctatggaatatgtaacggatcatgacttgggtattacgtttccctgtatattatggaacggcctaaagtcctggtttgataagattgtaaagtagatttagggaaccgataccgtattggttaaggtttctatcttgtaatcctgccccccatcctatataaggtgggcaggaggccctctagggggcatgacacacaaccatatcgtcagatctacaatgtacttggcggattcaaatcccaaaacaggagtagagtattacctctcattgagagggcctaaacctgtctaaatccttgtctccgcatccatccacttttaggcctcgtgcgctacccccttttattattgccgaattcatgtttcgacagttcgccgtcatccgagccactggtgagttttccgcgtcgcgctctacccgccggtgccctccaattgcgccgcctcgttgtcgttcgccgctaaccgtcaggtcctgagccgccgccgccgccaccggtggtaatgttgttgtgatgtcatcgccacgccagcgccgcgtcagtgccacgtcgaccgcatccccgcctcgcccgtgccacgtggtggaccgtttcggtgcacccggtacaccatgaacccaagcctgctgacgcaataaatctccttttctttttaaaataattttttattgcgttataattcaattaaaatctctataaataatttaattcggtttaaacttcaaaaattaataactaattcaccgtagatcggatttagttggttcaagtctctatttttgattgattttgttcttttatgtttagattccgatgttcccggagagtctgtctgtgcaggagaagagtctgatgagtttgaagggcagcaaggcatgtcacacagatcccaatcactctttgatcacgttattcccatttaatttctattcaactattgcatttattttttaatgtcaccgggtgggaatgacctattgcctttattatagaccattgttttttttactcaaagacaggggggaagcccccacggttaaattatattaaagaaggaaaaaataatacacacaaagaaacaaaagaagaaagcaaagattacagattgtcaatccatgattgaaccgtgggtctatgaacttctctgaacctaattaaatgtaggctcaaatcctccttcaaacccttcctccaattgtgaactgatggctgaataccttgaaaaataaggccatttctttctttccatatattccaggctgccagtagaaatagttccataaaactatactgagaaaaggaatttctttgaaccttcagcatttgatggtattctaatgaggagttccaaacccagcccaactttctccaacatgacttgctgaactgacattgaaagaagagatgatcccttgtctctcttgcattaatcccacatgtcaaacaataggcagtggcattcaaaggaatacaatgtttcctgtcaagaagatacttggtattcactctatccatcaacagtagccatccaaagactttgattttcatgttgagcttactttgccagatccaattaaatgaacaagggggagataaggaccaaaaggagagcttataa

SEQ ID NO: 47039 - DNA, 2343 bp, Oryza sativa
aaagaggtaaaatgaattggtcctgtggatttctttgaagatcctgagcaactgaatcccccttatgcttagcaaaggaaaaaagcctgggatatttgacagatcttatattatcatgccacaaatcctcccaaaacaggactgtcttgccagatctcaaaatgggctttgcaatacctctaaacaagacatcaaactgaaagacatctttccaccaaaaagaaccacaagaattagccacttgggggattatatttgagtaatatgaagaccagattaaattcacccaaggcacattatccttattataaaatttgtgcagatgtttcatgaggagagctctgttttgaattctaagatcaatgactcccaagccccctttattctttggcttgcacaccttgccccaagctgccagagactttttggtggaattaaggtcattacccctccataagcaatgccttctggctctatcaatattctcaatgactgaaaatggcagagaaagcgaacacatgtaatacgttggtaaggaggagagtactgagttaaccaacgtcaatctatcaccataggagagaaaagaagaactgactgttaatcttctttcaattctatctgtcaatggggcaaaatcaatcacctttggtctagtggttcccagcggcagaccaagataagtgaaagggagagttccaatggcacaaccaaaagtggcagctagcaagtgagctttgtcatcctcaacatttaaaggaatcatacaggactttgaataatttactttcaaaccagaagatatggcaaatgagtttagcagagctttgagagcaaaaagctgaggggccgaagcttctaggaaaataagcgtatcatcggcatattgaataataggaaagttattatctcctgaaactggaattggcagagagagtatccccctgagatgagctttgttaattatggcttgtagtaaatcagcacccaacgcaaaaaggagaggagagagaggatctccctgccgaacacctcttttacacttaaaaaactttcctgggactccatttaagagcacttttgtagaagcagaagaaaagatgttactcatccaaacattccattcatccgggaagcccatagctaacatcacttgaaggatggcaccatgttcaattgtatcaaaggctttctcaaaatcaagttttaataaaacaatctctctttttgactgcttgcactgatgaatgtattcaaaggcccaagctatgcagtcttgaattgatttaccttttataaacccatattgattttgatgaaccaaacttggcatcaacgattgtaacctgtcagcaaaaaccttgcacaggattttaacagagaagttcatcaatgagattggtctataatcactgggggtttgaggacttggtttctttgggaccaaagtgatataggaaaaattgatagaagacaaatccaccgaatttccccaaaaatctgagcaaagcctatagaagtcctgagctatgattggccaacttgatttgtaaaaacacccattaaacccatcaggacctggggttttgtcaccaggcattttcctcaagacaccatcaatctctttggttagaattagtgcacacagagtagaaaggtcccccttatgttcaatcagctcattgagatcaaagaccatagaaggtttcatagaaactcccattctttccttaaaaacattctagaaaatatcagctttcccctcgtgatcaaaaatttggtttccatctgaatcttgaagacaagaaatagcatttcttctgaaactttctgttgccatagcatgaaaaaatttggtattttctcccccaagaagaaccagcttttgtttaaatctctgcctccaatattgttcctgccaattcagcaacctttgaacacgagccttaacaagcaatctgaatttcaattctgggacacatagcaacctcaattcctccaatttatcaagaaagagaatcactttattgcaactttcgatggttttcgacagcttggcaagggaggaactccaacattttaggaacagagccttttgaattttgcagctataagctttgcttgatcattgatattttcaatatctctccaagcattagccactagatgaaaaaacccttcttgatgaatccagtaattctcaaaccgaaagatgttggacttaggaatcgaggtggcaatctgtattttgattggagcatggtcagaagtatttctagccaacactagcgcctaggtgttgggaaataaactagtccaattcgcagaggtgaaaacccaatc

SEQ ID NO: 47040 - DNA, 1297 bp, Oryza sativa
  unsure (1)..(1297): unsure at all n locations
nnnnnnnnnnnnnnnnnnnnnnnnnnnnnnnnnnnnnnnnnnnnnnnnnnnnnnnnnnnnnnnnnnnnnnaccatggcagcatactccatccttcaactactgtagaattcatgtttgagaagtatagaaaggtttggtctttgaaacctgtctaaaacattgactatatggcttactttttttttctaaaacataatctatttttgcaaaatatatatactcaccgtatcgacaaattcatgattttgcaaatttccgtatccctgtatcgtcataccagtatcgcgtatctgtgcatacaccggagaggaggaagatgcaagccgacgcgattcaaattaagcctacgggaagccccgtttctgcgcttggagccgagctcgcattctcgttacgttgctcctggagccgttcgatcgctgggctgtccacgcgttgttcatccagaatggcattggtgactcatcatgctgataagtggacccgtacatatgcctcatctatctattatctatctatctatctatctattatatactaaagtccattaaactccctataaacgctctcaagctgccatgtggctccctcaaaacgctctcatattgccacgtggcactctaatataatagagaaatctgaccatcaattttcatttaaatcggtggacccattattttacatcgttagatctattttaaaaaccaaaaacctcccaccggccccaccacctctgtttagtacttttttttttcgtttgttcctttcttttctttttccaatcctaattaaaattgaacctatctttatagaaaagaatacccccacaaatagacatcaaacgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactccaatatataaccgttgatttcattatatttgatggacccattatttacaaccattaaatttatcttatagaaaaagttaaccacccaaacctaaccccacccagcgtacgtacttatatctcatatacaactacctactatatatgaaaataataataatatacctcatgtattattattattattacaccaccctcttcctagattaactcttccttctcatattttt

SEQ ID NO: 47041 - DNA, 1268 bp, Oryza sativa
cccctggtaattatgaaggttcggccgaataccacgcgccaaatgctcaggaataacttgaggcaccaccgaaccatccggttgcacatgatgaaccaagtgttccgggaccacctgatttgcagggtactgcacaggctgaccaccaggcattgcaaacctagccgacgcattcattggggcttgttgctgaatcggctgaacgacctgctgtctcaacggtgtctactgaattggctgtaaagccggttgccttggtggcgtctgctgaactggttgcacggcctgctgaattggggatgcttgttgaataggctacacaacctgttgcctggacggtttttgttgaatcggctgctgctgagccgaattaatagcattttgaggaggtagaaacatagatgcaacctggtcttgtgttaactgagtcacattcggtccaggatgctgtgattgctctcttaccaataattggggattgattaattgacctggagccgatgacggtgctgcaggtgctggagccgatgctggtaccgtcgattgagctggaggagttccccgggtaagtggatgaacatcggtaatcaaagtccgataatttggaaaagtacccccttgcaaatagactgggcctgcagcctgatgttcagctattgaaccatcggctaccgatttcatcatatttgacaaagtattagttaatactccagattgattgatcaaagcaatatacacagcatagtcgacccgatcttgaaagttattgaaaaaatcttggaatgcattgtcattctgattaagattccccccttgcaatccctgagtgccgtcaccttgaactccatgtactccatgagagtagtcaccctggctctcctgagtcgacccatctgtaacacttttgtcactcggctgggctgatccatctggaacttgtttcttttctccctctttagacgaaccgatcccaagatcctcaggaaccaccttcaccttgtacttctgaacaaatgtgtcgttgcgagtttgcatgaacgagcttaaaaattgatcccgtgcttgctgcatcattgcattgaagtctttcttctgttcgggagtgagcttctctggatcaatgggcacaacgtttccttcatggacgtcagtcaaaccgaacttctgagtcttttccttaactttacccgggctgcccgacgacggagacagtggtggtttctcagccatgaaggaggctgccttctgacttctaatcggtcccacca

SEQ ID NO: 47042 - DNA, 12555 bp, Oryza sativa
aaactcgcctttggatgtatgagcgtgccagttgatttgatcctgcaaacaacaagaaacaaagacagagaaaccatgattaaattcataaatgatagccgatcggctagatgacgatgacatatcatttatctttgagccgatgtcatgtgtaaatcgatcggcaattgttaagtaaacaaatcagaactaaatctactcaatcggctgtagatatcaatgatatataatccttatatcgatatatacttgaatcaagtgattgggatagatcggtcaccttgccgagacagtataaatcacctagatcgaaatatatattaataatgagattatatatatatattcatagcatagccgatcagatagatgtagcgtgtatcggctaatactgcgatactactttatattaagatattaaagcaaatagaatatactaaacaaaaatctaatatacttaaatgcaacaagatcttaacaagatggaagcgctaatctcgagaacacaagccgccataacaagttttacctcttgttgaagatcgaagccgatgcagctcaacctgaaagcaataactcgtcgagataaaatgaaagcaaaaagggtggcgatgcgccgaaattgtattgaacgtgtgtatgtttttattacatagggctcggggtctatttatacccgagaaatacaagatatgtccatattggacacgactcttatctctaacaaactctaagataccataagtctttgcggcagacttttgcccacattttatctctaaggaatttagataaaatatcctaattaatggatacaattgccttctcaggactctatccatgcgtggcaatcatcttgaagcacatcaactcgaacccaatgtcacacacgggtcgtattgtcggaatcggctgtatcacttaaccagtccaactcagacttagccgatcccagtcgtagccgatccaaactccagccgattcttactctgtttccgaaaatacccttatcttctattccgctttgatttcatcttcatctccgatgctgatattaccaaatttggttgttaacaccttgccactcaccgtcgcagacgacgcagctgcacccgagatggatctggtcgtcccgaggatggcaccgccggatctaccgcccttgtcgtgcgcccaccgcgacacccaagggacacctcctcgtcggcggcgccacctgtcatcagaggagaggagatgagagagagaggagaggagagaaacagagaaaggagagaaaaatatagagggagagaaagaaggttgaaaaaaattaaagtggtgagggaaagagagaggaggggataaaaaatgaggagttatttttgcatgcaaatcacataagaggagctatccattatctcttaactttacgattcaataacatgcatgtctagattaatctaggataaaagtactgcgaatttggataccatgtctaaatatgtagtcttagaacatatggtgtgtcagggttacggataaggtataccctctacccttagatatacgtcatgtatcgatatggtatatctgcgtgtatacggacgttctctgtacacgctaaggaaattcatcacggagtccatagatgggaggattcctactcggatagaactgggtcatcactgtattatgtagggtccgatgtctccaagtcctacttggaggccaactgacctgcggtataaaagggaccccccgggaggacccaaggcatcgaatcgtaccgccaacacatcgaccacagcctacatgagccaaatcgcctggtgatctagtcgaaccaactcgactatgatctcgtcggtatcatcgagttccactattccctttgtaatatgtgatttatgtcatataatctcatatcaactagattagggctattacctaccaaggggcctgaaccagtataatccctgtttttgttgcttgatatcgtattacgtagatcctcgtaccagcgtaccccaataccctctatatccggtctacgggtatcccccgttgacagtggcgcgccaggtaggggcctttggtgctcaaggttctactactatgtcatcaagcttcgtcgacaacagcgtcaaccctggcttcaaccaaggagtttctacttcaacaatgctggtgtggactcaagtcggtgaaatcgtcttcccggtttacacctcggtgccgatctcgactggtccatcaatggccggaagtgagaacgccgtggttacaaccctggacgactccatgtcgaaggatcctcccgctgaagtagagaacggaacgtcgacaacatccaagcccgagaaggatcctagtgcggccaaaatcttgtccttccgacaagaatcacgagccgacaaggacaacttccgaggtgacagggtcctagtgtcctatccacaaaaccaggaaacacaccttgcaagcttgctgggtttttctcaacgtacaagctgagattcgtgcctgcaaagagcgtgggattcagcgtacttcttcaacccgtgatgtctattgtcctattcacaagacaaagaatcacgacctctcaagctgcaaggtccttctcagcgccatgaagacgtcgcctcctaaggtccagcagttacaaatctctcttagggatgaggacaaggaataaggagcgacgcttgtctcagatcgattcgttggggtaatcgacattgatccccatgagccgtcagtcctacacttgctcgaagaatagggctcatcgtcaacgagtacaccacgcgatgtatttgctatcgatgggaccagcacgtcagcgcgtgctaatgtagaagcggagaatcaagtggttacgccggcccagcatatcagggccatcaacacaatactgagggaaaccccttatgatcccgttctgaacgatgatcttgcacagtggacagaatgactacacgaatcagtggccaacctcagcaacgcgttcgaggaggccgctgccagagcacagctagaacaaccgacagctggcggcgccgatggcgaaccacctgagcagcggacatcacctcaatgagccactcctccacctcgtggtaccggcaatctaaatgaccatctgaatggtcgccgagaagcacgacgcgtgcaagacaacgagaaccgttcccgacatcgcatctcttcacgatgtcacgagaacgaagagcgaggagacgctcgggcgaataccgagaccgtgataactgccacgatcacgatgatcacgaacagcagatgccgggcgatactggttgaggacgtcgccataacgatgacgacggtggagatcggtgccgggacaataacggggggcgacgacaggattctcgagatcccgaacttcatcctcgtaatcgtacaccggaaccaagtgactcatcatcatcgtcatcatcctcttcatcctcatcgtcagatagacatccacgaaggacatacgatcgctgacaacccaccgcccccagcgtcgggtgtagagctttcagtcgttcgctgcgtgatgtccgatggcctgagagattctaaccgggagcagaagtacgatgggagtaccgacccagaagaattccttcaggtctactccatggtactctacgctgccggagcagacgacaacgtgttggcgaattatttgccgactgcattgaaaggttctgcgcgttcatggctgatacacctctcgccctactcgatttcttcatgggcagatctgtggtagcagttcgttgctaacttcctagtaacttacaagcgccacgcgatcgaagacgacctacacgcgttgacacagaacccgggcgaatccttgagggactatgttcggtgctttaatgagtgcagaaatacaatccctgaaatcaccgacgcttctgtgatccgcgctttcaagtccggtgtcagagatcgctatactacccaggagttggcaacaaggcgcatcacaactactcgaagaatatttgagattgtcgatcgatgcgctcacgtggacgacgcactaagacgcaagaacgacaagccgaaggcagggggagagaagaaaccagccaaggaagcacctgaatcaagcaagaagaaaagtcacaagagtgggaaaaggaaagcccaagcggaagtcctcgcgtcagaatacgcgacaacgaggcatggacaatggcgttcgacggcacactcaacagccaaggagcaggggcaggattcatcttgacatcaccttcgggagatcagggcaaccaacaacttcagggcaaccaaccaacaccttcaggagatcaggggcacgcaattcaccttaacttcagggcaaccaacaacactgccgaatacgaaggactactcgctgggataagagcagcagccgcacctggagtcaagcgtttgatcgtaaaaggggattccaaactagttgcaaaccaggtgcacaaagactacaagtgttctaaccccgagttgtccaagtatctcgcagaagtcaggaagttggaaaaatgatttgatgggatcgaggtccgacacatataccgcaaggacaacatcgaaccagatgatctagcacggcgtgcgtccagatgggagccactcgaacccggcacctttctagacgtcctgacaaagccatcagtgaaacaggcaaacgacgaagatagcccagtcatccccgacgtcagctcgggggctatagaggcagagcgcgccgtcgccgacatcgagaccacggacgactagcggaccccactcattaaattcataagcagcgacgagttgcccgaggacgatgcagaagccgagaaaataacccgtcaagcaaaaatctactgtatgatcggcgacgatctatataagaaggcgccaagcggggtacttctcaaatgtgtctcgtccgacgacggcaaacatctcctccttgacatacatgaagggatctgcgggtcacacgccgccagtcgcacattggtcggaaaagctttttgacaagggtttttttgggcgaccgcccttaaagatgtttgcgaaatggttcagcggtgtgaagcctgtcaatttcacagtaaacacacaaagctaccagcacaagcgcagaccatccctcttacttggccgttctcgtgctgggggctcgacatactcggaccattcccatgaggacagggcggctacaggttcctattcgtggcaatcgacaaattcactaagtggattgaagcgacacccacgggggaaatcaaggccgacaacgtcatcaaattcatcaaagggatattctacagatatggattgcctcaccgcatcataacggacaacggctcccagttcatcagtatcgacttccaggattactgcatcaggctgggagtcaagatctgcttcgcctcggtttcttcccctcagagcaatagactggtcgagagggcaaacggcatatcactacaaggaatcaagacccgtgtctacgacaggctcatgtcacacggcaagaagtgggttgaagaactcccctcggtactatactatgggccgtacgtactacactgacaacgtccaacaaggagacacatttcttcctcgtgtacggctcagaggccatgctccccaccgagctacgacatcagagtacacgactacagaagtactccgatgaggatcaggaggagcagcgaaacgatgatgtcaatctactcgaagaacatcgagaacgagttgccgtcagagcagctagctaccaacaggcccttcaccgataccccgagaagcgcatcagagcacgcacgctttcaatcggtgactacgtcctccgacgggttcaaagccaagcagggcgaaacaaactctcacccaaatgggaaggaccgtacacgatcacgcaagtcttgcggccaggtgcattcaagattgtagacagcgatggtcgcgagttggtaaattcttggaacattgatcaattacgtaaattctatgtataaatcaatagtattcatacttgtaagacatcttacagcttctataaagtttattttcaggtaaagattacaatcaaagtgttccttcctgacgatcccttaccacgatgacacctagcgttgaaacctatcctactgtccctttacgccgtcttgacaaggcctccgaggaacctaagggaacttcggctggggacgcccagagccgataaagccttgtcggatcctgtagagacaaaagaccatgtaagatctggtcgtgtaagagttctcaccgtgcgtattaaccaagccgtgtaatcggaaattaggttttccaacttcacggctgggggctaggatcagtgcttgttcaaccaaggcaggtcaaaggtccaagagccttatcttctaggggctagggagagtgtatgactcaagtgagaagacactcgtacacaccgcatccagagtaaggaaacttagtaagatatatttcttttcaatttcacaagtacttcttacagttcgtaaaaattccaaaatatattacatgcctccctgagatatttgtcacaggatataaagactaccaggaaggccagcaccagtccatggactgaaagactttctccgcaagcggcgccatcgactttgccaggttatctatctctgcgagagtcctccgagaacgtgaaaaccctccgtggaggaactcgagatgcagctgcggacggcgatctcgcatacaagccagcacatgccctcaagcatatcggctcgatcgacggcactcctgcttcagggcctcgtcgatacgcttgccgatgccttcgagctgagcgcaggccctattcaaccacgagatatatccggctgccgactcctcgggatccccgcgaggtactcggagttccctgtagactccggccatggccgtgcaacagctcctgaggtacgagttgaaccacacttcgcgacctcggagtgcttccacggaccggtccttcttcacttccaccatagtcctctcgagttcggccacctcgaacttcgtcctccagtattggatgcgacgatctcggtcggccagtgcactctcgaggtctgctcagcatggaaacgactaagtcaagctgttcttctctctcgagaacacagcaaattaagtcaatcccgacagaagagcaaaggagatgaaaacaaaaaaaaaaaaccaacctaaggaagtcgtcgccatgcccgctttcatgggcaagttctaatctatgtcgacctgcagcacatatggctcgagcgcaagtgccggaacgattacaaacaactcaggctgtctgcgctgctggacatcctcgacatcgacatctctacaacgacaataaagtactcgggatcaaaatgctaaagaaaacgaaggtgatgactgcacacacaaaggcagttggaaccaacaagagttttacaagcacgactaattaaggagtacaggggaactgaaatcctactcttcaaaaaggggaagaacagactcccccagatcaccgacttcttccatcacgcccttacgcgcgtcattagcagccccctgatccaagataatctagaggtcaagttcagggtgcgccaaccttacgcattcgaggacgtggcacgccccggtgtagatcccgttggacgtctcctccccgatcctggccacatgcttggaggggatctcctccatcgccgtcaccagttccgcgagcgaagtcgtcagcgaaaactcatcgggattcaccgggatggtggtcgtaacaccgcactccccgacgagctggtgcaggccggtgtaggtaatccgcagggagccacggatctccgacaagttgttctcgagctccgacatgcagtgctcgagcccctgccgctgccgctcgttgccgaccaccagctctctcatcttctggaggtcctcacggacctccgccaggtcacgcgccagcttgtcggcgcgttcgttcaccgacgacgccgctgccgccttcgcctcctcaatctcgcgccctatgccgcgagcaccggcctggaggatgcgctccatctcgatttggagctccccccagatgaggatgtcagcgggcgggcctcgagcgggcacaaggccgcctgcagggccgctgggcgtcacctcacgactcttgggcacgaccatgacctttgtcgaagccgctgcaggagacgcactggagttctctccagacccgtcttgcgccgccttcgcccgtgccgccctgtgaaggattgccgtaattgccatcaagacgggctgccagagttcgatgaattaaaaaacctcaaatttgtctacttacttctcgccaagtgtcaccagcctctaccgtcgctgaggcgggggagacgcatccgaggcctgagtaaaacgagtacggtgtgaggacaatatcttccgactacacaataaatgaccaaaggtgcttaccgatggggtgggcgccttccgacggttcttcggaatgttgccgccactggtcatggcagcggcagcagcagtagcaacatcgaatgcctcctgggcgacgccctccttcaacgaagctgccgcctagtggtccacgagcagcccgaagatgtcagtcagagggagagcctacactacatgaagtcacaatgcgatcctagaagaaaaagataaaagggtcgtcaaatacactcacgttgattgcagtttcacgctcggctgtccctttctcgcaaagggggacatggacgttgctcgccgttgtggggccgctgatcatcacttgaccgacgcggctctccacggtttcgctgttcaaacctgtagatcgagaaccagaattcgataagtcaagaggaacatgcacataaggaatggaatccgaaatacaagaaaaataccccgaggagaaacccgggtcgcgtcctccggcctagaataatcaaaggctggatgggctcgagcctggagcggctggatccgcctaccaatgaagtcggcagtgacttcataccccgacaaccctcacactcggaggtcatcgatgatatcgatgaaggactgaagggagggggttaaggcgggtttgacggtccaagacgaaatcttgtctggttgttcctcagggacaacaaagactggatccgaattctctatctgaaaatagaaccacctcgcccgccatttgctatgagaaaaggggcactaaaaggggatgtatcgcgacttcaggccatcccgaagtcggaaaccgacacatccggacacctttttaggttccatccagcgcaactcgtagtagaaacgaaagagatcaagaaacggctctaccccaatgtaggcctcacaaagatgggaaaaaatactgaggaaggcgatggaattggggttcaaatggagcaaagaaagaccgtagaaattcaagacgagaagaagaaactcggaaggcggaggaagaaaaccacaaagaatatagtcctaaaccgcaaccatgcggcccaagacaggttcgggttcaaccatactaggacaggtatatacctcctagttctctctccatggtcccgcgaccggggagagcgtcgtcctcctgcagcttcttcagggacgcgccggtggaagtggacttgtcgagatccatagccgccggagatcgctgaagaagggactgagatgagcaagctagggtttttgcgggagcggagaagacgaggagcgcttggaggctggaaagtttttcacaacaggcggacttcaaaatggatcctcaaaactcccttaaatagacgcactaccgacagtatgaattccaaggaaaggagagagatggccgccggaaatttctagccccgttacgcgtggcagttttcggacttcaatttaaattcacttatgaccgttgaacttcgcacggggttgtcgattactccatgtctctacggttctcacaccgagatcgaccagtagagaacgacaataaccccgacatcagaagtcgcgatcggtcacatgagttcatttaagcagaagtcgggggctactgtcagggttacggataaggtataccctctacccttggatatacgtcatgtatcgatatggtatatctgcgtgtatacggacgttctctgtacacgctaaggaaattcatcacggagtccacagatgggaggattcctactcagatagaactgggtcatcactgtatcgtgtagggtccgatgtctccaagtcctacttggagaccaactgacctgcggtataaaagggatcccccgggaggacctaaggcatcgaatcctaccgccaacacatcgaccacagcctatgaaaccggagcctacaggagccaaatcgctgggtgatctagtcgaaccaactcgactacgatctcgtcggtatcatcaagttccactattccctttgtaatatgtgatttctgtcatataattccatatcaactggattagggctattaactactaaggggcctgaaccagtataatccctgtttttgttgcttgatgtcgtattacgtagattctcgtactagcgtaccttaataccctctatatccggtctacgggtatcccccgtcgacatggtgtatattatggaggcacctacaaatccctattttcttttgcaaaaatcgggcactgtttcaccaagtagatcggaattgtttcactaagtagatcgaaaatttttaatattttaaaaaaactgaaacacaaccaaatcaccttgtgaaacattttgctacaacgtacgaaacaatggttttcaaaaaaaatcgggcgttgtttcaccctatataaaaataatatttcagcaaatagtgaaagaatgtttccattcactgcaacatttgatctatacatagtgaaatattacgagtatacttgctgaaacattactagatgaacaaaaaataaaacggatttccttaatacaacgtttccgtaatatgcggatgatttgttgtaacggcgtgtgtggtggggtgcgcgtgtgtgtgtgggagggggggggacagcgcagaggcgcgggcggcggcgggcgcccgatcgctgccgttttcagtatattatctcatattaggttaaatatatagtattatctaatttctacatgccatctaagatctgagagacagacttaattaaaattagaataatgcattaacaatgttagtgtatgtaccgagttgcgtccacttgtacgtgccaacccatcgtgtcttgcactttggaatgcaggaatttcacaggaaatagttcggttcgtccaaattaaatttccctgaaattaatttctccaatccgaatatatagggcctaattatatatgctgaacgagatgaaccggccggtaatggcgctggtcagcagtaacagattggtaagatctgttggaatgcgcagcccatcaatctctgcgatttttttttccttctccagcttctcacgtggccgatcgacgatgacgtacgcgtatacgcctgcatacaatgcatgacgagattttcaccagaaggagagcctagcttagctagcagctagatagctagattatcgatctactggagtagctaggacggcgacggccggccaccatgtgcgtacgtgcgttgtgtctcccgcggacagaccggtaaaaacgacggtagagtgagtgatgagtgatcgttgaggttgacgagccgagtggggtcgtaagtacattttacccactccaatcatttatttaagagtaaattttactttggaccatatttattgaccaaaattttacattgggttagggctagactcatgttttcgcttaacaccacgtataattaccgttctttgaactttggacctgattttatagttaccatcacacgagttgttatctaggtgcttagcattttacaagaaacaatgatatggaaatttttgccatgcaaatatgcttagcacaagaacaatgatgtaacatgttacaggatatcctatcagattaatgggacttcattactactacatatgaacattcacaacccttatactatagacaaaattggagaaatattgagtttaagaactatttttttagaaaagatattacatgttttacaaacccaactgtagtgttagtacaaattgttgaattctaagttttctaacacaaaaaagaaatgagatcagctctacgatcattatactatgtgtaatttgtgaaacccggtccaaagtgcaaatgatggtaactatatatggtgttaagtgaaaatataagtctaattctagtccaatgtgaaaatttggtaaataaaggttgaccaaagtgaaatttactctttatttaaagagagaatatcttatataccactagtctaatcccttttatgccattaaaaattagcttttcccctatataccattgttcaaaatttgcacatcctctcatgccactcccgtatgttgaccgttaactctaagtaaaaaagatacatttgcccttctgaatataggatatgtctaacaactcagaagggcaaat

SEQ ID NO: 47043 - DNA, 1861 bp, Oryza sativa
attttttagaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggatatgtagaagatctaacatattgtgtagagtccaactaagcaaattattcgtcttccctcaccatggatggtagacatgttaattcgtgtctccggcagcatgctcacatcatcatacttagaagaaaaaaaagtgcccttcatgtatatacatgtaactacctcatgcccctcttttcattaaagaaaaaaagttctatacccatgcatgcacaccgggatgcaccggttagccctccaatttgttcactccatggacggtatgttcctttgttctagtgattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcgagagaataattaagttggttgtgagtcaataggtccattgatgctataattaaggttaaggttagcggtttataagttattttgattttattaaaaaactaagttggatattttgatttgtaatgagaacatttaggattttttgcgtatggatgtgggtccaaaatataataattttattagcaattaaatatggttggtatagatattaaactattgatttaattaaaaaaacacaatggaattaaatatggttggtatagatattaaactattgatttaattaaaaaaacacaatggttcaaacagatcataaattgaatatataatttaaaatttacagctattgaagattctttatttatttataaaacataccaagatcaatatgtatgagatatattatttatacctatatttgcaagtgtatgcaatctttgaaagtatgataaaattaacttactaatatagaagatattatatacccttaagccttaacttaattaccatcgaaaaaagggaggcgagcaaggaaaaaatcacacagactcttatcatgcgtatggatggaagcatgtatatgtgttgggcggactcgtaccgccagattgatattaagttttttactaaagataaatctaatggtatctgatggtaaaaaaaatattaggtccatcagattaaataaaaccaatggttagatgttctcctttttccatagattttctacgaattaattagagcgttaggtgtcatctttgcactgtttcttggaatctcacgtggcagtttaggagctttttaggatgtttaatggacttttatataatagatagatatatctacgtgggtttgtgaaatttactccataatatatatttccatttttaatattttgtttttatttggttgcattgcaaagaaaaatagtatatattcaaagttaggaaagcgtttttcttatataaagatttgataggttcaccggtttaaaccatctatatacctaaatctaatggttttaatgtttg

SEQ ID NO: 47044 - DNA, 12271 bp, Oryza sativa
atactcaagcttcctgttcctggtgctagctggtgatgctggctacagcctcttgcgttgtctcgtgtctctcgtccacccgcttctccactatcccttttggatttagaaatcgccgtttcttgaccagctgaccgaggtctagtgtttataggcacgtgaattgttgccagaaataaccttagtaaagtttggcattatgttgttaccaaattttagtgattatggatgtatttgtttgtaggcttatcaaattttgatagagtttaaagtggatgtattttgaaaactactaaagtttaatagggtagcaacggtagtggaagccactcataagaacacatagacggagactatactcctctccaataacacgtagtggctttaattttacaagttgcccatatcaatttctattttagttcacgatattatctcaatttatatacactatgtccataattttacattaaacactctaaagatggggtattagcataaccctcctcaccatttcccatattctcctttctctcctgacatgctcctccttggcacatgccaacaagcactcttgggcaccgtcatcgcttcatttctcctcatatatgacctcaacttcttcggccgacgagctagccatcagcatagatcaaggctggttagggctgaggagattatcgtcaggtcgatttttcaccgtcaaccatcaaacaagcaaagacctcgctaaatctggtcatgagcgtgccaatgctagctacaaacttgttgaatttggtcagatcgaggcgacgtggagcaacgaaataataagattagggtggcgcagaggtaaatcggtgcaacatccatggtggtgggccccttttctccctccctcatcatcagccatcttcctcaccctctcttcacttgtccctggcagtgagcaccgccgccttctttcatatttgacatatctaaccatactccgcctctccctagttccagatttggccttcactgcttggaactcgagggtacggcctcactcaatacggtttgtaagtagatcgtcttaactagacacaaattccttttgcaagacacgtgtagctctgttgtggggcatgggcttgactaaagtggaggcatggctcagatgtggtaagccgaaaccacaaatctacttgtcagttgtcatgttgttaccatgtgaatggtcctctagaaatagagaatttctttatatctgtctgatgtaaaaaaaaaaacctcacacgtgctacttctatcttaaaataaatcaatttaagattggagacattacctaaatctactattataaatctggaaaaagaaacttttaatctaatgttagattggttaattttaaagaaggagtaggttttaggatcctagcactgctaattttacggttttaccacaccaagcagcgatgacctctcaatctgatgaattgagatttagtgaagtcctaactgtgactgcaagttaggaactgcacatcatctcagccatccattttttcaatgaacggtctagatctgatgctacaatgttgatgctagttttacagtttttttttcgtgtgaacaatacttgatagattttggaccctcagatttacatcaaaaggtcctaatgtgactgcttatgttgcagtcacactaggtactgcaccggatccaaatcccaatcccaatctgccgggtcaccacagaggcgacaagtgtccccaaactcccaacagcgacgtctcccgggacgccctagaaggacggatcctgtcaccaccaccaccaccgtactcctaccataggatctcccaacgtgacagccagcgcgggaccctcccttcgatttgcgtcacggcacggcagcgatctctctctttgctatgcttcgctttctcctccgctttcgcacttggcaggcgacggggagagcctctcctctcctctttccgtgacgaagccgtcgatgccgcggtcggccaccaatgagatcataggcagcagggacgcagtacaaaaggggagccacagcgtgttgggttttgtactgcaaatccccgggcggataggggataagaacaaggacgcctgggaaaagtaatcatcagagtgagagagagagagatagagagagagggcccaggtgtttaaaaaaagagagagagagagagggccagggaaaaaaaaaagcaggttgtaggattatctaacacaagaacaccaggacagcagctgaatcgacatacctcgtgcaaacatttcccatgagttcatgccaattctatattttccaatttcttgtattttagtggtattttttctctaaattttctttctaaggttttagatcattagttaacccaattccaatcattgatgtgtcaccgggcacggatagcttgtgtatttttagctattttagatcatattaattattatattactttaaaaattactccctccgtttataattcgtttcatattataagtcatttttattttctcatcaaacttctctaaactttaatcaagtttatagaaaaatataataacatttgtagcattaatttaatttcattacatctaatattgaatgtattttgatagtttatttgttttgactaaaaaaggtcaaaatgaaacaaaggtactccctccgtactcgtaaagtaagtcgtttggacagcgacacggtctccaaaacacaactttgacttcttgtttctataaatatttattgaaaagtgatatatgtgtacttttatgaaagtatttttcaagacaaatctattcatataatttttacattttcaaactcaacaacttgagagttattcatgatttatattcctaaggtttgacttaaacattgtcctaaattacttactttataagtacggagggagtactatataataagtatgtggaggacaagatcctcaaaaaaaaaaaaaaaaagcttcgccactaattcgaatacaactgaaggtgattatcttttcatggtttaaatgaaattattgtcacatgagaaatggacgatctttcctaccaaggatttataaatggcattgttggctactaggtgtccaaaatttcccaattggggataaatctatgtaaactcaaaagtataagacaataaattgtcttcaatttgtgtcgaccttgttttcttggtacattgagtaccctaaccattttaactagtgaattcagcacaatgctagacaacaaaagtagtgcaaaaggttgttccttccattacacataaaaggaaaagaaaagagcttcaaaagagcaattgtttgtacaagagcgcaaatagttgggttatagttccactctaattggatactctaggtcgttgcaagcaagcatttccgatgcaatactagtactatagctacctatatcccataacttccaaaagggaaaaagaactctgtatgtacgtcatccatggaatctaggatattcccatttgctagagtttattcataacaaatcttccattagcttcaattgttgagctctttcaacatctctttcaagagacgtcagcgtttggtcgatagtgtcccttttgtaagttgcggtctaactaagctatcacaagagaacacggcataaaacatcggtttttatcgggaactataggtgaatattcatcctgattggttgcagtgatcattggatacgatgtgacaatattgaattagattctacttcaaccatccatatatttcttcacagcatatatagttcaacttcaggagataggaaggtggcatattaacggtttaattaagttgtcatatgtactttgtatattcttgaagtcatgatgatatacctatgcgagaaggaaaccaagaaaatggaattggataattctaataacacgctcgtacgttataacatgcccatataaatagagatgagttagaatggtgattgaggacaaatcatttaatccagtggttatacacacgtggtgtgaggaggggatggaaggagatcgactttgcttttaaagttttatagaaataattagaaaaaaaatcttattatcctaaaggatatatagatgtacctcacccattttagatactgattatggatgtgttctccattagctagcagcggcatgaaaaaaagaaaaagagtggcaaaagtgcggtttgcttgtcctagatctcaaataattgggttagggttccactttaactggaattggataattccagttgcagctaacagtacacctacatcatgcatgctgctctatacgtcatacatgtataatttgaattaaaaaaagagaggcaaacatgaattcaaggattttttttcattaattaatcctccattagcttcctattgggctcttttgggggcatcgatgtcagcttacatcgccaaatgggcgtcctttttcgttgcaaattgcacgcgaaaccgctacataggacagcagtttccggcaggtacaagggccatttggctggacaaataatattcatttggttaagctagctgatgcaattaacgatcattggatccgacgtgatgacgacgatggaattaatgggatccaaaacgtgacataatttaggtttttctagggagatttggtctgattgatgggagaagcttgtgaaagtctaatacttcctgcgtttcataatgtaagtcattttagcattttccatacattaacaacaatatgaatatgggaaatgcgagaatgatttacattgtgaaacggagggagtaccttgtaaggtgctgatccgctcaataatacttacaatagttaatagtttagaccagtacactagtcacaggactgtacatttcaacagaaccagatctgatggacatagttcaatcttttctcccccgtatttttctgtgttttttggaatggttttttctcttagtttttttaaacggtttttattgttttttcctcccttttttgaactgctttatatgatacacctagcaagagtaagagctctaacctgttttttttttctgaaagtatagaggttgtaataaaatcataaacaaattcgaggaccttgcctttttttttcttttatttactagttggagcaaaaaccatactggctgcagaaatgagaggcaaactagatcatttaaagcaactggtagcaaagtaaaagcatcaggagagcctgcatatgttgtcctacctgccctgctgccaagcagtcactgaatcttacttcttggcctcaattaatttggaatttgatccaagatttttttttaaaaaaagtattttcatcataaccttggcctccattcacttgtaaaagaggggggaaaagcataaatcttttgcagacataacattgggtgaccgtcttatctgacctcatgtcaaaggtagcaagaagagggagacatccccccaataattcatcgtgccgtgccggataacaccagcagtaggatttacaggtgttgcaagtgaaaacaaggggaatgaaagaaggaaaacaaaaactgtcctggtgatgactgatgacctggtccacaggggtattatttccagctttccacagaattccactctgtctcatcaggttctgaatgctgggaacacagatttaaattaaatacgaaattctagttttatttggttttatttactactactacctcccatgtttctattcttttctagtgagagtggtttcttgtatgaccctttgtatcttctatgctgcaatttatgtatttcagatggactggcttggtgatgaattcatatatgcacataaaagtatcaataatttgagaccgaccgaattttcaaacaaatatgaatttcatgaatataaatttcattgtaggatttacccaaaagcgttttacactttttttttctaatagcatccaatttggacctgctcggctgggctggttatcgcagccgctataacacttgacgcacaaacgcacaatcaatcaagacatttgttatccatatagaatagagtgaagcacatgggcgatcccgaaacttgtgccagtgtgtcatctagatctccaaactactaaaatatattttttaggtctctaaacttgtttgtgtcatgtaggtccaaacgggttctaacccgctccatagcgctgatgtggcaatgccacggtaacgcctacgtgttagtgaaattcacatgtcaagcatatataaaaaaataaaattaaaaaccatattttctcctcttaggtagacagaaaaaaagataaaaattcgaaggtagagacgagaaaatatgttttttttctaattatattttttctatgtaactggcatgtggatccgactaacacgtaggcgctaccgtggcataccacatcagcgcatggaagaggttggagcttgtttggacctatatgacacccaaaacaagttcaaagaaccgaaaatgcattttgaaagtttagagacctaaatgacatacccgcacaagtttagggaccgctcgcgcactttattataagtctcgatgtagatccaccgataagaaactagtcctatgcatttttttatcgacggaattaccaaatgacaaatatatttttaataatggattaaaactcagcctctacaccaacaacgtgcatacagccactgccgaagatgcatatatagcccccactcttccatggaaaactgaatacaaattgaaacatcaactacaaaatgaccattgtaccctgcaccaatgattccaacccaaaacaaacctctcccaaaataaaaatagaaaaaaattaaaaattacagtagtagtaataatttaccagttggataagtgtactgaactaccctaataaactagcttgaccaacctcagtccagctccagcaaagcaaccagcagtagcgggtagtatattatagtagcagcgtgcctacgggcttctctgccattgcagtgcagtgcaggggtccctctcgccttaaccacccaaccaactacctccccaaacagtcgccgccgccgcgcgccgagctcgagctacctgagctgctcccatgtcgtcctcgtcctcgtcggccggcggctcccacgccggcctcgccctcgccgccaccgccatggcgctctccggcaccctcgtcctcttctccctctgccgcgccaacaagccgcctcaccacgacgacgcccctgctcgcctccgcccctgcctctcctcctccggtgagcgagcggagcaaaagcgccgccatggatggccatagcgcgccgtcgtgcgtgctgttcttcttggctcctctttaggactctcctctcacctgacgtgtgtttcttgcagagaagcggaagagggagaaggcgcggcgcgggagcaagaagcgggtgaggttcgccgccgacgtcgtcgacaacgacagcaatgcgtcgtcccgcccggcggcggccgagccgtcgtgcaggaacgcggcggcgacggcggcgacggcgatgccggcgaaccgggaggcgctgtaccgcggcatgctccgcggccgctccatgctcagggtcgcctgctcctactagctccagctaattaatctgccattagtcccttaatccggaacttgttgcttctgtttgctcccttgctgatcgctaatcgccgccgctaatcatcgggaagttttgtaattagcgtgcatcccgatgcacgagcgagcgagcgatcagcagcagtgcaggtgattgtagctgtacttgttgtacgtgtacattattattgttattctgggtgattagtgaattattaatccattgaagcttccgatcttgcacttcctctgtgtccatcaaatttctctctctcaatattcattttttttttcattcttttttcccgccaggtgattgccggatttctttttcctcctctcgttgcccaattttttttttcgggtgttagcagtgatatatcatcatatcagcagttgtggtcggccgttgctgtcctgatccaaccaaaaacacaagcagagacggacaaaacaaacggacggaagaggggaagggaagcacggctcgggttgttgctttgggagaaatcacggaagccacaggattattggtatcttgtctcgtgagaggatggagcagatagatagatggatagatagatactggggttcgggggattattcatggctgcgagagaaaagaagaggaatccgtggtggtggtggcgtgcggcggcgacacaggtcggaatcgatcggcgggcgcgcggaggcggggcggatcacatgcgcgcgcgcgcggggggcgccgctgcggtcttcggctaatctcccgtgactcgcggcgtcgtcgtgtcgtacgtgtcgtgtcgcggtggtggtgtgggttttcaggggaaagggggcacgcgcgcggtcgggtactcgggttgggtttggtgtgttgtgttgtgtgtgttttgggaaccctacctcaacacgaaagatagagcgacggattagtttagaatctattaagaactaggataaaaacctttaaaataatactttgttataattgtttttaaaattgtatattatttggtagtttggaaagccgtacacgaaaaaaagagagtaaatgtaaatgtacttaaaaaacacacccttgattgcacataccttagcaaggtctaaggtcaacaatgaaaaaggcggtttttagtaaagttgatgacaggcttggcagtttggcacaaacgtacgcaatgaagaagtttacaatcgttaaggaactcttacctctcttatttaaaatatataatagtatactactatcaacctaaatttgatactagcttttcataatactaattgatgttaaatttaattttaaattactatattttaaaatagagggagcacactataggagatccttcgtttcgcttcacttcagagcattttttttttgcctccaatcttaactagtgaaaagttaatattaaaatagaactagaatatgccatatcatgtaacaaataataaccatcggatctaaaaggacaaaaagagagaagatatctgagccgtcaaatataagtagaaaagatcctttcggcgactcatatttcttgagacctaggaaaaagaaggggaaaaagaacataactactcctacattacatgctgcacattgctttgtttagttcacactaaaattggaagtttggttgaaattgaaatgatgcgacggaaaagttgaaagtttgtgtgtgtaggaaagttttgatgtgatggaaaagttagaagtttgaagaattaattattttggaactaaacacggcataagtactcctacatctattttctgcatgaagctttttggatgactctgccctttgaaataagatcaaacggatatagtgttcacgctacagactgcagcgaaccgaattcaatccctacactactgtgtcctgaagcagccacaggtcgagttcactgctgaaacggcgggctccaccaatgagagaggtagatcattccaccataaaatctcctaagacccaatccagacccatcgacgatgatggtccgagaaactaattcaaattccttgcttattttctaatacatgtgtagatttatgctccaccatacagtaaagatatttctcaaaataaccttactttgttctcaaattttacgtcaaatgatataattgtttaatgacacataacaaaattgttatagtcgtgcaaatgcgtcactttatagtccaataccagtgaaaaatcctagtaaactcagggtgctctcccctcccgttggttactaccggtgcccagtgagttggcttacatatggttcgtttaagatgaaattcctgattgaccgagcgtcgttttcgtataaggtgtaccgttttagactatttttaaaatctgtttttttaattctttctgcatcatattaatatcaatacctagtagtttaaatgataaatatgtttaattactaaccgatagagcgtcgcttttaaagagatgctaccgattccgagaggatttcgatcattcgttgattcgttcgatcccctcgttgcggcaccacaccgtccactgcgacgctcgtgcagtccagcgtctccatgttggggttggcccgatcgctcatcaaccataaccaaccaaccaaccaacggcctggagaccaccggtcccctcccacgctcgcacgctcgtcaattaaacggagatttttgaattgctatgggctgcagtgtacatctactggtcgcctatcatattttgttaaacaagattctctatccatgattgtagctaaattatctttgttattaatctggtcaagtacgagtacaaacaattcatctcgctgctctgacatcgaccggccgtgatggtagccaataattagtcatgtggattaggcacgagcaacgagatggatgtagattagttagtttttttttttgcggggagattagttagttaattaatatgttacaggtgttctgttgtgattagcggatgtgggggatcgcgttgattagtgttgtgtgggtttgattaattagcacgaggagacggcgaagcttagagctcttctaaaattttctaaaaccctcctctcttttttttctaggaccgtagaggtatggacacgcaagccgcctagctagctctttcagctccatcttttactggttggcttatttcatagctaaaatttgaattttcagtttcttaatcataattttgttttttgcattttcttttaaatcattattttggtaacttcatttattttcccatgacttattagctataaaataattatgacctctcacctaaacttcatagaaagatcttagagacgagacaatcccgaatgactgtaattttttatactagttgtctatgaggccatgcttaaaatgttatgcctttcgtgctgaaagtctgaatttactcatgggcttgttcagattaatgttattttaaatcatactatattttaaaaaataataaatatacagatggatttagttaattaccaaacatttataatgttcagtgaattttgacaacacattagcctattctaacgtaaacacatcttaggctcttgaagcgtgcggttaagggagtgttctcaacgtattttttaaaaaaatattagtgacgtacccatccgtcctctgtaacaatcgtttggttagtgtgacctgtttgcaagatcttcagctagagaaaagcagcacttctacgaaagcaattagcatgcttttatgtattatattgcgtgattatttctacggactttctggatcttgaatgatcaactccaactttctcccccacccaatgtcgtcactcgtcaattttgccaactcagctcacgccatagaattctacagtaccttctcattatcttggtggtgttcttgagaggtgcatgcaaattcatagggcattttttgaactttgaaaatgacggacgtgttcacttagataaaaaaaaccttaccaaattttagtatatagttaccaaaatttggtagcaaactaaatgtaaccacttttttggcaactttatcacaacttagtaaggttgaaaatagcattaaagtgaacaggcccgacacgtttatagattccatcagaaattggactctataatttaaaatggcaaatgttgcatggatgggaggcgcggcataggtgttatcatcaattttcatgtccaactatacagatttttggttgagctagtgttgtcaacttgtggtgtcataatgatttcacatcaaatttcatcgatttttaaaaaagggaaataccaggaaaaaaaggaagtaaaaatatcaacgtgaattatttttagggagggaaaagcagcagcctatattggagaggtcagtctcacagagcgtcaacagcaacacaggtgaaagatgggcctcgattgggcttcgtttggtcggattacggcccattagggcaaaaaagaaatgaagaaatgtcgcacaaatctcctgaaaatttttgagctgtcgatatgaattcgtttcggagaattttggtttgtatgaaactctcgactaaataaaataaatacggataacaaaaaacaaaatgtcagaagtgggatttgaacccacgccctcgttagaggaccagaacttgagtctggcgccttagaccactcggccatcctga

SEQ ID NO: 47045 - DNA, 11865 bp, Oryza sativa
taacaaaacaaattacataatccacctgtaaattgcgagacgaatttattaagcctaattaatctgtcattagcaaatgtttactgtagtattatattatcaaatcatggcgcaattaggctcaaaaaattcgtctcgcaatttacatgcaaactgtgtaattggtttttttccgttcacatttaaagctccatgcatatgtccaaataattgatgtgatatttttagccaaaattttttggaatctaaacacagccgatgaatcaatttttatacacattgacgctagtaggtaatggaggcggcaacggtagagcccggaccgtcacccaacctacccgagagctgcctccctcactgcatgtatgatcatttgtactgtgagcgtctgcgtttgtattttgtttaagaaaaaaaaagagaaaaaggccaatacttcaatgttaggacagttgtaactgatgcaagcttgcattctttgacatggctattgtcgtggaactcgggatagcaaccattgtggtccagtcagcagaatttgctgaatactccccgctgttctgcgtcttaatttatcttgagcaaatgtggtgggattggaattgaactagagaaaggattaagaaaaataagtccatgcaaaagcataccgtaaagttacaggtaggatacgatagcatacaacgaaaatatgggaaacgggtacatttttaagttccagctgccttctatggatgtactcgaagagctgagaccactgcttcttgttttatgtttaagctgaaacagactagttcttctgaaaaataccgaaggctccaaattgatgggggcaaacagacctgaacaatatcccaactatgtcgaaatgtatataaaaaatggaagactaaaatcatgattacgatgcattcaatcagatccccgaattgtccacaatcacttgatgctttggcaattgtgtctgaatcagactgagactgaatcacaacgattcatttttcaggacaattcatgctcaggtgcaaaactgaattgaaactgaatttttagtggacatgctgaaacagaattgaaacttagtgttcgatccatgaggaaaaaaatgacccgtatatgctgaaactgaatgattaaaagtgtcaatgcgacaattccacggtcatgggagcatttcggaacaaatcttcagaagataatgagataacctagagttttatgtttaagctgaaacacagaccattcttcagaaaacaccgaaaacttcaaacaggatggggcaaacagactctgaactcaactatgtcaaaaaagaaaaatgtgtaaaatgaagaatgtctcaaatcatgatcacagtgaattcaatgagccgaattatcccccaattacttgatgctttggtaattttgtctgaatccgactgagactgaacaacaacggttcattttttcaggacacttgatggttggtgtcaggcaatgactgaaacaaaatgactcgcgtatgctgaaactgatcgattgaaacttaagtgatgatccatggtcacaatttgataagaagaacaccacaacaaaaaaatcgtcaggaactatgctaactgacccaagtgatcgaactaaactgcttgtctccctgaactttccgcagaagaaacaaatcaccgaagaacatcgatcagactgcaagatggtggattaatttgccgctggtgctggcaatttgctggttgctaggctcagctgtaaaaataaaaatagaataaaataaaaaccaccaaaccatgtcattttaaatcagcaaccaaacttgcatgaacagatgagaaatatgagatggataccagaaatgactcggcgcagtagctgacgaaggggaagaaacggccttgtgatttgcccaattcgcacactttcttgatgcgcagcgaatcgagctcgacggcgaagacgccgtcttcttccgtgccgacgaagatgacgttggggtcctcggcaactgcggccaagcacgcccgctccttgcccttggtattcccgaccggccatggcagcacctgctcgagatcgatggccacgcgccacacccaccgggcggcggcggcggcggcggagccgtcctcctccctgtcccacagggcgagcttgtggcggtgcaggactcccagccgcagcccgccgccgtcgctctccggcgccgccatgacgacggtgtagccgaggcggaggcggcgcttggcgcccggcggcgggtcgaccaccgagagcacgtcggccgaggtgatgccgtggcccaggatgtccctgccgcagcgcagcgggaggccatacctgtaccggaggaggatccccgacttgccgacgaagtagagcgtgtcgccgccgacgagggcggcggggcggtcctcgaggtggtacccatcgaggtcgaggtggatgttgatgtggacgctccactcgccggtctccgacgagtagaagcaggcgtgcgcgtcccagaagtgcctctcccaattctgcacgccgacgaaggcgacgatgaaggaggccgagccaccacccccacccgcggcggcgccggagatgacggccgggtgggtcaaggcatccatcacgttggggatcctgtgctgctcgccggtgatcgggtcccagacgacgtggccgtcggtggggtagtgggagtcgtagtcgtagaggacgacgcggccgtggcggcagtcgaggatgtggtgcttgcggcggtcgccggcggcggcgcggaaggaggaggcggcggccgggacgaagcggtccagctcgcggtcggccgggttgtggaggacgccgagcacgggggccgccgccgccgccgccgccctcgggtggaacgcgcggtggcgcgcggcgaagctcgggtcggcgaggacgcggcgccagcgcttgcagacggcggaggcgcggacgaggcgcgtggggtcgtccggcgggatgcggaggaggatctcgccgaccaggtcgtcgttgtctgccacggggtgacgcggacgcggaggcggtggcggtggcgccgccatgctgcggatcacggcgacggcgacggtgacgatgatcgatggcgaggggtggagattggaagaatcgatttgtgattctttgttgcttttatctggacgcacgatcccatgtttccaaacgccgaccgttggtgtcacagttcactttccaaacgcagttcagattgctccatgtgttttgtttcattcggaataagttcactttaatccctcgtatttgcttcgagtttaaatcacatccataaatcatgatacgagatataacacgtctttaacttacaatactgaaatactactaaattcacatgataatattatgtccggttttagctgacgtgtcattgagtcaaggtgaccacatggacgctacatgtgaacgggtcggttttcctactcctccctcctcttactctctcgtccccatcttttccaggcttccctccaggtggtagcgagcggtcagcaatagggagaagggcgataattaaccggcaagacaagagctgagtggcagctggcatcatcgaactagaccaatcgccgaatgggaatgtgatgggtggtgaactagaacatgcggtgggttttcgctgaactggaatgaaattgatttttgcatgcagatcttttaagtagccgtatgcgaaaatgtagaccgatgtttgcaggcacgactagttacggttcacccgtaacctaaagatgtcctcgttcggaaaaatgttttctgtagtagtgatatgacaccttctaataaaagtttgctccaaatgtcacggaaagagcaaaggatttttttttcgctgtgatggactgtataaatattgataaaatgtgttcagcatatcgttgtgaagttgaggtatgcagtgttaattttggataattacattgttatcaagctccatcatatgtgttggatagtatatggagagaggtatattgcgtaacatggatctattgtattgaacctcagggggccggtatatataggagtatatggagaggagataaggaaggattacagatatggaaggaatccacacaaatcaatcctattccacaacgccctcttgtgtgtcaattactaccttcccaaatcctatccatgaacgcatgtgtatacagataagagagagagatgggcagcaagagatcgatggcaaggctggcggaggtggcgtcaacggtggccagcggcgtagaggagtgcggggacggcggcgtggttgatggaggtggcttcctcagcgcggcgaagaggcaagccccgtcacgctagggtagatggctgcggggcagcgccgagcaccaccagcaggcgggcgtcctcagcggcggacggggcccgatgacgccggccgaggtgaagaggtggccgtcccccctcccctcccccccccccagcggcagcggcgaggcaggcctagcatggccgacggagatccacacgtcaacggttgctcgtggatggccacgggcgggggcagtgcgccaggtggtcggtgagatcgacgacgatcggagacgctgctgctgctgcttgattgatgacaacacaaacgcctgagagatggatctcttaggatgatgacttgacgacgcgaagagagaaaaaaaaagttggccgcccccgggagatcggagccctcccggggcgacggtgacggaagcgtgagcagcggttctaggtcgctcgctctgataccatattggatagtatagggagagaggtatattgcgtaacgtggatcaattgcattgagccttagggaccggtatatataggagtacatagggtgagataaagaaggattacagatatggaaggagtccacacaaataaatcctattctaatataactataactaccatatactctaacaatatgatttcctgctaacttgtgaaagtttttttttaaaaaatgaaaaatcaggatgctagatcttactatctgttttccagcatcgagaatgtgatgaaatatatgcttgatttgtgcatcaagtttgctgaatgtatatttgtttcaatcagcataaagttctaatttctcctccaagaggcctttatgatgcaataagctttgcacatatttcctcacaagcaaagcaagtccattcttgttataaataataaattgttcaaggtacttgttttaacactagcaggcttatgaaatttatgtttgctgtgatgtttattagttttctgattagtggtgaactcatttcctcgtcgggccagccaaccgcatgtgaaaatcctctccgcccatctgaaaaaccctttctgatcggtggcagctccagccttgggagttctcaccagataacgagctacacatctctcggttttccctgtgatcatcctgctttcgacatgcatattgctggaaaaacaacatcgtcttcaaaagtttcgcaatcgtttgttagggcaatgtggtcattagtaactactattagacttgtagactttttctatcccttaattgctacacgccctagaccaaggaagtaatattgtaagcacttaatggctgtatgatcgcggttcaaattaaaatgttgattgcatttttaggcacttttggcaccatatatatgcgcgcatagaagatttttgcatcgctttattcttcctccacacgatgcacaaagtacgctggctgttcgaatttttgaaaagaaaaagtatcccattgcttgggcaacccttcgcgcgccgtatttaatgtgtgtgatatgcactgatccgatccgtttctctcttgttttttcgtcacccgcgtgggtacagaaaaaaaaacagaaacgaaggtgacgtaggagtacgtattgctagcatgtatcgacggcgccggtggaccgagttcatgcaccaggctagacggacacacagcctatgcccgtcgcgcaatctccggtgcccgtcgcgcaatctccggtgtaaagcaagcttgcgagcgtgccacgcaagctaaagccgatcgacctcgacgacatacatattccgtggtccccttttctttccgacccaatgcaatagcctgaagcagattgcaaattaagcagcacgagtagatgggtcatggtggctacatgcttttcgtgctactggtgtaatactcctgtgaaaaagaaattaatgtagctttattaatttatttattgctgaactaaatggattttatagttaggccttgtttagtttgccaaattttttttcctaaaaacgtcgcatcgaatctttgacacatacatggaacattaaatatagataaaaaaaataattgcacagttagggggaaatcgcgagacgaatcttttgagcctaattagtccatgattagtgctacagtaacccacatgtgctaatgaaggattaattaggcttgaaagattcgtctcgcggtttccaggcgagttatgaaattagttttttcattcgtgtctgaaaaccacttccgatatccgatcaaacatccgatgtgacacccaaaaattttcttttcgcgaacttaacaaggcaatttgtatcttgccaaacaacaaatatcgatcggatgtagatatgtactactccctccgtcttaaaatataagcatttttaaattctgacacagtctccgagattctactttgaccaacaatatcaataaaaataaaatgttttaaatataaagaattgcatattatgataatttgtttaatgataaatctagtaacatcaattttatacatatgattgattttttttcttttgctactaatagttaaagctaaaaatgtttaacttgtcactgtactagaaatacttatattttaggacggaaggagcaataaatagttccgccggcaaattttttctccatcacatcgaacgtttgaacacatgtacgaaatattaaatattgaaaaaaaacaattacatagtttgcgtgtaaattgcgagacgaatcttttagacctaattgtgccatgatttgacaatgtggtgctacagtaaacatttgttgatgatggattaattaggcttaataaattcgtctcacggtttctatgctgattatgtaatttgttttgttattacttcaaatgtgtgtctgtatatgatgtgacccggtttttttttttttttttgccggtggaggctaggttagttatatacacgtacgctcacttatttcatcactaaattgaacttaaaaaatacatatatacgctcacttattgcagcgttgcagtaattaagcgaggaaatgcatgtagccgagaaatgcatgtaattatcgatctgtttgcgatctctgcttcttctaggctgctgttcggtcgcacgcaaacaatccacggaattgtccaggggagggagagagggggacccacggaatttgtgtgcttggttggttggcttcatgcatggcagaacgtgtggatgggtgcacctgtgctaccggaaagatacatacaccggagcttgaaagatccatacacctagcaggctagcacggtctgtgcgtctactctacccgcggttcatgaactcagtccacgcgctcgcggcgccgtggatgcatgcagcgcgtactgctactgctaccaccacgacgacggcgtctacgcctgcagctctggtcttccctttttccctgtacgcgcgcggggggacaaagacagactgcatgtcgaaatacacatgcatatacatgcagttaatgaaatggtaatatggaatagtagtagtatactaacaaagtcgttttcttgttgatgcatatatacaccgtctacatcgatctccaatttacatacatacaccgtatgcatttcacggtacgttggtccaaactccaaagccaaaggtgatctctctaaagtttgactgctttttctaacactctcgcaaaatgcataacccatagttgccaaaaaaccctagcattggctcctgattataaatatcgcaaggctgcactgcagtagtgcacttcacctccacccccggccatatctcctcatcagcgagaacgagagatcgagatgtcgtcgttgttcatcctcgggtgccccgtcctgtgcctgcctggaggcgccggccatggtggtggtgctggccgtggccgtctcctgccgccgccggtcgcgcgcttcgccggcgccggccgtcccctcaggctgacggtggcacaggcggctgctaacccaggtccatggctggcctgggacgacgactccaccaaggtgagaaaacgcacgcactcttctttccaactacctgcatctgcatgcatgtgtagtacgtacggaaccggatcgatgtttgcggtgtgcgtctcgactgacttctgccttcctcgcatttgattcgatgtgtttcaaaaaaaaaaagaagaagaaaaatgttcttttcggtcgcgcgtattgatctgtacgtggagggaaaaaaaaactggtcgttttcttgttgatgcttgcgtgctgtaacaaacggtagatctaggattatgggtctgggatgccgtgagaaaatctgctcttgcggtaaaaacatgagatcgcgcgagcttgttgcttgggagaacatatatgttgtacttgatgcatgtgtgacgttggcctgcaggtagtaaggccctcttacaacgttctttctctcggtctagatctgtgtttgtttgtatcttctatggagtttacgttgtgcttttcttttcggcttttttctcccgaggagttcacacgctagctcttctttaccgttcttgttggttgtgttgatacatggtctatctgtttctcgcgtacgtaggttcttcattctgaaaagaaagttttcttttttttaaaaaaatcgtgcaggcttgttcgcaaaaaaggttctcttctgatcaataaacaaagcgtacgcagtagcaactacggaggaagaaacggtagatctttggtggttgttgggccatttgttttctcgaaggaaaaatatttactatgtctgtccactaatacaagggatgttcatattttcttgtaaatgtttgaccactcgtcttattcaaaaaaattttttgtgcaaatataaaaaacaaaaagttatgcttaaagtacttgttgttattagtaagtataagttagccgtgttgatgatcgttgttgggctaggaggacagacgttggggatttgggggatggaatctgtttgacgagaggatggcctgatcggaaagggttcgagaatgggccgaactgatcagcccgttggtccctgggcatactgtgggcgtggatacagttgtgagatgggttcctaggggagcgtgccgggccaatgagttgttctgggccaggccaggctgatgcaatttaattgaagtacgagcatgcagtttgggctgagaggaaattggttatggggcaaattctttgggctgggaggggtttggggctgatgatgtttgggctatatgggctggaacttagtttcgtaaaacaattccatatacatacatgcgtgcctcaactgaagtttgttttttgagatgaaaagaagaagatatatatatatatctgaatctttatctgttttgttggatatgtggttgctgtcaggtgacgccgtacaaggccatcgcatggtcagctgcagaggcgctggacctcctggagcagactccgccgccatcggccgggagcgccgcaagccaggacgtgcaggaaataatcggcacgttcaagaacctcaaggagcttgctgattccgatgaggtgccgatggagcccctggcggcgacgtgcacgctgctgaggtaccattggtacctttggcagtgctaccacggcgacccagtcacaaggggattcccggacgggctcctcagtttcctgcacagctgcatcagtttcgcttgcggccccgatggctacgcgctgccatactacctcaacattttcggcatcaaggccgacaagctccccaaggaggcgtgggccaaggtcagaacagaacagaacccgatgacttttctccgaccctagacctccttgtgttggcttgggccgagtttagtttcgaaaaaaaaaatgtcacatcaaatttttattacatataaatttttaattttttcatcatatcgttttaacttcaatcaatcttttaattttgatgcggagctaaacacacccttggtatacctgaccgacctgttcgatttgtcgcgtgcatgcaggatttggtcacagtcgcgatgtatgcttcccagggtacccgcctcgtcgtgggtaaacacgagaagcatcttctggatgttttcaggatgaggctcattgcagatgaggggaaacaggaggaggagtccaagattcgggcggaggaggccagccaccgcaaatggcgccccgaccacttcgtcgacgacgatgacgacggcatgctcggacttgggggcgtctgacgacctccttccaagcgaagccggccacaaaatctatgccattgccatttgccaactgagtagacattagttatcttatcttagagtatgtttatggttaggtgttgttactttagccttctgatatgatggtgtcttgattatcactgctttatggttacgtgttaccagacttctcctttgctttatgctcactatattaatccattcgctagcaatgggtactctgttcctttgcaactccagtattactgctattatatcagaatatgcatgacacttgcatgggtccatggcatgaatgcaaagaatttggatccacaaaatttgagggaaaaagactttctgcactatcatagcacaaactttcgaatatgacctctctaaaatcaaataccatttccctgtaaaaacttttaaattcaaaaatgatggctctgtttgaacacagcttcaactctagctggatatatgaaaattcgaaaatgattttaacccataaattctactatctgcaatgccaaacagacccaattatacaggtagcagtgtcttattcgaaaaaaaaaggtagtagtgtcttattccggaaaaaaaaagttgtagtgttatctcgtattgttatgcttctacgacagcaacatgttctgcaccaataattgttttgtttattgtgaaacattactgttacagcatcatcttctgattagtactatatacattgactggtcctttctactatgtactccaccctgatcaagtctgatttctcctgaacccagtgtgacaagtctatattgattgaccggtcctttctagactgctccactgagtggatgcaagcgagccaacccgccggacctaccacttccttacacccgccggacccaccacttccttacccatgcttttctcattctaagtcttgatggtattgtgttcttttttaaagttcatatagaagcgagattttttttttctaatatttcaacgagaactgtacttcttttttttaaaaaaatctatatttaaaaagattaggctagttatggactaattaggctcaaaagattcgtctcgcgatttccatgcaaactgtgtaattagtttttttatctatatttaaagctccatgcatatgtcaaagattagatgtgatgtttttttttaaaaaaattgaaactaaacaaggcatttagctcaaaccctcattgacgcctagagatggcaatgggggcccgtttaccgtttccccgtgatgaattcatctattaggtgacggggatggttaatatctactcaccatgaggaataaaatggttaaaaacctctcaccatcggggatgacggggg

SEQ ID NO: 47046 - DNA, 9411 bp, Oryza sativa
ggccccccacagtgacccgactatacttatagggcggaattctagactttttagatgtattggcccataatattgaagcccatttaacatgcatatatataatctaaccctaagtcaacaggtcaaagccaaatcctccaggacctccacccatccagatccacagcaaccaccacccaagtcacgcgcgccgcgccgccgccgttcgccagtccgccgggagcctaggagccgtgcacgccactgttcgctgccactcgctgccttctctcgtcgggagattgaagccgtcgtcaccggccggcgcggcgcttgcagccgtcttcaccgagagccaccggctgcctctgtcgacacgccgccagcctgcagccgtcttcaccgggagtcgtcgtcgccgtgctgccgggagccgccgtcgccgcgccgccgggagccgccatcgccgccgccatccgttgaccatggcttcagcctccccccgtaagctatgacagcgacgatgcaaggtgagcatactacaatccctcatcccttctctgtgctcgatagacgcctacctctagttcttctccatcgagttattcgtcttccatagctgcattgttgactcactaacccacgaccggcggtccacgcgaagggatgctgccatggatttggacctgctaccacgtgatacaagtaaagcagtagtcgctgccgcagccacacccaatgttgggcatactgccgtatccgccgccgtgctgggtgctgcccctgcggtcgtcgcattgggtgcagcccctgcggtcgtcgggttgggtgctggctcctctcgcaagtccaatgcaaatgcccttcgcaggcctcctcctttgaaaaggaccacatccaagccgaaaagccatcttgcagctgttggagctccttctgcaccgactactctaaacacgtcatcttttgccggcggccttcgtctattaaaatccatggggttcgatttcaagcacgctacccctcttatatgtttcagctcttttatttaacaatttggaatatgtaagttggagtttatgacttatgagattgcattgcacttaggtactgaatgtttcagctcttaggtactaaatgatggatttgttgatgttactgtcatatattttctttgcaaattgaagggatatttctttgcacgttactgttatatattttctatatttatacttatgtacatgcattattgtttggtgatttatagtgctatgcaggtatgcgtcaacatggtctgaactttaaatttgctttcacagctttgtaaagggatttcagtatgttactaggccattgaataaattttgaactgaatttatttctctcttctcagattcacatcgaagtcaactgcgggtagtgcgaatagaagccagcaagactcgcaatcacttccacctcacgatgagagtgttaatgattctcagccaatacaaggtgatgatgatgaagatgaggctgaggaggaggatgtggactttggcaccaagaggaagcttacttctatcgtttggaaggatttcaagaaagtaaaaatctgtggtaaagtcaaggctcaatgccttcattgccacaagcggcttggagggaaaagcagtaatggaacaagacatctccatgaccatttgaaaatttgcacattgaaaaagatcaagatggcgggacaaaacaagacacttgcacagtcttctttaaggttcaattcccaggagggaggaaaaatatctgtggagaagtacacatttgatccacaaatagctaggagagagcttgctgccatgattgtactacatgagtatcctttatctattgttgatcatattggatttcaaaggtttgtgactgcacttcagccattatttaagatggtgactcgaaacactattaggtaataatgatatctattagtttcagttgtctattaaaaatatctgcaattaagaagaaaaaattaacatttatgcatttttaggaaggacattatggactattacatggaagaaaataagaaagccctagcctacatggctggaactaagtcaagagtggctattactacagacttgtggacatctgataaccaaaaaagagggtacatggctgtcacagcccatttcattgatgattcttggacacttagaagcattatcatgaggtacttgatgaacaattaatttcatttcctactgctacatatttaattcagcatgacattagatttcatttttgcatcaatctgaatttaatctaggtttaactttgattgtataggttcatatatgtgcctgctccacacacaactgaagttatatgtgaacaactttatgaagcattggtggaatggaatcttgatgagaagatctcaaccttgactcttgataattgtaccacgaatgacaaggtaatcactgaacttgggaagaagattggcaagtctaagttgatgttggagggaaaattgttgcatattgttaacgaccaaatttggttatttaggtatcggagatgaagataaaatcgaagcggaatccaagatggagatcgttccagaagcggagcaagaatcggctgaagtccgaatcggctacgatcaggatcggtagagttcgagtcggacaaggttgccgattaagccgattccgacaatgtgattcggtacacgttgtcgggttgagttaatgtgcttcatgaggattgccatgcatggattgagtcctgaaaaggtaattgtatctattaattagggtatttcatgtaatttccttagagataagtttgggcaaaagtctgccgcaaagacttatggtatcttagagtttgttagagatgagagtcgtgtccgacatggacatattttgtaatctcgggtataaatagaccccgagccccatgtaatacaacaacacacgttcaatacaatctcggcgcatcgccaccctttacttttgttttttttcgacaagttcttgctttcgggttgagctgcatcagtttcgatcttcaactagatgtaaaacttgttatggcgggttgcgttatcgggattagtgcttccatctttatgatactctaatcttgtttatgtaattcgtcgaattatcatatattatgtataatcttcaacaatatcgttatctaaccttcaatcggctaacatctattattggaaggcaaccaatcaggttaaatatctatgttgacttagattatacagggtatctaccactctatgaaacagccaacagcttgattgtctagatattgtccttcttttcatatttatagctgcatcagttgagtttgaccttataagtcgttattaaaatctcaatttctagcctgcttttggttgccgattagggtagtgtcggggtttcagccgatcttacctgatttaactactctatgtcttatatgcttgattgacatgttaaatccgccctttatgttaagatcttgttgccgatacatgctagatctatctaatcggctatgctatgaacatctataatctcattgttattatatatttcgatctaagtgatttatactgtctcggcatggtgaccgatctatcccaatcacttgatttaagtatatatcaacataagaattatatatggttaatatctacagccgatcaagtagatttagttctttcttacttattcatgattgccgatcgattcaaatatgacatcggctcaaagacaaatgatacgtcatcggcggctggtcgatcggctatcgtttatggatttaaccgctattttcctgtctttatttcttgttgattgcatgatcaaatcaactggcacgctcacgaacctaaaggcaagatttttggacctgcactggagttaagcagatctcccaggcctcgtgtttttcacatcaacacatatgcgttgtgctgcccatattcttaacttaattgtgaaggatggtatagaggtgataaaatattcaattgcaaaaatccgtgaaagtgttgctttttggacagccacgcctaagagagtagagaaatttgatgaaattgctaagcatgttaaagttaaaatggatcacaagttaggccttgattgcaaaactaggtggagttccacctacaagatgcttagcattgctttaccttatgcacatgcttttgatcgtgcaaaacatgttgagaagctctttgattgtgcccctagtaaagatgaatgtgcttttgctgtagaggtagttaataggctcaagttgttcaatgatatcacagaagtgttctctggaactaattatgtgactgccaatgtccaactcttgaaaatttgtggggctaaagagcaaattaggcagtgggctgtgtcagggttacgggtaaggtataccctctacccttcgatatacgtcacgtatcgatatggtatgttcacgcgtatacggacgttttcggcatacgttaaggaaattcatcatggagttcacagatggaaggagtcctactcggtcagaactgggtcgtcattgtgtcgtgttcggtccagtctctccgagtccaactgggagacaggtgacctgcgatataaaagggaccccccaggaggacctaaggcatcgaatctcagagccaactccaccacagcctacgaagccggagcttatcggagccaagtcgccgggagatctagtcggatcaactcgactacgatcttgtcggtatcgtcgagttccactgttccctttgtaatctgtggttttcatcatataatcccatatcaactggattagggctattacctaccaaggggcctgaaccagtataatctctgtttcctgtttgcttgatgtcgtactacgtagatcctcgtaccagcgtaccccaataccctctatatccggtctacgggtattccccgtcgacagtggcgtgccaggtaggtggacttggtgctcaaggttctactactatgacatccagctttgtcgacaacagtgtcaacaccaacctcaaccaaggagttcctacttcaacaacactggtgtggactcaggtcggcgaaatcgtctttccggtttacaccacagtgccgatctcagctggtccgccaatggccggaaacgagaatgcagtggctacaacccagggcgactccatgtcgaaggatcctcccgccgaagcggagataggaacgtcgacaacatccgagcccgagaaggatcctagtgcggccaagccttgtctttccgacaggaatcacgagccgacgaggattacttccgaggtgacaaggtcctggtgtcctatccacaaaaccaggaaacacaccctgcaagcctgctgggtctttctcaacgtccatgctgaaattcgtgcctgcaaagagcgtggaattcagcgtacctctccaactcgtgatgtctattgtccaattcacaagacaaagaatcacaacctctcgagctgcaaggtctttctcagcgccatgaagacgccaccttctaaggtccagcagtcacgcatccccatcagggatgaacacaaggaacaaggagcgacgctgatttcagatcgattcgttggggtaatcgacatagatccccacgaaccatcagtcttgcacctgctcgaagactatggatcatcgacaacgagtacgccgcgtgaggtattggctatcgacgatgtcggcacatcagcgcgcaccaatgcggaagcggaaaatcaagcgactacactggcccagcacatcagagccgtcaacgcaatactgagggaaaccccctacgatcccattctgaacgacgatctcgcacgatggacagaacgactacgggaatcagtgaccaacctcagcaacgcgttcaaagaagccgctgctgcagtgcacccagaacagccaccaactggcgatgctaatggtgaagatcctgaacaccgggaattgcctcatcgagccaccccttcacctcgcggcaccggcgatctccgcgatcacctgaatggccgccgagaggcgcgacgcacaagtgacaacgagaaccgttctcaacatcgcatctcttcacgacgtcacgataacgaagatcgaggaggccgttcaagcgaagaccgaggccatgataaccgccacaaccgctgcgatcatgacgatcacgaacggcgggtgctgggcgatactggtcgaggacgtcgccataatgacgacgatgatggagatcggcgccgagacaacaacgggcgacgacaacaaggttctcgagaacccggccgacgtcctcgtaaccgcacgccggaaccgagcgacccatcgtcatcgtcatcatcttcctcatcttcatcatcagatagacatccacgaagggcgtatgatcgccgacaacccaccgcccccagcgctgggtgtagagctttcgatcgttcacttcgggatgtccgatagcctgaaagattccgacctggagcaatagagaaatacgatgggagcaccaacccagaagagttccttctggtttactccacggtactctacgctgccggagcggacgacaatgcgttggtgaattacttgccaaccacattgaaaggctctgcacgttcatggctgatgcatctcccccctactcgatctcttcgtgggcagacttgtggcagcagttcgtagccaacttccaaggaacttacaagcgccacgcgatcgaagacgacctacatgcgttgacacagaacccgggtgaatccttgagggattatgttcggcgctttaacgagtgcagaaacacaatccccgagatcaccgacgcttctgtaattcgcgctttcaaatccagtgtcagagatcgctatactactcaagagttggcaacgaggcgcgtcacgactactcggagattattcgaaattgtcgatcgatgcgctcatgcggatgacgcactgagacgcaagaacgacaaaccgaagactggaggagagaagaaaccagccaaggatgcacctgagtcaagcaagaagaaaattcgcaagagtaggaaaaggaaagctcaatcggaagttctcgcaacagaatacgcggaccctcccaagcgcccagacccacaaggcagcgatacgaagaaagcatggtgccctatacacaagtcggacagacactctctagaagattgcctcgtcttcaaaaagtcgctcgcaaaacacatgacatcggaaaaaggcaagcgagtacacgtggttgagaaggatgctgaggcgcctactcaggaatcggactcagcatacccagattccgatcttcatgtctcacacatctttggaggttccacggcatactcctcaaagcgagaatacaagaaagtggaacgtgaagtctgttcgacgtggcagggggctgcgcccaagatgaagtggtccgagcagaagatagaattctcagaagaggaccaccccaagattgctgtcatcccagggcaatatctgatcgtagtcgaacccactattcataatatcaaggtcgcacgagtcctgatcgacggcggtagctcaatcaaccttctcttcgccagcgccttggacgcgatggggatcccacgaaacgagttgacacccaccgatcaacccttccatggaattactcctcagtcatcgtccaaaccattgggcaaaattacgttgcctgtgactttcggccaagcaaactacttccgaacggaacagatcacctttgatgtcgctgaatttgatacagcatacaatgccatcattgggagaacttcactcgcgaagttcatggccgcatctcactacgcgtatcaagtgctcaagatgccaggaccgaagggaacaatcactattcaagggaacgctaagctggcagtacaatgcgacaagtggagcctcgacatggtcgagcacacgcccagcctacccgccacagctgagccacccaagaaagtgagcaaaacaaacaagacgccgaagccggacggcgcaatcaagatcgttccactctccagtgccaaccccgacaagaccgtcaagatcggggcatcactaggcgagaaataggaactcgcgctcatcaccttcctccgcgacaatgctaacgtgttcgcttggcagccgtccgacatgccgggggtacccagggaggtgattgagcacaaactcatggtgcgacccgatgccaagccaataaagcaaaaactgcggagatttgcaccatatcgaaaacaagccatacgagaagagctcgacaagcttctcaaagccggtttcatcagagaggtactccatccagagtggctagccaacccagtcatggtacggaaggccaacgggaagtggagaatgtgtgtcgatttcaccacctcaacaaggcgtgtcccaaggatcactttcctcttcctcgaatagaccaactggtggactcaacagccggttgcgagttgttgagcttcctcgacgcttactccggttaccaccaaataagcatggcaaaagaggacgaggataagacagcattcatcacgccgttcggggtattctgctacgttaagatgccattcggactaataaccacaggaaacactttccagcgcacggtccaaggtgcacttagtgaccagctcggaaacaatgtcgaggcttacgtcgatgacattgttgtcaagaccaagacaagcgactcattgattgacgatctgcgggaaacgttcgacaacctccgacgatatcgccttatgctcaatccagagaagtgcacgttcggagtaccatcgggcaagtgtcacaccttgaaaattcaaaatttataaattgttgtttaaaaggaatttttagaatttatttttaaaagtcttgaaaagaagatctaattttaaaaataaattccaatataaaatggggccagataaaatttcattaaatactttgcttaattctataattcctagatttttctgagatttatttgagctaaggaagtatttttaataaatggaattgcatttaaaaaataatttaaattgaaaaaggttttaaaaatcttcttttggctttgggccgaaagtcggctcaaaaacctctcttttctctctcctcggcccagccgacccagtccgcagccgcgcgcgcgcgttcggtcgctgacaggtgggtcccacctgtcaggtcgtcgtcttcctggcgtcggcctccgcccgaaaccctagccgccgccgccgccgccgttcctttccaaatccggccgcccctttccgtttccggccgaatcaatagaggggaaatgatctccgggatctcctcgaccttttctcctttggaatcttcggctaaatcggtttggaaaccgatgggttcgaggtcgattcggatcggctttgaccccgatcttt

SEQ ID NO: 47047 - DNA, 19853 bp, Oryza sativa
tccgatttagttggttcaagtctctaaatttttctaaaattgagatctacatgttaaaaatatccacatgtactgttcatgcttgtttatgtgctgttttggtgattttgctcttttctgcttagattccgtcgttttcggagagttcgttttcgccggagaagagtttgaagagttccaaggccagcaaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttggagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcttttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacaagttggtatcagagcttccttgaccctaggttatgccaaatggttacccatagaagccctctaaaaatgttggaaaaatagaactgttctcctccctttctcttttaattaaaccaaactaatagcacatgcacttcataatctgttttaatggttctcgttcaaaaatttattccagtgttattagtactgtacatctattactgtactaatggctcattttaccagcaaaagttttacaatattgttttatttaatcttgctgcaataaaataaatttaacatgttgattttataactttcttttatttcttttggaacctgatgttcaaaagtacaaaattcatttccaactgtttcaacttatcttgcaagcttggtttactttatttaattaccttttactttgatcttctaaactttattcaaattaatcccaaaacttgtgctattaattggataaatgtcttaactccctcttttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcaagtcaggaggtggcaaggatcgccataggagagctccgcgatcgttacagtgatcagttggccgatactgagtatcgctatcatcctcgtcaaccccagggaagtgaccgtggcagctaccttgagactgaaggaattgagaatgatgctaccacaaggcatttggttgagatgctgtgggctatggatgaaagtcgtgcggagactgtgttagcggctcaagatcgtgaagatcggaatcgtggtaagatttgcaagctagaagacaaggtggatcgtttggagaaggaactagccgcattgaagggagaagcaccaccgcagaaggccaggattcgtcttaccgcaaggaagagagctctatttgtccctcgctatcaattggcgccaaaggttcgtgtggtggagaaagaagttgccccaactctagcagatcctccggtcaacatcataagtgatgatgaggaagaagaatccaagcgcaaccattccaagattgagtgggtagcaactcaagatgatgaagatgagccgaaagagccttcaatcgacctccgatgctcggaagaactagagtgacttgttaagtcgttgtcttagatcgttgtgttagtttgcttgctttaagttgcttgtgtgtgcttcgcatgtaatttacatcagtgatgggatgtaagtgcatgtgtttgtttgcttttgagtgttaggaagttggtgagtttagtggtgtgagagttttcagttttgtaataaaactcagttaagatcaataaaagttaaagtaattctctgtcctaagtagtttccccccccggtttctcttcttgtgccctgtccagcaagatggtgaatactcgcagcaatgggaatggccccaacaatcccaataataataacaatgaagggaacccaactcttgcccaagtcctggctcaacaggtgcaacttatgaacatgatgatgcagcaacttcagaatcagcagaaccaaggaaataaccatgcacctccgcagaacaggttaactgattttcttcgtgtgaggccacctaccttttctagcactaccaacccagtggaagcaggtgattggttgcatgccatagagaagaagttggatttgcttcaatgcactgatcaggagaaggtctcatttgcatcgcatcagttgcatggccctgcctctgaatggtgggatcatttccgccttaacagaactactgctgaacctatcacttggcttgaatttaccgctgctttccggaagacgcatataccatcgggagtggtgtctctcaagaagaaggaattcaggtcgctcacccagggatcacgctctgttacggagtatctgcacgagttcaatcgtcttgctcgttatgctccggaagatgtgcgcaatgacgaagagcgtcaggagaagttcttagaaggacttaatgatgagctttcttattcactcatgattggagattatcctgatttccagaagctagtggataaggctattcgccaggagaacaagtacaattgcatggagcagaagaaacgccggattgctcaattcaagacacaacaggggaataatcagaagccgcgtcttactttaggaccccagtccataccacatggaagttcttcgtccgttgttcgtccgcagcgtcagttcttcaacaacaatgctggcaacaacatacgtaatcaagttccgcgtcctgttgcagctccaacacagcaacaacctatcaagagggagcaaggcagcaagcccgcggtgtgtttcaactgtggagatccaggacattatgctgacaagtgtccgaagccccgacgcgtgaaggttgtccctgctcagaacaactctactgtaccagtatcaaaggcccgtgtcaatcatgttgctgctgcagaagctcaagatgctccagatgtgattttgggtacgttccttgttaacttagttcctgcaacagtgctttttgattctggtgctacacattcatttttatctatgagttttgctggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagacctagatgtcatcctagggatggactggttagccagacataaaggtgtgatagactgtgctaacagaaaagtaactctcaccagcaatgatggtcgagttgtaactgttcatgcattgtcttctgaatctttaaggtcgagactgaaccaaataactttggaagagattcctatagtccgggagtatcccgatgtgttcccagatgatttacctggtatgccgcctaaaagggatatagagttcagaatagatttggtaccaggaacaactccgatccataagagaccttatcgaatggcagccaatgagttggcagaagtcaaaaggcaagtagatgatttgcttcagaaaagatacatcagaccaagttcatcaccatggggagctccggttatttttgtggaaaagaaagatcatacccagaggatgtgtgtggactatcgtgccctaaatgatgtgactatcaagaataagtatccgctacccagaattgatgatttgtttgatcagcttaaaggtgccactgttttctccaagatagatcttcgatcagggtatcaccagttgagaataaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtggtggtctttattgatgacattcttatctactcccgaactgaagaagagcatgaagaacatcttcgccttgcactagagaagctaagagaacatcggttgtatgctaagtttagcaagtgtgaattttggttgtctgaagtgaagttccttggtcacgtcatctcagcaggaggagttgccgtcgatcctagtaatgtggaatccgtaaccaattggaagcaaccaaagacagtttcagagattcgcagtttcctaggcctcgcaggatattatcgaaggtttatagagaatttttccaagattgctaagcctatgacacgactgcttcagaaagatgtgaagtacaagtggtcggaagaatgtgagcagagttttcaagagttgaagaatcgtttagtatcggctcctatcttgattttgcctgatgattttgcctgatccaaagaagggtttccaagtgtattgtgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcatcattaccttttcggtactcgaacggaggtatataccgatcacaagagtttaaagtatatctttacccagccggatctgaacatgagacaaaggagatggttggaattaattaaggactacgacatgggaattcattatcacccgggaaaggctaatgttgtagcagacgctcttagtaggaaaggctattgcaatgctacggaaggacaacggttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcttggaggatgagcaaggaactgtatggttgggtgagagaatttgtgtccccgacaacaaagatttaaaggatgcaattctgaaagaagctcatgatactttatattccattcaccctggtagtaccaaaatgtaccaggatctcaaggaaagattttggtgggcaagtatgaagcgtgaaatcgcagaatacgtagcagtatgtgatgtttgcaccgaatcaaggcagaacatcagaaacctgccggtttgctgcaacctttgaagattcctgaatggaaatgggaagaaatcggtatggattttatcactggtttacccagaacgtcatcaggccatgactctatttgggtgatagtcgacagacttaccaaagtagctcatttcatcccggtaaagacaacctattctggaagtcggttggcggaattgtacatggcaaggattgtgtgtttgcatggcgtccctaagaaaatagtgtctgatcgaggcagtcagtttacttcaaatttttggaagaaacttcaggaagagatgggttctaagttgaactttagtactgcttatcatccgcagacagacggacagaccgaaagggtgaatcagattctggaagacatgttgagagcttgtgctttagatttcggtggaagttgggataagaatctaccctatgtagaattttcgtacaacaacagttatcaagctagtattcagatggctccttacgaagcactgtatggtcgaaagtgccgcactccgcttttgtgggatcaaacgggagaacgtcaggttttcgggacggatatcttaagggaagcagaagaaaaggtgaaaatcattcaagaaagattgcgtgtggctcagtctctacataagagttatgctgacaatcgccgcagagatttgagttttgaagaaggagattatgtgtatcttcgtgtcacgcctcttcgaggggttcatcgttttcacaccaaaggaaaattggcaccgcgttttgtgggaccttataagatagtcagcagaagaggagaggttgcttatcagttggagttacctcaatctttggcaggagtccataatgtgtttcatgtgtcgcaattgaaaaagtgtttaagggtacctaccgaagaagctaatcttgaacagatagaagtccaagaggatctgacctatgttgagaaaccaatccgtattttggaaactgatgagagaagaaccaggaatcgagttatccgtttttgcaaagtccaatggagtaatcactcggaagaagaatcaacttgggaacgagaagatgaattgaagtcagctcatccgtatctgttcgccagttcttccgaatctcgaggacgagattctgtttaaggggggtaggtttgtcacaccctgaaaattcaaaatttataaattgttgtttaaaaggaatttttagaatttatttttaaaagtcttgaaaataagatctaattttaataataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaatcttcttttggctttgggccgaaagtcggctcaaaaacctctcttttctctctcctcggcccagccggcccagtccgcagccgcgcgcgcgcgttcggtcgctgacaggtgggtcccacctgtcaggtcgtcgtcttcctcgcgtcggcctccgcccgaaaccctagccgccgccgccgccgttcctttccaaatccggccgtccctttccgtttccggccgaatcaatagaggggaaatgatctccgggatctcctccaccttttctcctttggaatcttcggctaaatcggtttggaaaccgatgggttcgaggtcgattcggatcggctttgagcccgatctttccttctcgtcgccggtcgccgtgggccttcgccgccgcctccgagcccctttaaaaggaccccccgagctctcctctacccgtcgcccccttcgccttcgcctctcgtcgtcggagaagccctagcgccgtgcgccctagctcagccgtcgccgccgtcgctccagccgtgcgccgccgccgttccagccgtcaccgtcgctcgggaaggccaccgtcgggatcgccaagtcgccgccgtcctcgtccgttgcttcgccgccgtcggagaccgctggagcaccatcgccgtcgtcgaaccgaagagctccgccgcttcttcttcgtcgccgccgccgtccgttgggtttccgccgtcgttttggtcgccggtgagttcgccgtgccgtccgctacccgttggtgccctccgtttgcgtcctcgtgccaccgttcgccggcgagtgtgcgccgcccgagccgttcgagccgccgagccgccgccgccgatgatgacgtcatcgctgacgttatcggggccgtccgccgtgagccgtcgtggacccgatcgatctcggccgtccgttttggttggatcgatctcggccgtccgttcgcgtgaaccgccgccagtgcgctcggtccaccgcaaaccctagccgctgacgcaataaatccccttttcctttcaaaaataattctttattgcgtcataattcaattaaaaccggtttaagtgttttaatccgatttaatctttaaaaattcataactaattcatattagctccgatttagttggttcaagtctctaaatttttctaaaattgagatctacatgttaaaaatatccacatgtactgttcatgcttgtttatgtgctgttttggtgatttttctcttttcttcttagattccgtcgtttccggagagttcgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggatttaacctattctttgttatggcccttttgttcttgtttaccttattccttgataccttgggttattataatttgactagcatggaccttacatattggattggttcagctagatattagatgtaattgcttagccctgcttagaaacactagttcacttttgggttaactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttggagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcctttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacagcaagctactcggcttcctcgtctccggcagaggaatagaagcaaatcccgagaagatcatggtaatcgagaacatgaggtcgcctacaagactcaaggaagtacagaagctaaccggatgcatggcagcactaagcaggttcgtcgctaggatgggagagcgaggacaacctttcttcgctctgctgaaaaaacaagacaaatttgtatggacacaggaggccgaagaggcattcattgcattcaagcgctacctatcaaatccacatgtacttgttgcccctcaacctaatgaagaattatttctctatattgccgccacgccatattccgttagcactatcattgttgttgagagagagaaggtgcaactaccagtctactatgtcagcgaagctctccacgacgtaatgacaagatatccacagatccaaaaactgctctacgcagtaatcatgacatcaagaaagctatgccagtacttccaagcccacagggtcacagttgtctcctccttccctctcggtgaagtcatgagaaataaagatgttgtcagccgcattgccaaatgggtagtcgagctaagccaatttgatatccacttcgtgccacgaacagccatcaagtcccaggtactcgccgatttcgtagccgattggaccatgcccgataacaggtcagacaaccaaatcgacaatgaaacgtggaccatggcattcgacggcgcactcaacagcaagggagcaggggcaggattcatcttgacatcaccttcgggagatcaattcaagcatgcaattcacctcaacttcagggcaaccaataacacagccgaatatgaaggactactcgcggggataagagttgcagctgcgctcgtagtcaggtgactgatcgtgaaaggggattccgaactagtcgcgaaccaggtgcataaagactacaagtgctctagccccgagttattcaagtatctcgcagaagtcaggaagctggagaaaaggttcgatgggatcgaggtccgacatgtataccgcaaagacaacatcgaaccagatgatctagcacgacgtgcgtccaggcgagagccactcgaacctggcacctttctggacgtcctaaccaggccatcagtgaaagaggcaagcggcgaagatagcccggtcgcccccgacatcagctcgggggctatagaggcagagcgcaccgttgccgatatcgagaccacggacgactggcgcaccccactcattaaattcataggcagcgaagagttgcccgaggacgacgcagaagtcgagaaaatatcccgtaaagcaaaagtctactgtatgatcggcaatgatctatacaagaaggcaccaaacggggtactcctaaaatgcatcttgtccgacgacggcagacacctcctcctcgacatacatgaagagatctgtgggtcacatgccgccggtcggacattagtcggaaaagctttccaacaagggtttttctggccaaacgccctcaaagacgcctgcgacatggttcaacagtgtgaagcctgtcaattccacagtaaacacacaaagctgccagcgcaagcactccagactatccctttcacttggccgttatcgtgctgggggctagatatactcaggccattcccacgaggacagggcggctacaggttcctattcgtggcgatcgacaaattcaccaagtggattgaagcgacacccacgggggaaatcaaggccgacaacgccatcaaattcatcaaagggatattctgcaaattcggattgccccaccgtatcataacagacaacggctcccagttcatcagtgccgatttccaggattactgcatcaggctgggagtcaagatctgcttcgcctcggtttctcaccctcagagcaattgacaagtcgagagggcaacggcataatactacaaggaatcaagacccgcgtctacgacaggctcatgtcacacgacaagaattgggtcgaggaacttccatcagtactatgggccgtgcgtaccacaccgacaacgtccaacaaggagacacccttcttcctcgtgtacggctcagaggcgatgctccccaccgagctacgacatcaaagtacacgagtacagaagtattccgatgaggatcaggaagagcagcgatacgacgatgtgaatctactcgaggaacatcgcgaacgagttgccgttcgagcagccagctaccaacaagcccttcgccgttaccacgagaagcgcatccgagcacgcatgctttcgatcggcgactacgtcctccgacgggttcaaagccaagcagggcgcaacaagctctcacccaaatgggaaggaccgtacacgatcacgcaagttttgcggccaggtgcattcaaaatcgcagatggcgatggtcgcgagttggcaaattcctggaacattgatcaattacgtaaattctatgtataagtcaatagtatccatacttgtaagacatcttacagcctcaataaagcctattttttaggtacagactacaatcaaagtgttccttttcgatgatcccttacccagatgacacctaacgttgaaacctatcctcatgtctctttacgccgtcttgacaaggcctccgaggaacctaagggaacttcggcggggacacccagagccgataaggccttgtcggatcctgtagagacgaaagaccatgtaagatctggttgtgtaagagttctcgccgtgcgtattaaccaagccgtgtaatcggaaataaactttccaacttcacggctgggggctaggatcagtgcttgttcaaccgaggcaggtcaaaggtccaagagccttatcttccgagaagaattctccgatgacaaggctggaggctagggagagtgtataactcaaacgactgatcgaagtcgcgaagtgagaagacactcatacacactacgtccagagtaagaaagcttagtaagatagatttcttttctattccacaagtatttcttacaattccatcaaaattcaaaactatattacactttttccaaagacatttgtcacaggatacggagactaccaggaaggacaacgctagtccatcgactggaaaaccttctccgccagcggcgccatcgactttgccaggccatctatctccgtaggagttctctgggaacgagaaaacccttcgcggaggaactcgagatgcagctgcgaacgatgatctcgtatgcaggccaacacgtgccccccggcatatcggcttgagcgacgacactcctgcttcaaggcctcgtcgatatgttgaccgatgccttcgagctgggcataggccccattcagccatgagatgtatccggcagccgattcctcgggatccccacggggtattcggagctctctacagactctcgacatggatgtgcagcaactcttcagatacgagttgaaccacacctcacgaccccggagtgtctctacggcctggtcctttctcacctccagcatagtcctctcgagttccgcgacctcaaacttcgtcctccaatactggatgcgacgatcctggtcagcaagcgcactctcgagatctgctcagcatggaaacgactaagtcaagctgctcttctctcccgagaacacaacaaatcaagtcgatccagacggaagggcaaaggaaatggtaacaaaggacaacaaagtactcaagatcaaaatgctaaataaagctaaggcaatgaccgcacacactagggcggttgagaccaataaaagttttacaaagcatgactaaagagtacaagagagctaagaccctactcttcaaaaagcgagaggacggactcccccagatcgccgacctcctccatcacatccttgcgcgcgtcgctaaccgccccctgatccaagatcttccacagatcgagttcagggtgcgccagcctcacacatgcaaggacgtggcacaccccggtgtagatcccattagacgtctcctctccgatcctggccgcatgcttggaggggatctcctccatcaccgtcaccagctccgcaagagaagacgtcagcgagaactcatcgggattcgccgggatggtggacttgataccgcactccccggcgagctggtgcagaccagtataggtgacccgcaatgagccatggatttccgacaagttgttctcaagctccgacatgcgatgctcgagcccctgccgttgtcgctcgttgccggccaccagttccctcatcttctggaggtcctcgcgaacctccgccaggtcgcgcgctagccgatcggcgtgcttgttcgccgacgacgcagccgccgccctcgcctccgcgatttcgtggctaacaccgcgagcaccagcctcgaggaggcgccccatctcaacctggagctcctcccaggtgaggacggcagccggcgaaccacaatcagccacaagatcccccagacatccgtcgcctcatggctcctgggcacgacaacgacatccgttgaggccacggcaggagacgcgttggaggtcccccagacccatcttgcgctgccttcgcccgcgccgccctgcgaaaggctgcgattgagacagagttcgacgaaatcacgaaacctcaaattcattcacttacttctcgctgagcgtcacaagccgctgccatcgcggaggcgggggagacgcgtccgaggcctggagtacaatcgatatgatgtgaggtggaagttttccgactacgtgatcaaataacaggagaacttaccgagggggtgggtgtcttccgacaatgtccgactacagaggagaatttcctcccctttttcggaacatcgctgccactcgtcgtggcagcggcagcagcagtgtcagacgcctccttggcgaccttctccttcagcgacgctgccacctgatggtccacgagcggcccgatgatatcagtcagaggaagagcctatgtttcatgaagtcataatgcgatcccggaagaaaaatgcaaaaggaccgctaagtacacttacattgatggcagcgtcacgctcggctgcccctttctcgcaaagggggacggggacgttgctcgccgttgtcgggccgctgatcatcagttggctgacgcggcgctccacggttgcactattcaagcctgtagatcgagaacagaatccgataagccgggaagaacatgcgcataagggagtcaatttaactaaaaaggaaatacctcgaggagaaacccgggtcgcgtcctctggcccataataatcaaaggcaggaagggctcgagcctgaagcggctggatccgcctaccaatgaaatcggcagcaacttcataccccgacaacccccgttctcggaggtcgtcaacgatatcgatgaaagattggagggacggggtcaaggcaggtttggtggtccaagatggaaccttgtctggctgctcctcaggaacaacgaaggcaggatccgaatcctctacctgaagatagaaccacctcccccgccatttgctgcgagatgaggggcactgaaaggggatgtatcgtgacttcaggccatcccgaagtcggaaaccaacacacccggacacctttttggattccatccagcgtaactcatagtaaaagcggaagaggtcaagaaacggctctaccccaatgtaggcctcacaaaggtgaaaaatactcaggaaggcgatggagttggggttcaaatggagcaaggaaagaccatagaaatttaagaccaaaaggagaaattcagaaggcggaggaagaaaaccgcagagaataaagtcctcaaccgcaaccatgcgacccaggacaggctggggttcagtacctcctacttccctctccgcggtcccgcgactgggaagggcgccatcctcctgcagtttcttcagtgacacactggtggaggtagacttgtcaagatccatggccaccggagatcgccggagaaaggaccgagatgagttggctagggtttttgcgggagcgaagaagacgagggacgcttggaagctggagagttttttcaacgggcagacctcaaattggatccccaaaactcccttaaatagacgcacctccgccggtgcgaatttctgggtccgttacgcgtggcagtttttcggacttcaatttaaattcactcatgaccgttgaacttcactcgatgttgtcgatcactccttgtctctccgtcctcacaccgagaacaacgacaatttcgacatgtgaagtcgcgatcagtttcaccagttcatttaagcagaagtcggggggctactgtcagggttacgagtaaggtataccctctacccttcgatatacgtcacatatcgatatggtatgttcacgcatatacggatgttttcggcatacgttaaggaaattcatcatggatttcacagatggaaggagtcctactcggtcagaactgggtcgtcattgtgtcgtgttcggtccggtttctccgagtccaactgggagacaggtgacctgcgatataaaagggacccccgggaggacctaaagcatcgaatctcagagccaactccaccacagcctacgaagccggagcttatcggagccaagtcgctgggagatctagtcggatcaactcgactacgatcttgtcggtatcgtcgagttccactgttccctttgtaatctgtggtttccatcatataatcccatatcaactggattagggctattacctaccaaggggcctgaaccagtataatctctgtttcctatttgcttgatgtcgtactatgtagatccttgtaccagcgtaccccagtaccctctatatcctgtctacgggtatcccccgtcgacaggctgcatgtggcaataatattatagaggaaatgtcaactgagatgattgcgaagtttgataagtattggaaggagatccaaggaccaatgggattggccaccatacttgatcctaagtttaaaacagactacctccttgggttcattgagtccattactagccaatcaagtgaggagtgtacagacaaacttgaagaggttaaaaacaatttgtatgacctcatgaaggagtatgaaatggaagaggatgaagataacacagaatcttcagctcattcacttgctaattcaggtgtattgtcttcaattagtgcacgtgttgcttgaaggaggccaccagcaataagagttaaatctgagctagataggtacttggaggatgagttagtctcaattaatatggaaaacttcaagatttttgattggtgtaaggtggctgggacacaatatcctacattgagaaaagtagcatgggacatatttgccattccagttagcccagttgcatcagaggctgcattcagcactagtgggagggttcttagtgagcaccgcagctgactcacttcagatatcttggaggccttaatgtgttcccaaaattggctacgaaacaagtacaaaggtgtatgtgttgtaccattcaaacatagtgtgatcatttatatttttccattgtcatggttgcataataatcattacaactaattttgtagatgctgataatgaagaacctgcaagatttttggagctgtcttcaagagatccaagataagatggaggtattcttttcaaactaaaaataattgactattgcattgtactcccttcatttccttgctatcaaataattgactaatgcctatgtattttgcttgtcttttgcatgcagagacttgcactagtttgagacatgaagagtcgaagacagtgccttctaagctaacgtgtgcatgatgcctatttgtgtattttgtttattgtgatgatccattggatgatggttgtcacgaccggaaatcacccaacgggcgttccttacgtgcgtgtattattccttgtcccaggaggcaaggtacaccaaaagttgatacaattcagagtttaacaagcggaagcgtaaatagttaattattacatgggcagcgacggcccagcacactcaaagacaacgaagaacagcggaagactagggcgacgaccacaggcacttgacggcaggcacgagctagacaccaaagccttcatcttccaggggctcctcttctgggtttgggaaaaattgagcaagactgagtacaaccaccgtactcaacaagacacacccacaagtgcagcataattgcaaaggagtacaatggaattataatataggggttaggagttgcagtaaatagcattaaaagacacttagttgctcaaagctatgttgtaaacacgatcctagagctataaaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacagacggaagacgtgacatagttcccaacccatcctagccatagacaagagtaccgacccaatcccacctacggccggaacccccgggacaggtaggcaggactgagcccctagcagcagggcaccaaccctgtgccatgacatctcgactaccgggccgcagctcgtgtagccttcatttgtcctagagatgtccatcgaatcccccgacttcgtccatctccatccgtgtacttttgtttataaccagactgagccacaaactaagccttacccattagacatgtggaagtacggtggtgctttgcaacagaggcccgaagaccggtccttatatggccgaggtgcgactatcaaaaccatgcaccccgagcccagcctaaaaccattttgagagttttgaatagagggggcggggtgaatccaattccacaataatccaacaattccagtgtccaggtgatatgaatattaccacagtctagggttttaaaaccacctaatgttacctaattaatcagcgaagcatctacctaaaatcatactagtgataccacaaatagagtgtccactagttgggggttttgtttattctagggtgaacaaggtaataatagcaataaaaataataaggtcgtaacaaaggtaataggcatggctaaataaaacagtgataacgcgggaatttaaataaagcgataatgcaataatttaaatcaaaataatttcagaaattgggattcaatatgttcaaggatgatgtgtcttgccttgctcgctttcccaaacgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattctgagttcaaatggccaagttatagccatttgaagtttatatgctctttaaatgaatatttgcgaatttcttcatttaaattttaatttaaaatcggatttattgcgtcagccgaggggagagggcgcgcggaccgggtccacgggagcggggcccacgcggcagcctcacggcccacggtggaccgggtgcacgcggctcacgccgaccggcgccgtgggccccaggcgtcagccgcacccgaaggcgcgggcggctgacggccgagc

SEQ ID NO: 47048 - DNA, 1686 bp, Oryza sativa
gtcagcgagggtggcgggcgggcccgcccgtcagcggcgcgcgcgcggggaggaggccgagtgggccgcggggagaggagagggaggggagggagctgggccgagccggcccaagagggggagggggagggaaagggaactttttagggtttttctttttataaaacctttttaactttgtttatttcttcttaattatcatttgtgctctgaaaattccactaaaatttatttacgcattttaggctttttaggaaatatacaaaaatcctccaagccttatttgacttttaactttgcacattttaatttttgaaggctttcacatggattttaattattctaatcataatttagaggatgtattttagagtcgatttgggacgcgacaatggtgccccagactcatatgttgctgacttagtgactatgctcatttgtgatttgtgaaactaatattagcttcagactgtcattttgtggctcatgtgatcatgtgatgtttaatattagctccagagtctagactgcaattttgtggctcatgtcatcaggtgatgtttatttgtgttttgcctaatgaagtaatgacaaatgataatgatccttactgtgattgtgatctataatttgctgatttgttgagtggagtattttggatatatttgatataatgtgattgtgaatatgttgtttaaccggggacgtgttcaccatggagaaaaattcaccgcgtggtgatcggggctagagaaattatagccccgttgtagttgacgggggcggggacagtgacatattttcaccgtggtgacggggacacgggcatgaccccgacggtgaattaaccattgccatctctattaacaccagactcaaagatgcaaaaggtgccaggactgcgggatgcaggtgcacgtcacaagcctgagaaggagcgatcgtatcgcagagaaagagagaggagaaacggaatgggatagaggacagggcatgaccattgatgggagatttttgtggtgcatccagcatatggtgggtcccatggtatgctttatatttttccttttaatttccgtcgcacttttggacgtatcaaagcatgcatccataccaatatacttatagcaaatggtctatatcatatacctaattaaagaaaatatgtaaagctttcggcgattttttttcaattgaaatggactaaacttagagtttgcttgtttagaatagggcttaattccgagtttgatacacaatggattttctctgatttttgggacaacggaaaaatgaaaagataagaatcgaaaccctcgatcaattttagattatctataaggaaatgacctgatttcacaagaggtggcttcagccggtgttgggcaactgagagaatctggacagatatgggaaggcggagggaaggagaaaggaggaaaatgggccggcttagctacgggttgaggaagaaaattggctaaaaaaggcccatacacaaatgaggatttttatttagattttgttttaaataaatgctgaaatgatatttgtattatagaaaatagcaattaatctttgaaaattccgagaaaaaatcaaagagtgtaaataatcatgaagaatttaataaaaaattaaattcagccatgctattttatttcccacacttactttacttataaa

SEQ ID NO: 47049 - DNA, 2992 bp, Oryza sativa
acctatttaaaaatacctagatatctcaggaaatttataatttaattaactacaaaatgtaaatctttctcaattgttcctcaattttctcgttttttcttcccttgcaacgcacgggcactttttatagtcttttaaaatatttgtagtgtttttatcatctcacctgacataatgacgctgaaaaaaaataggaaatcaaaaatagatagctcccttcacaaacccagattcgtattcctggtttgcaacctaggactaaaggggttgcaacccggactataaattctctagcagttccaatttctttaaagtattatgtaattcacgttcttattagctttgaaccatttatttaaaaagtggctccaactagctaaagagtactgtactctctccttcccaaattgatcattatataatgaaatctaaaatttctcaaattgatcatcatataactttatggacgcggatttcatcggaatacaattaatgcaacatcggagaatgtgtgcatgctagcgaccaattttattaccatttctaattcgatctttattcctgatccaattggtactacatctcctagcgccggtccccctgctccgtgccaatcagatctttgttcccgatccagcttctcctagcactggttacaacgctcggaggccggggaaagaccggccgcgacgatggccccaacctttggcaccctgtgtcatctcctcgcttagagcaggtacaatagtagtagactataaaccagctataaccactgcatatatcgagaaaaaaagagaagagagaaaaaagcgggctacaaatttatagctagctgcaacacggactctaatatgttatgtgtgtatgagatgtgggaccgggtattaatggtgtagtatatttttatagttaactattgtataaatgggctattagattatttatagataatttagagtcagtagttggctatactattaaaatactcttaaggattagagcccgccctctcgtagtgagttcgtttccaaggttgggtgctggggttcttggttaaatatggcgtatatacataagtatataacgtatataaattttatataagtatgtattaaaaaataaaaaaactagaaaatatattatgtatacaaagtttgtatacacataaaaagttttttacacgtatataaactttgtatcccgtaaaaaaaacaaaaaaaaaacggaaggaaaaaaccgaagaaataccgaaaagatacaaagaaaaccgaaaaaaatcccacgcgcggcgcggcttctgccgccctcctcatccgcgcggacgtcggcgaattagcaatttcgggtatttttgctagtaattaataataggtatactatatatatataatctcctagggcttagggttttaccttaatttccttctccaactcgatcgatatatatatatatacacaccctaagccccggcctgcaacaaactacaccgatcgaccaggcgggcagcgagagatgatgcgcccctccggcctcctcatcagcggcggctccgtagtcgtgcggccggcaaccatggctgcgcgcgccccctcgcggcttccgtccgtcgtcgtccacctcccgaggtgcaccgccacaggagggccgccgcactgcaggctgacagcggaggcatcgtccgtcctccccaacatgtccgtagcgtccccatgggtcaacgatgacgacctcaccgaggtgatcgatcgatctcatcttcgatcatgatctcttaattctttccttcgatcatgcaatacaaatacaatatagaaaatccatattgattattctctaaattaatttgttgtttaatttcttttgctgccgatcgattactcgattaaattagttaggcacctgctgatccatcttgctaacttcataacttaaactaaaattgttgcattttgttttcgatgttccgttgaaacaactaatatttctatttattattagtttaatagtatatccttcatcccaatttgatcatcccctaaataaaaggtgcaaagacaaggacaataaaattttcatgtttttaaattaattatcaccaatcaaggtgctccatatatccagtggatattgcatcacactttaaatgttgcatggaattgcactaacagtcgtagcatgcatatggcttcatgcatgcattccattcagcgatgcccaattaccctttgcataataaataaataaagagacacttattattatatgataattattttaggaagacctcaaaatcgttaggtgatgatcaaattgggatggagagaatatctttagatctaatttatttatttgcttgtgtgatatattttcattattaaaaaaaatctgatttactcatatagagtcgtatcaattgtatgatatctatcgaatattatttattaattactccctacgtccctaaatatttgacgtcgttgacttttttaaatatgtttgaccgtttgtcttattcaaaaaatttaagtaattattaattattttcctatcatttgattcattgttaaatatacttttatgtatacatatagtcttattacatatttcacaaaaatttttaaataagacgaatggtcaaacatattttaaaaagtcaactgcgtcaaatattttgggacggagggagtagttaattatgagcataatatttacgtttttggcagatttccatctacgaggtaattgcgtggtctgcagaagaagccatggaactcatcaagcagactccacctccaccacctcctcctcctcctcctccctctcctccggcgacgcacgacgtgggccagccacctcctcctccctcccttgcagcgccgccgccggcgcagcacgacatgggcaagctactccgcatgtacgcgcggctgctccgccgcctggagtcgcaggccatcgacatgtacgccggcagcaggaggctggtgg

SEQ ID NO: 47050 - DNA, 9876 bp, Oryza sativa
tcctgcagccctacaaagtactgaaggatccaagcttcacagtgcacttcatactattgaagggagtagttgcattttcaattgttttcagtggctactcgtgatagaaaccattatatatctttggctgttattgtgacttatatgttctaaactcatccaatttgtttttttggagccctttttgaaggaaattttatttatcttagacaactaataagacggtataattagtgcaagaccactctcaatctgtgcacgcatcatatgaattactttctaagaaaaggaaataaaaagacaagacaacaaatatcataccgtccgaactataaccactagggatcatcatcctcggacaatcaaaacagctcttctaaaacatcgtctctaaaaaaagaacaacgtgtgtacgtatcgacattgccatgatccaatcagtaaatataccataacataggttgtagttacactatgaagaaactcttctaactctatataataccttcaacaagctaggaagcaaataaacatgcatgccgccccaccattccaaggcggttcttccataccccgtacacttacaagcaagcaaataggcacactgctaaaattcatgctcttaacaagcacgccaataggcacatggccaaaattcatagggtccatctaaagagagagagttattgttagtgtaagtgatgcatctaaatagtggaagagttattatcagtgtaagtgatgagcaagcctataggcacatgcattcaaaatttgtagggtccatccaaagagagaaagagctagatctaaagaaacaaagagtgagtgttgtcggcataaatgatatcataatttgaaacaagatagcttcgacctacatgatgatataaaagtcagtaactagtgatgaagatgtgtcacaatgagtaactgcacctagtggagagaagggcttaggcttcactgccacctgcgcaaatacaatcactcccaccgttcatagatcaccactgcttaaaaaaaagtttgtgcggggcggtcaagaacctgtttacaatggtgttttagacccgcctacaaccaaggccttgtaaaaatcacatgatttgggcaagcgaaataacgaccgctcttgcgaaatcaatttccatggacgactcccttaagtttaaaggacttgcccatgagaacaaatttctagtttttgaatttgttggtgaaaaattccgtaatttagtagacacagcatattaaatcatactccatccgtccaaaaaaaactcgacctagggttacatattctcttttttttagggggggggggacggagagagtatgccttagatataatggctataaccgaaatgagagagtatgccttagatataatggctataaccgaaatgtagttgcaacttgcgagatgatgcaacagcctgttaattgaatgacaagatgcagagaaatcgggcaaaaaggcacacatcagcacactcgagatgatagtactaaagaaggaagacgtatatgtgaatccgtcttcgatcatgtgaaaccggaagcccaaaaggcacacatcaaaccattttcaaagatggaactgattgtttatgtcgacaaatccttcgcacaatttataacagttgacaaatccttagctcaatttaggcatcacatagttcgttcaagagcagcattcctcatcttacccaataagttatgttcacggaacaggagcaattattagcaggtaaaacaaggagcatcgcctcgtcaggtgcaacaccaacaccagaaccggagctaccaatgtcccaagcaattagagcattcacttcccttcaagttgtaccaattgccacatgacgacaatagtctttgattaatcaaaaccaatgaatcgaatatacaatttcagcatattctagcaaacaatgtaacattaatgaatcgaataagtagccgacacaaacaatggcaacattcagttcaagggccacatttcctcggggagcaaagcatatagcacacaactccacggtaagatagtaatagcatacgcagccacaaacttattggacgatcttgaaaggcatggttattgcaaaaaggatcttcttggttctctcactggttgagatcaaaatcaataacacgcacaaactctatgcaagtcattcacttggaaaatcaggtatgtcacaggcaccgggcatgctcgcccaggggtcctcaaggtcatgttcatcgccttgacctgcagcagctagattggtctcatcagaaagacccccatgaccgaaagcgtcatctgcatctttggcaaactgctcatttgagggcggcaattcttcgttaaactggcaataaactggcaaattcggttctagtgatacatcgtgcctccagaaagtagggtccaccaagggtggaggttggctgtcaaggaataggctgcttgcattattgttgatgccaacaaaagcatgacaacctgaaaagactaacagtaagttttatgtgatattgttcatgttaaaataagagtgagtacacttactgttctcgaggagatcatcaccaatgattggaaaggaagaactcagagagaaagcattcgattgaatcacttgattgcattgaacacgaggaaaacaagcatcaaaagatccttgggaatttgcaagttccccttgtccatgtcctccatgaaccaatgcatccagcagaccattgttgtttggagagagatattctgatctcagggagccaaagtcaacctggtcaataggatgtcctaaggggtcgtgatatgaccatgcattattattgttaaagtcatagttgggatattggagtgaagggagctctacattcatgggcctctgtatggtcccagaagtagagaagttgccatcaagaattggatgtccactgacaatggcactaccaaaaggtactgactgatcttgtgtggcaatggcactaccaaatggacttgtggcatcaactggaagagaatttggagtcacacaatttggccgaatataattttctggtctactatagtctaaattatcgaaaaaaacctctttgtaactttgaccatttccctgtaaaacctcatttgttcgtttcttggcacgtgattcatcagggctttcacagttcatcacttccagatctgtcaacttaaaatgattaaactccttcggatatagaggttcaccagttctctgaattctcttacatctagtgttccagaagttcttgatttcattatctgtgcggcctggcaactgcaataacaacaacagaagttcagatatgcaagttaacatatgatctaataggatttttctaggcaattagactaaagaaccttaaggcattagcctaataagcatttgcattgtacctcagatgttagaatggcaaatatagcaagatgtatcatggtgttgcaatagttggagaggatttaaacatacctaacgaaacagtgaatgatattgtctttacataaatgaaaatatgatgaagtcctattcgatgaacaaaaactcataggaatttagtaggaggcaggaaaggaacccaataaaagtttaaaaatatatatgaccatgtcaatgaatcctcccataataattgcagaccctaccttatcctgtggcctagatgtcagcttttcctgttgcagtttaaaagttgacactacttataacatggctcagaaaactaagaattgaaaattaaattcacatctttcgagattgtgtctagctagcgagtcacagtacatccgcctgcttacagtaacacaagggaaaaagacagttccatgtgttaactgactgtatagattcaagaaaataggtattctatttttttctaattagtgcaagctctgaatgctcaaacaagccgagttccttctctacagaagaggaataacagtaaaatatatatctagtttcttttctgcagtgcagcactgcaagcacgtgtgccccatggcaccacaacgcactaaagaaaaagtatgcccggcaaccattctctatttaagtccttagcaactaacgatattaagacaattaaattgaataaaataaagtctgtcaccaatatacataagaaagaactatttaatgtccactgattatatccagacactagcaaatagtatatatggagaagactgcactagacaaactgttagctggctttaatctagagacaatattttcctctaatccaatacaccaatgcatctaaatatcagatacatgattgcaatatgccgtttggttttctacggatactcgactgctattctcgggaccacacctcgagagctattctacggatacatgattaatagattatatactgcttgattaatagattatatccagagcaagggtctcgacctcgccgacctcatctggttgtcaggtaaactattcactcttccattaatttcagtatttcaccatccatttcagagttcagacttcaccatcaatattagttgcagtttcacctgatgacagtatcgtttctgaaaagaaaagtaaaaccattcacttaagctaatgaatggttaacttgacacaaacggcagccaaagatcgattttcacgttatatcctaattaagtcgattgattactagctagtcttcaggatagaactcagatttggtgttatatctagcttgatctagctagctacgtggtgtttgcaaatgcgtagtacaaaccaccaacaaatagtgaattagtgatgtgatatcgtgatgcaatatggagaaaacgattgttaacttttgcaaattctttatgtgttcagtccgcaactaggacacactctcactctcactcactcaggcactcacatcacaccagtaatgctgtccctaaagattcagaagatgaaagatatatagcctcgatcacaccgattttcatgtagtaacaatactaacaaacaatgatcctaataggaacctagaacagtgactacagtctacagatgccgaatttctatccattatctacaaaattctcgagccacgacaatccagaattgaacagacagcttacgtccaacatggaggattgggtctacttaattcatagaaggccaaagcttagctgaattttgttcacgggtatcgcatcaaatcaaagttaaaaaacagtttagatacgctgtttggttttctacggatactcgactgacaatatgccgtttgttctgattataaactaaacaatttatattaatcaagcagtatatcatgcttctagataggtagtatatatacgactaagttgtaacttgcaaaggttttgcagccaatggaggccagtgtccaggtaggcagccatgaggctctgcccctgcttatgtaaagccactacaagcaagaagatttaaaggataattggtctgaatcaattttctttcgatttgttggaggaccaaatactatttcagacaagactaacaacaattgtaaaagaacgacttactttgttattctctgcaaacaaggaataatggcaaagcatttgtctactccttttaacaaggccatttacaagagtgcagcatgtcaaatgtgtctgcaccatggcactacgccacactcagaaaaaagtatgcccagtggccattctctatttaaatcaagttggagccaattaaatgaataaaataaagtctttcgccaatacagaagaaaatactggttgatgtactctgaatacatctatctacgagcaagtggtatatttgcggcccctatatttggagtggacagcatgcattctccccactaggcaaactgttggtaggctttaatttaggtggttaaatatttttgctctaatccaactaatacaccaatgcacctaaatattaagcatgctactaatctaaactaacaatgaacggagtatcaatgcacaagctagcaaaaccaaggaaccatgaaagagtaggaggaggagcacacttacagagtttgccatcttagcccacttgttccccagccataaatggagcttgatgatcatctcctcctcttccttgctgaagggccccttcttgaggtcgggcttgaggtggttcgcccagcggaggcggcagctcttgccgcagcggttcagccccgcgttcctctgcacccggttccagttcccctcgccgtgcgcctccacgtactcccgcagccgcttgtcctcgtcgggcgtccacggccccttcttcagcggaatcctgccacgcacgcgcacacggccgccgccgccgcggcgacgaacccccgccctagccacaccgccctgctcctcttcgccgccgctggcgtcaccctcatcatcgccgccgtcgccgtctccgtctccgttcgggtgcagcatcgccggcgactccccctgcgagcccgccagcctcgccgcctcctcctcctcctccatcggcgacgaaccctccatcctcatcctgcacgaggaaaatccagtcaaatccccccaacaattcaacaaaaaaaaaatcaaaaaccaaaaaccaaatatccaacgatccaatctcgctccaccctagcccgaactaatccaaccagcggcgcgtggatctccagcgggggagagtgctcaccggcgtcgagacgaggtgggcggcggcggcggcggcggcggcggcggagagcgaagtagagtagtagactaggcggagtagggaggaggaagcaagtagtagacgacccccgatgacgatggctcgtgtcctgggccggaatgggctgccatctcgaggcggcccaactagggtttgcttcgttactaaggtttatcatgtaatttttttataggaaaaaaatatcaaaccctcttgtttattttatccatggaagaattattatatatccattcagataggataatgttttaaaaaaaggatatatgtatttaatattaaattccatggatgaaacgtggaaaagatatcttagtatttaaaagaaacaaaggatatatattccgcgtgctgaaattaatgttaggtacgttctctcatattaaggttgttttgaattgaagccaacacgtgtcctactgaatttttggtaacttcaatagttaggaaaaagctagatgtgtcaacattttcttgctaaattcttaattattaatattgatgggtcatgctatgggtgtatttagatttttataacttacatcttgatgaaattattgtcaaagggggagaaatatacaaaatgcatacttcttgaaaaggggagaattgaagttctagactcagtgaggagttgaggtccagacggtcaaggataccgggtgacgaagttggatacgagatggcatacggtggatggataccgtgtgggtgaaatctttgcaacgggcttcacgaggtgtgcgtgcaagcgtcggtgttcgcgaaggaaattggaaagtaagagtatatggtgctacagtacacgtggtactgtagcatgcatatatgtgtgcctactatgaattgcagtagcgtggtgatgcatgttgtgctatgcatgtgtgtatgcgtactgtgcagcatgcagcggctcggcttggtgatgcaagcagggcgtcggctggcctgggcatgtggcaaggcaagccgagtctgactcggtgaattttctgtggccggctgtggctgcaggtttcggagagtttgtgagaattacaattttttaagcaacttttgtacaaaaatttttttacaaaaaatacaccgtttagcggtttgaaaagtgtgcgcacggaaaacgatcgagaggggttagaaaaagagggtgccgaacacacctcattgtgccaagatgaaatatgactatcaaaagttgatggagggagtacttaattaattatgcactgcataatgctcacatcctaaaatcatgcaccagcgcgcttcactgtaccaccaaccagcagggcagccaccattggatgaaggcatgaagcacacacgtcctatttgattcgatccccgaattttgcctggttgccaatttgcgtgacagtggaacgcaacagcgcaactcgctagatagctgtacatccatgtgcaaacgaatgaattactaacgattattatgtgcacaagcaaacgtacgtgtaacacccttatatcggagcgggccaaaaaattcaaatcagcactgaaaaggtggaactaactgctggcccgctacaaaaaattttagaaaggtatttcgaatggaagttttttttactgctgattatcggttaaaaaaattggttaacttgtaacgatggggtgacgtttttcatttcgatagtgggtaccatacagggtttgccattcggattgagcacgatccacctgtgtaaccttggtttacaggactgcattgagtgtttcttagatttagtggtgaacttcctgaaaacgatcatttgttttgtccgatgaagcttacataaaatctaggatgcaataataaacctcgcatttgtgttgtttcccgtgaagccattcgaaacagattatctgtttgtcaagcggtgtgcacatttatggaagtctatggatatatcacggtaatgtcacagcttgttgttgattcacatccttttctgccagtggtattcctatagtattcatttctacaaataaaatggattaaaaataaatttattatgagacgtaagaagtaagtacatgaataattactgaaagcccaaagcgaaagggggcaaataaaaaaggcataatgcgtgcatatgcttttcaaatttcaagtagtttgaggttggcgcatgcacgcacgtcggccgctcgctcgctgcaccctgcgtgccggcccgcgaggcgatcagtcgagtcaggctgcattgctggctgctgcaacttcaacacgacgcgcgcgcgacgggatcggagacggagacggcagaggcaaagaccgccgtgcggcgcggcggcgcgcggcatgcggcgtactccctccgtccaagaaaaagttagaccatagatttccgtgtccaactttaactgtctgtcttatataaactttttttataattcgtatttttattgttgttagatgataaaatatgattaatattttatgcgtaacttgtctttttaaattttttttataaatttttcaaataagacggacggtcaaacgttgggcacggaaatcagggtttgtattttttttaggacggaggaagtagtagccaagatctcgtccgtcgtgtccctctccgcaagggcgacgtccgtagtcgcgcgggcgcgcgcgtagtacgtagagtatcgacgacttgcgcatgcgcgttgtttcggtcgggccaggttcgtgccacctgcaggcttgcagcccacagccacacatggagggaggcaacacgggggcgcgtacgcttgtcgcagataccgcccggtgcgcacgcgcgtgcacgtgcgccggccgttgactagctggaaaaaaaaggttaaaaatatagtagtattatttttcttctatgattttgcgtggatataccgattaacaatgtaattacgcaatccctgaatccctaaaaagaacgatacattttgagagcgtccgattagttagttaaaaaaccacgcgtgcgcggcggagacgaccgaccgatcgatcgatcaacctcagcgactcctgccggccacctagctcgatccgtccggaaagcgaacgcgatcgatcaacgacgaagccgcgcgcggcgcgcagcagctagcggctagctagcgcggcatgcacgcagatgcaggtgcgctgcatctcgcgcgggggggggggggggggggt

SEQ ID NO: 47051 - DNA, 3579 bp, Oryza sativa
ggcagcgtgggggctgggggggtctcccctaccccctaataaatcattagagcccctattaagaccccttaaaatttaaatccatatatctattgtaagggggctaaaatagattttatctaataatgttataaggcccaaaggctgagaaaccccactataattttatcctggctccgccactgtgtaggatcaggatatattggcatgtagcctcgtaggctgaggcaatttttgagatgataaatgttagattatataaacttctctaccttacctctatttggtattgccaatttttttataagactagagaaaatgcatgtgcgacgcaacgggtgaaggctattctaatcttataattattataaggtttagttcaggtaaaactcaccgttagaattcgcttggatatattattttagaaaatcatgagtgttattaggagtccaatcgtctcaagttagcatgcgagttttttttaagagatttctatgcgactcctttggtatttctaaaatcgaacgaacttaaaaaccgactcatatacggatgacgtaccaaagttctggcaaaaacatcttcagtttttataatagtagagatataaatgggagaagttgttctgatatcgtgcaaaaaataattgtgtgaattaatgtgccatttggaaaattgagccaatgtggaattaatatatgtgtatatatgggtattacccaaattttggtaaaattgtttggcatatgtatatactccctctccgttttatattagaagtcattttgatattttactactaaatttatagaaaaaattatcaacatctaaaataccaaattttagattcattaaatctataatatgtttgttttgggttgaaaatgctactaatttttatataatcttattagtttgactaagaaaaaaaatcaaagctaaacttttattcagaaacagagggagtacaactttagcaaatgtttgacattgacatgctttgatagaggaatagcagaacattttttttaccagcaccaatagtttcgaaaataaaccattaacaccttatcgatcggaaacttcaaacacaacaacctcaaactatattatactcgttagcatattccccctttgattaattctgtaagaagcaatgacgaagaagtatgtaattgatgatcattccaacccatagattattctcatacggaacaaatgactcggtaaaaacataattaaatcggtgaaacggtgtacatgtgtgtggctaggtaagagacaccaggtcctaaaaggtattagcatggactaaaaatatattttattaggataatgtcatcaaattgttcccctgcaggttgttgcactaaaccgcattcttatccatggttcagctcaccgggacacaaacgccaagccatggtccaagaagatgaagagcctgctagagcaatttgctagaaattaatattggtttttagtagcccttttgcctggcaacttgcaagagctgagctgaatatagcagctaggagtagctcataattagtcattgctttagcatttaggggtagattaagtggtccattttgtaacaattgattgtacaaatggtctacagtagatggattcagatcccctggacggccaactaaaagtcacaggtccaagaaagtgaagggaagaaaaaagaaaagaaaagaagaagcgagccgcaagtttagctgattcaataaagtgtttcaagttgtccgctttatgccttgctgatgctgatgacttgtgttcacgccttctgtttcggataaactggtcgaattttccaccaaattgtatgggattatcaagaatatatttgtattttgagggctgctataaaacggaatctcgttgcaacatgatagacatatttcgttctatcaggataccgttgtctaggttttctgttgtattttctaatacaactatatattccctccgtctcgaaaagtataacgttggttagttcacaacacaatatataaataatccacactgttatgaagacagtccagtatatattatttcttatgatcaacgtggtaatttactatactagtaataatttggttattttacaaattagtcatttccaaacttatttcgaaactaaccgtgcagaaaaaaaaactttaacaaaaaaatatgccattgggtcagcgccaaccgtcttggtgctgatgagtccctgtcacgtaagtgagggggatcgtcctcggaaccatgtggatagggggctcaacgtcaacatagctaacgttggtatgtttaacctcagcgccaatgtctctggtgctgagaacatggcttaattttttattgaagttttttttggcacggtcttagtttcacaataaatttctgaaaatgatcaatttgtcagaaagaaaaaaaaaggtgtaataagagcactcaacaagttgtgaagttgccttgaaaaggatacaaattttgaagtaagaaattcatttggagcttgtattgacagtgtacaaatcccgagtatccagctggttttgcacgttgtcttgtgcccgtatggctttctcacttctcagtcaccagttggcagtttttgtttctcgaatagagacgggccggtgcagctttggttgggtgcgttgcatgccagcatccagcgacgaccagcttggcccaattctccggacatccgacacgtacgtgcagctaaaaagtaaaactacacgcatttattactccatattttttttgtttgaaatacctgtcaatggttatactattctctttttaactttgatataagtattttcttaaaaaactgtgtagccaccgtaataatgtgattgtgtcatactgtaaatataatcatacaactatcattaataataaattaggaagaagtttgtttttctttcacgaaacaatacataattaataataataatacttgtctagatttatataaaagtaaaacttttctagagaggtagtaattatatttttcttaaaacacagtacatatatgcgctcacaacgtgtgcatactcacgtatctttctaaatgcgcgcgcacaccttacctctgtaaggacatgatcacctcctaaagacatggctggtatattttattttgggattaacgaaatctcaagtatctcgttatcgattggtatcttgcgaaccactaaaataataatttacgtgaacgctagtgcacctaaatctacttagccgtaaatacgagcacctgagttaaattagaagccagtaaacccaaacgatcggtttcaccttaggctgtgtttagttcattaaattggggagaagtttagggaaagttggtagtttggaaaaaaagttgggagtttatgtgtgtaggaaagttttggatgtgatgtgatgtgatggaaagttaagagttgaagaaaagtttgatgtgaactaaacatggcctaagagaacccaaccagttaaagctaaacagacttggtattcaaagttattcagtcaacaagtacggagggagtgcactactatttacggctccagcaaaaa

SEQ ID NO: 47052 - DNA, 4775 bp, Oryza sativa
atatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggagtacacgcttagctagcatttgtgaaacaagtcttggcatatgtcattttcaaaataagtttcagcatggatttacatttgtaaagtaaatgtaagaagggccaaagtgttaaaattctagtgcaagcatctttatgcataccaatttatcaatcaaaacatatttttttgttaattaattactccatctatcccagaatacaagctttttttttttttttgactctgacatggttttcgatatgttactttgactaacaatatctataaaagtaagatgttttaaataaaaagatttgcatattatgataatttgtttaatgataaatctagtaatatcaattttacatgattgatcttttaattttttttactattaatagtcaaagtttaaaatatttgacttgtcactttgttaaaaatgtttatattttgagacggagagagcacataagagaagtccacacattggaagaaacgaaaattagcacaaattcgttccgctaaaattctattaaaagtgcatacacatgtgtgattattgatttaaacaccctgttgattggagatatgcacccatgacttcatcgtcttatctacgatcatccaatgcttgactcgtccaattcttatactttatctttactagtaatatgtctatgcgttgcaaaagacactacaatataaacaatattcctaaacggctaaaatgcatttctgcagatggatgtagcaactgcatgccctcaggtgtatatagaaatagggatttcccagacaggtaacacaaccacacgtgaaaataggatttttacacacgacacgtttacccgactgaaaaataaagaatttttgaataaataaataaaaattccaaaaagaaaaatcctaaaaaccctaactcacgtatctttctaaatgcgcgcgcacaccttacctctgttaggacatgatcacctcctaaagacatggctggtatattttattttgggattaacgaaatctcaagtatctcgttatcgattggtatcttgcgaaccactaaaataataatttacgtgaacgctagtgcacctaaatctacttagccgtaaatacgagcacctgagttaaattagaagccagtaaacccaaacgatcggtttcaccttaggctgtgtttagttcattaaattggggagaagtttagggaaagttggtagtttggaaaaaaagttgggagtttatgtgtgtaggaaagttttggatgtgatgtgatgtgatggaaagttaagagttgaagaaaagtttgatgtgaactaaacatggcctaagagaacccaaccagttaaagctaaacagacttggtattcaaagttattcagtcaacaagtacggagggagtgcactactatttacggctccagcaaaaacaccacaaggacccggcctctagctagtcggacgataattgatggtcttgactgagaagtcgtgatcatgcactgccaggcatcggcatcgtgtgtccatcgcttccctgaaacctcgctgtcccgtacgtcgccggcatcgtcgacagcgatgcacctgctcgcgtagtacgtgaatgcgcctgcacctagaccaatcgataattaaactgtacccatccgacgaaagagtacgtactggatctcgtctcgtcgagagatatagctcgatcgatggatcgatcagtcatcagtgcatgcactgcacccaccaagccaacgtattacgtatacttagctgcaggttcagtgaacggcttgcatcgcgtcgatatgatcgaatcggacctagctagtagtagtagtagaagggaccagagagatgtgtataggagtaagggtgtgcatgtgtgtgtttgcgtttcttttttcttttcttttttttggcaataggggaaaatttggactgggaaacttgtactgccaatcatatcaaaatgtcttcaattaatagaaataatagtatttttgggtggttcatataggtataatgattagtaaagggtattaatgaaatgaaactcgaatagaagtagatgagtgcatagaaatggacttattcagagacaaataaacctataagatttaaaaatttattatagaatatatcagcttacatctactttttttatcacaaccaataataatcaatcaaatttatccaccacttcctctctcaacttatcctaattgcaatgattttttttcatttaattattgttttctcttatttaatttcacatgctttcttaataacccataattaactctagaaattgttataccatattttatcacccaacgaatagtaacaattaatctctccgtctcaaaataagtttttttcacccatttcacacaaaccaatacaaaaccaaatagactaaaatattcccattttatcaaatcccaatacaattatttttctttttatctactcctaatgtattatccacactactttcataaactttgagatataatgtttacttaaaaataaatttatcttagaacatataggaagaaataaagggcttatttggtttggtaccctaccaaaattttggcagtgccaaaacctggtaagttttggcactaccaaaattttggtatggtagcacagtaaatacgagtgtttggattagtgccaatgttgtgccaaatttttatgggtcaatttccatttggattggtaccaatgaaggattaccatttttttttggtgtaatagttttggtactatttgctgcagaataagcacaaataaacagagcggtgaggcggccagccgaggagacgagtagtggctgggagtagtggctgggtatttattgaagtagagaaaagatgaagccctagcttcttttttttaacggaagtgcgtgaactagtttgtgcttagccaagttgtgtggcctgcttctgggcacttccggcgggcgacggatggctgccaattccagcctatgccttgctaccaaattaaacctaggcactaccagtgatttggtcacaatccaaactcacagtggtattgttctgataactaaaatattggtatggcccagtttttatagcaaaccaaaacggcccaaaaatgaactcattccggctgtgagggagtactgcacaattttactgctacagaaaaagcaccactacaataatagtctgcacaaattacgtactgtagagaaattgaaactggctcgtactactacaataatagtctgactgaaaagtcataccgcccgggcacctctcattttcgttccatgaacctggctgtctcgtacgtcgccggcatcgagagcggccgatcggcctgcaggctaaaagtcctaggagtacacgcttagctagcatttgtgaaacaagtcttggcatatgtcattttcaaaataagtttcagcatggatttacatttgtaaagtaaatgtaagaagggccaaagtgttaaaattctagtgcaagcatctttatgcataccaatttatcaatcaaaacatatttttttgttaattaattactccatctatcccagaatacaagctttttttttttttttgactctgacatggttttcgatatgttactttgactaacaatatctataaaagtaagatgttttaaataaaaagatttgcatattatgataatttgtttaatgataaatctagtaatatcaattttacatgattgatcttttaattttttttactattaatagtcaaagtttaaaatatttgacttgtcactttgttaaaaatgtttatattttgagacggagagagcacataagagaagtccacacattggaagaaacgaaaattagcacaaattcgttc

SEQ ID NO: 47053 - DNA, 2841 bp, Oryza sativa
  unsure (1)..(2841): unsure at all n locations
ctaaacggctaaaatgcatttctgcagatggatgtagcaactgcatgccctcaggtgtatatagaaatagggatttcccagacaggtaacacaaccacacgtgaaaataggatttttacacacgacacgtttacccgactgaaaaataaagaatttttgaataaataaataaaaattccaaaaagaaaaatcctaaaaaccctaactcacgacggtgaatccaggcacaagggatggaaagaggcctccggctgtggggcatccctccaaaggttagcagcatcggatctacgccatcgcccctagccactgtcaacgtcattgccctttcccattggaccagatctggcgcccctccccaccacttggtcgttggatccacgagggagggcggtcgtcatcaacgcacaccacaccgtcggacctgcctctgtgcgtgcaccaccgctgccgtgagtgagagatgaggtgagtttgtgagtgagagaggagttgagtttgtgagtgagagaagagagaggggctcgaggagataaggatgaggagatgagggagagcataattctttactttttaagaaggctgagagtaaggagaggttgggtatagtggctggtcttttaggcccgtggaaataattcgttttctcaagaggatctcttaagatattcacttcggaaaatatttttttatgcatgtctttccttgggtaccatctaaatcgttttatttgtgggtttattttgcataatacatgacagatgtctataagaaagtgaaagacacaagatttaaaggtgaggcactcattcattcattcatcctcaaggagtataatagtgagcatcatcttctctctatatagaggcatagctatagatagttttcatatttagtgatcagtccaattaatgggtataactaagctggatctttatgagccgccggtttcctaacacgacggatagatgacgaaactcatgttttaagtggtagctatctagatatgtataaacacatgacatatatacaagacgcacagtgtttctatgattaaaaagtaagggatcggagggagaaagaagttatttcaaagaactctctattcactgctttatacttttcattttctttaccaggccatatatacttttattgatatcaatatatagattacgacaatttgtgtgccaaagcgactgcctaaattaaactaaaacacccggcaaaaagctttgtttggtatcgggtctaaaacgttcagattcatgaaccctctcggtatgtacatcgatcccctttgtttgtttacgactaggtcgtcaactaaaacggtccagttacactcgtggcactaaaataagtacttatactactttgtttagcttggatgcagatgtatccatgcatgggttcagctcacccggacacctctaaaatttaagggtcatatataaatgtaacatacatatcttgtccaagttgttgatgaatagtagtactcctgcagactctctttgatagatgcaatttgatgcaaacgaaatagtagcactagatctttaactattacagtatctctttgcacttttcttaacagcaacaactgccatcttgcatagttgcattcttgccctcttattgtgcctctgggcaacttgttgcatgtgccagcgctagatggatttgatcgatgagcgtgataaacaggtatctcactgttggttttctggtcatcgcactattgcgtaatataagaagtaatataatacttcctatgtttaataatacaaaaagttataaattcaaatttaatattataatataaggatttctacttattcgcatgattcacacatcattttaataaatcttgagctaatcagatgatttaaaaattaaaaaatgataactaaagttgactaaagagaaatatttttctctaacattagtacttgctaaataatctagaaagttggattatttagcagttggattcagctccccaagcactagctaggcaacatggtcgtggtccaggtcgggaaaattagcagagttgcatgcaagctgtgcaggcattgcaatgcttgggatggtgatggtttatcgtatcgaaatacaacaattgatcaggttaagaattttctttccccgattacataccccatccgtctcacgtacacactcgcaagcgcactctcttaagacatgctctgctgatgagagcacaatctcacatatgcgtgtaattatagacatcaagatttaaaattaaatttgatggatgaactctacttcaaataatggttacctcatatcagcagttttatgtgtttgaaatagattatttatcagatcatctaattaattaatcgtagtgataaattaaatactttttgaaaataaacataaattaaataacttaaagaaagtggtttaagcaatgccatatgaagaaaaatttgttttagaggcatggggcaaataattcacagtaatgatatggtgaagtggctaaaaaaacagggagcgatcactaaggagatgagttctatatagcggcccgaactccactcacacatctaatttatttttttaggttactctagtcaactcggctatttcttttttatagagctaaaattgtttgattagactagcttcagttccaaaagtgatgcagctagagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47054 - DNA, 1402 bp, Oryza sativa
attcacttcagggtactgcactggaaactgatttgttggcgccaaaaactcaccatttgactgcactggaaactggtttgcaggcaccgaaaacccaccatttgactgcacttgatactgatttgcaggcgccgaaaacccacaatttgactgcactggaaactgatttgcaagagctgaaaacccaaactttgactgtacttgaaactgatttgcaggcgccgaaaccccattatttgacttgtttgcagacgagttgccagaatggcaagatggagagccattgcttgtctcccacatactcttacagaacatgccagcatatgagctaccagaatcgtctgtatccaacaccaagccatttgatatgtttgcaaatgagctcccagatgggccagatgggaagcactttcttgcatttgatgagttctgcagtggctgaaacacaggattgttgcccgggcttccaccatggccaactgtccccatggccatgtttctctggctgttcttgagctgaactgagtgagtgggcagaaagccatttgttgccaatgcagatgcagaattcatccttgcaaatggattgctcgagcttgaggaggcaatggctggggttagacggtatctcccattttcacagtaatttttcagagcatccagttcattcatatacttccatttttcaggaaattgatcaggatccatgcctgtttgagtgctgatccttttcaggtataaccgatacttctgaaaccaagaaaggcaaacacatggttgagatgtgtccatactcattggaaaacaataaaaaaatcacaaaaaaattgattactagttgtgtgcacacattaaaagaagatatgaaaggtttatgtatggaacactttcgatcagaaaagagtaatccaaatatctttaattatagaaacatagaaattaaacataagtgtagatataaacctgaagatgacttgcaatattctctctggtcatgtagtccactttcatcatccgcaatatcttccttggaacagcacctacattcacataatcaaaatatttattgcttaagacaaattgaaaaaaagaaaaagattgtttgataactgagacatgatgcatgagctcttacgatcaactccaagctcatggacggcaatgacaaagtcccggtgcagctcaggtgtccagacaaccctttgtctcttcagagttgaatccatgttctctttgttctcaccataattatctccatcatttctcatcttccttgtgtacttcctcttggtccgcgtcgcgccaaccagctcaccgccgtcgttgtaaccgccattgtggttccttatgtcaagctttctcttcctccacacatgttgccatatgttctggatgtctttga

SEQ ID NO: 47055 - DNA, 3932 bp, Oryza sativa
aggaaaaaaaatgtggcgtagatgatgctagttatatatggactctgttcttttgaatatatttaaggtattacacatgtttttccatcttttattgtaagcaaatatttcacacgtgctagacaatgacatgctacagttatggtcacttttatgttcgacggtttcaaatgatataggttttactattttgcacattaaatagaaaaaataggacaatacatgtaacacgattacacgaatgcagattcgacaataacaccaacaaaagaacaactatatcaaaccataaaacgacaagggaatattccattcactgaaattctgttatatgttcagattaatctaaagatcaagcacataatagacatgtgaccatttttgtctaacctaccatctatcatcccaagtatgaattaagtcaataaatttataggatctcacgtgctatctaagtacaacaaactattcaatttatctacttgaaagtagtaccaccaacaaaagaataactactacagaccctaaaacaacagtagaatattccatccaccgaaattccgttacatgttcggattattattgatgaatctaaaacccaagcacataatatacacgtggccatttttctctaacctaccatctatcagcccaagtatgggtgaagttaataagtttatatgatctcacgtgctatccaatgtacaacgaaccattcaatatatctacttgcaaatagtaacgcctacaaaagaacaagtacaatggaccataaaacgacaacataatattccatccaccgaaattccgctatacatatgtttggattattgttgatgaatctaaagaccaagcacataatagacaaatggccatttttctctaacctactatctaccaacccaagtatgaatgaagtcaataattttacagaatatcaagtactattcaatgtacgacaaaccatttgatttatctacttatctacttggaagtagtaacgccaacaaaacaacaactataacggatcataaaacaacgacataatatccccactgaaattccgttacatgttcagattattattgatgaatgtgaagaccaagcacataatagacatgtgaccacttttctccaacctagtaccatctatcagcccaagtatgagtgtgaagtcaataaatatacaggatctcacgtggtatccaatgtataacaaacaaccattcaacagatctacttgaaagcaacacttcctacttctttagacatctacttccaagagaaaagggacaaataccaagaaagggaagccatgacatgcatgaaaaatggaaagttggtgtgaaggaaggggttttactgatgacggggagatccatctcaaggccgatgagctcgagaagcttgaagccgtccatgtccagcatgtgcacgtcgctaatcaccaggtcgaaatcccccggcctctcccggagcatccgtagcgctgtcgccgcgtccctcgtcatcgtcgctacatcccggccaccgcagaaatcaagcaaacaacaagaaaaaaatatatacaaaaaaaagatctaactaaacaactcggctaacaagccaagaactcacgttggtacttgcaccggcgaagcaacgcctccaggagcatgaggcaaacggggctatcgtcgacggcaagcacgcgcaaaccctctgggaattttctggcggccgtcgcctgcgtcgccgccatgttcgtcccttggatccccttggtaaaaaaaaaaacaaacacgatcagcaacaagaaaaccccaatctggacgaacgactgaccaccaaaatctccctccccctccgcacccccagcaagaacccaccaaaaccaatacaagaacaccaagaaaccctcctagaacccccacctttcagatcttttccgatgggttccctcgaatgctggctcaaaacagcacaagaagctgcaactcgaggtcagagagggatgggtgcaacagcgagggggagggcgtcatttatatcgacgaggagaggagaggatcaggacagtagatgggggtggaattcacgcgctccctcgcagagaaatttggaaggtattttggcctgtgtgcgtgcaaatccctagctttaaattcctgactattgttgcatgcatgtttcttcttccgctgccactaacacttcactggttgatgttctattggactgttcttcccacttttgcgagagccttgatgcgaggagtaaatgtgtgtgcaccgaatattggtaaatgtttaaatgccctttttctatgggctacagttgaaaaccacatctggttttgctggttttcataaatgatgaagctaggtgtataatataaaaatcatttattgtatttgttgaattatatatgttgttcatagcacgatggtaagatcccaacgagtgaggccgctgacgagggctcaatcactactggctcacgcaaaaaaaaaaggtccatcgctatgtgttttccgtggtcgtggcatgtagctaaggtgatagggtgcatctaaccggcttttagggattttttttttatcttaaagcaatgtatttagaacgtctcttcccttgggtttaatttttttatatacattttactagtgtggttttatgtttctctttggtgaattttgggtttaagcaaaattactttctgtcggtcccaataacatgtcactttctttgactttcaatagtttgtcgttattagatatgattgccaaataatggtaaatagttaaatgctcttactccatgtgtgctatagttgaaaaccatctctagtgtggctggctttcaattaattcattggtgacaatgatggtactagtgtatattatttgaaacttttgttgtatttgttacgctataaatacagcaaaatgatgatactagcactatgatactaacaaaatgattatttaaagcttccgttgtatttgttggataataaatgttactcacactagcacggtggcaaggtctatgataagtaattccgcttgaatcagagatttgttaaatacaagtagaagcatgttgttataatttaatgttctcgtgtttgcattgctgtagaataaagagtaaatgtggtcaatacatttttcaatagcatgccattattatttgattattttgaatgttctatttagtgaatctatgattcgagaggaatcaatttccatagaagtaggagcatgtggttgatatttaatgatttttcgatgagcttattgtataataaacaatgctaatgtagttttagatttatctattagattatgagtgttacataagtttttgttcatttatttagcaaatacaggttccaagttgaatgactttagctagtatttagaggttttgtgatatagagattaagggcatgtttggttataacctaaccttgtcataactcatttttttacaagtgtgacttgccacacaaactcacgaagtgtgaccattgttttattagccataagggtgagaatgttttgctatgaattttgtgtgtatgacatttgaagtaacaaaatgtggcttgccataattacaataataaatcaaacactaacccaataaattgtaacacacctaaggcttagggaatgtgtggcatacaaccaaagaagccctcaaagaatgatattcttctactataaaaaaaatatagatatcactgtggcatggcatgaagccgtgaatacgtcaataaataaacgattttcgtgctaaactgaacacgagatgtttatttgtattccaataaaagcacgtagatttcaattggtgagcacacagtttcacatagaagagttcaaataaatgacttgtttttttacttctcaagtcttgcatatattatttaatgcaattaaatc

SEQ ID NO: 47056 - DNA, 1948 bp, Oryza sativa
agggtgctcaagaacatatcatctagtatcattgcccttgtcacggagaaaggtaaacaagattctgaagataacgtgtaaagtcaaaatattttcagacagacttatgctgataccatttgtacaggagctcatcatttggacttcagatcagcaactaaagatgatccagattgggttgtagaacaacgaagacaagaagttaagatcatacagggatggatagatcagtacaacgaggaccttgcacagatatcaaaatgagaagatgcagttactgcgacagacaatcgaaacatgagactgtctacacagtaatcaactgtttttggctacatggaaaaaataaggaaaaggaatttttctttcttgcaggctgttagacagaaaattaaattaaggtaacatacagtggaaactcaataagtcactcagaaaggttgtaagcggctaacccgcgaaacccacttataggccaaaataagccacaaactcgtttattttgacctataagtgggttcgcggcttacccacttacacccagtcagaatcagaaattgtgacacccaaatattccatggttccatttatctcccagtaaataattggttctatatctgcacagtaaatggtcatgcatgtaaaacaagcgttatctctataattctaagaaaggaacagtattgccagatgtattcccgaaaaaaaaaaagtattgccagataaaaactggataaagcgcaccatttcgaataattcatgaaaattattccatttaaccatctaacacatcaatcagaacacgttcaacctgacaaaacttcaatgtgtttttttatgatctcaaaaaccacgacgaagctaaaatcttttgttgagctgactactctagatggaaatggggctttttctgaagatgacctgcttctaactagcctattacaattggcacaattttgcacacacaatgtgcaacagccatggattaaatcagcagctagcctatgcagatacagaacatatctcacatagtcaggactaaggaacaaaatcctggtctccatctacgacagcatcataaccttccatgaaatcctgcagtgagaaaataagttccattcagatgcacttctcagcgaattccaagtgtaaagtgcaagccgaaacgaaatatacttcaaagatgcccaatgtttcaatattataagcatgaaccaacggtatgaatcaagcagtgtagtgaatactggctacaggtatgtgaagaaaatcgaaaccagagagaaaagaagaataaaacgagctgccgatctgcaggaaaaaggagagtatcttacatcattaaacagctcagcaacaatgtcatccaaggtgtctgtcccttctggaccatttgttcctgtgatgaaaccattgttttcatctttttttttagataatggattataaaaaacccggcctctacaccttgtgagggtgtacacagcctaaaagtcacaaacacgagtacataagactctcccgttacatgggtaaagcataaataagttttaaagatggataacaagcaagaggaactaaaagctaagcttcaatccttcttctaaagttccacccaaaagtagagaagagctccatcatacgcttctctaaaagcttgcacttcgcgattacttcaatgccttcgtcttctttaagaagcaaagaccaaagccttgacaactgagttgctttgaaaattacctacaaaaaagatacgtggttgtagccattaaagactaagtcatttctactgagccacaaagcccaacaactcgccgctatgcctacccaagtttgtcttttaagcttaggttcaaaacctcttaaccaatttccaaacaagtgtgaactattacggggttgcttgactccaaaagtaagatagatcgcattccaaatgtatcta

SEQ ID NO: 47057 - DNA, 71097 bp, Oryza sativa
  unsure (1)..(71097): unsure at all n locations
tgaaacaaattacaagaccaagggtatttgtttctaatgcccccaaaacatgaggttttgtgaaatttgctctataacaaaagttgttggtgtagttttgggtttctctagcaaatcttggattctagcggggtggctttttataagtttcaatagcctatagttattatttgatggttttgcatgttctattttgagaatctttgattcaaaggaactactttccgtagaagttggaacttcttattgtaatttaattatttctaccatgacattcttgtataataaatgtcactagtgtggttcgggtttctctagcgaatcttaggatttgagcagaatgattttctatatgtttttcaatagtctggtgttatttttttacagttgtgcacattttgtagtgaatctatcattcgggcagcattactttccatagaagtaggaggatgtggttgatatttaatggttttgggatgagtttgttgtataataaacgttgctactgtggttttagatttctattggaatcatggattcgagtagaatgactttccataggttgcagtaggttatcaatgtttgtttttgaacttttctttagtgaatatcaactccaagtggaatgactttagttaatgcacaattcgtttttcgcttttccttcaaacggttgcctctctgtggtggcctggtgggggtccaccaacaactaaacttaaacaaatcttattctattttgatcctcccttatttcaatgttattaatcaattgctatatgcatggaagtcaataaaaatgtatgtgcataccacatatgcagattgaggacatgatagactataacctaaccgtgtcataactcaatttgtcaccagtgtggattgccaacggggtggcattgtttagctaggaattgtgtgtatggaatttgagcgcatggagtactaaaatatggattgccacaattgcaacaactaatcaaacactaactcagtagatttgggcaatgggtggcgccatgccgccatacaaccaaacaaaccaataaataaacggtcttcttgctaaattaaaaaaaaatacatagatgtcactttggcatcgtgtgaacgagtcaataaataaacggtctccttgctaaattaagcaaaagatgtttattttatagtccaaaaaatgcttagatgtccatttaggtgagttcgcagtttcacacagaagagctcaaataaacgacttttttcacttcttaagcctgcacatattacttaatgcaaattaaatcagatgctattagtcacaggtataatgggagacgccttgcatagtcaaccactcatgttcttactccttaatagttgctttcattatcagttggaattttctttgtcaaaaggggaaaaaggacttgtaaataactagctcgtgcaagtgcaactcatttttgaacatgttggcatgaataattgtttgtgcttgcttggtatgacttgggaccttggtattcagaaaagaaatacaaagaagatacacaaaattacaatttgatgaaacgaaacagaagcatgtttgcaagacctaggagatctcattctgcattcctgttcactttgaggtagggcagtgcgcccgtcacgttgttgtagtcgctcttgttaacttggatctgcgagaaagataacaatgttctcttagagggcggtagacaatgacaagttttagacttccagtgaagttgtccttgatttatgatgacacttttaggacttcagaagctactaaaatagactacacccccagcaaatcattgttattttcttattgtaataatgtttcttttcagccgcttaattaccaaacattggtgatacaagtagaacagatgttgggcctacaagaaagcttcctatctcaaatttagtgtagggtgtgctttactttaaggatccgagaggtaagaaatgggaagactgaacttcaggggggaaagaccaaacctctataaaataatatggagactcagttacagaagaagtgtacaaaaatagtggacttcatttcgacaaaacactccaatgcaaaatgtgtatgatgcatttgcacattattattagaacagaaaaatgtaaaggacacataccaatcatggattgatatcaaggggagattgggatagatgagcaattaaattatcaattgctggtatgtacttttgcgtgtgcacactaattataacactcaacctactgagcttctaatattacaacaaagtttatggctgttaattatgttgtcagatccccaataatcaaatggataagacattcgacaatcttttaacttcccaaaaaatactcaaagagcatggcatattattattcagcaatttaaaaatatgctaatattaagtaggacttagcacaatagcacatagacataaagaagtggcttctaaaaatattttttgttgtaagaactaatagtggaccatgaactctgaaaaaaaatgagtgaaattactaattagttatcgcgaacagcagagctgaacacatcaaagtttagaaagaagctacaaatgccactcatttgattcccatacaatctagaatgcacagatatgtgacccacaatcagattcagccacataggtactaggagacagctatgcatattgccccgaaattcacaaatagaacatcccaaattcggcgcattccatagcaccatgagctgaaccacactcactcagtcactctcacagtctcacttagcaatttagcattccacagctcacattgcaatccaatccaaaattaagcataggaacaccagcaaattccatggctagataagctggacaactagtagaccagaatttgagctgcactgtatctggattgcagggtggtggggggagaagagaagaagaagaagcataccatcttggatagcctcttcctgcgcttggtgttcttcttgctgagaaggtgctgcttcccggcgcgccgccgcacgatcttccccctccccgtcacccggaaccgcttcgccgacgcctgaaaaaaaattcccacagaaatcaatcagccccagcagcagcaatccacaccagaacagcaccaaccaagccgcgccgtaccttgtgggtcttcatcttgtaccccttccccgccgcgacgacggcggaggcggacgacggcctgcgacggagcggcgacgccgccgccgccgacgcgggggagaccgcgacggccgccagcggcgcgccgaagaacgacttggcggggaacgcgagggcgccggggtggagcttcctgggggcgcccccctgctgctgcagcagaggcgggagcgcgacgcgcgcgagggagagggacatggccatggctcgagggcactttgctcacgcttcggcttgcggtggattggatgggcgagcgcgagccgcgagcggatggagaggatagcgtcgccactgcccactggggggtagcgcgggaggtgggccgtgtaggctgtgggccgcgcgcgctacgggagaaaaaggaataagttcatctggtgtctcttaacttgtcaaccaatgcgtcgtttaattgtcaaaaccggtggtttggttttagcttgcgtggtttatttgactggtttttcatataacgtggtatttacgtggcaatttgatctgaaaaaaaaaacctataaaacccacatgtcagcttcacacacacaataataaaaaagaatagtggggcccacataaacccctggtctcaatcccttcctcttcttcctcctctctccccatctcccatgtcttcatctctctcccctctcatccctcctcttgccggcggagaaacggacggcttgaagacgcagcctcctccactctcgccccccatgggcctactacaggcatccgccacccctctcctcgtcgcccgccacgcctgcctccaccgcctccggatgttcctgccgtcgccgccgcttccccctcgcctcgacctccggtggccgttctccagcaccgccttttgcccccgcgccttcctcagaaacggttgccgctcttgccttcgccgggcccccgtcctcctcagtgacacgcggccacctccccgtctccgttgcttcctccaacacacgcgccacgtgactgcaagggtatcgcccatgagctgcacgtcggcagcagcttagagccattccctagccatgtagctgcatccatggcgctgacagtctggtcccgcatgtggctcctcttgctcagatgcacctgcgaccagcggcagaggaagcaggcacggtggctgtcggcggtaagcccatggggacgggagtggaggaggtcgcgcctccacgccgtccgcatctccgtcggtgagaggagggaggagaggggagagaggtgaagataggtgagatgggggagagaggaggtcaggaggaagaagaggaggggattgagaataacatgcagggcccacatgggtcccaccattttttattattgtgtatgtgaagctaacatatggttcccacgggttttactattttttcggatcaaattgccacgtaagggccacgtcaatgccgcgttagatgaagaccgagtcaaattagccacgtaggcaccacgtcagctaaaaccgccgtccaaacctccttatgacctatattgcaccggttttgataattaagggacctattatatctgattttctggttgaaagacgaaaatcggattcgtcgataagttaagggacctcagatgaacttattccgggagaaaacgagaaagaaacaagtccacatatcgcctctcagttttcgtggagtttaattgacatccctaaaccgtaataccaaaaatcttcaccccttatacagacgaaaccggccaagccaagttccatgacagtacggatggttggttttgggctgacgtcatatcttagtcagcaaaaagaaaattaaaaaacatgtggtccacatgtaagtggacctcctcctctcctcaactatcccctctcttccccatctctccacctctcccctctctttcccaggagctcaatggaggagagagtggcagcgactggcaagcccgtccgcgggagacagcgcggcggtgggaggtcggtgatgagagggctcttgtggaccatggcagcaaaaggagaagaggagggagatgagggagtcggcgagctctagctcaccgacagtccatgggaaggtggcggtgagcagtcgaagaggatagagggcaatggtagtctgcgatgacggaggagaggacccgatgccccggtaactccgcctcgggtgctcctgtacgtggtcctgtgacactggggatgggctcttccctaccgctaggagtggggcttaccgtcgctgcctgattatgtcgagagtgagaggaggagccgctaggttgaggaagggatgccacggtggtggcgatggaaatcaagctcgagcggtggtgtcgttgccatgtcctagttccagccccaagccactcacgctgcccgactcgctaggtaactcctatcatgcctcctgcggcaggaagcgctccacatcgagtcagcaacggtagctcagcccgattcctttttgtcgcttctcgcctacccgacagctcgacggaggcggcgagctgatgaggttgaaggtgaaaggggaagagccaacctggatgacgagctcctcctcctattcggaagctgaggaagtccctgctctatacggatgtttctacttcggtttggcctctgtcaccaccatggcagacccatcgccgcactagacctcctcgccttgagctgcttcctcatcaccgctcctggttagcccccacttctcaatcaccgctctctagcaacgtgctcgatgcatcaagctccaagaaccaaagggagatggagagaaaatggagatgagggagggagaaaatgggaggagagcgaggattatatgtgggggctcacttttattttttttcacgtatacgcctagtcagcatgagtggaccgagtcaacttgttatgtcaatgaaaccaaccatctatactgacggatgatcttaattaatccggttttgcaagttggggttgaagatttctagtattgcagtctaaggatgccgtttaaactcgacgtgaaggtgatggatggcaagcaaacttattccaaacgagaaccaaaattgctaaaaaaaaaactgtcgcaagttttataggaaaaaactttcaagtgtaactatagtatagttatagtgtaactataatgtaaattcactatagttacattgtactccctccgtcccataaaacaaatctaggactagatgtgacatattttagtacgatgaatctggacagatatatatccagattcatagtactaggatatgtcacatccggtattaggttggttttttatgggacggatggagtaatttgtaactacaatataactgtaactacattgtaatctctatataagttagatataaagttgcgtatattattttaatacttatatacaagttaatattatagttacagtggaattatattacaattgtagtatagttagatttgaaagtttttcctaaataacttgcggcggttttttagacgcgcgttttcgcggcccaatgggctgactgcccggctaactcccgtggaccatggcctggtttccaacgcgtgagttgtagtgcagcacaggcaggcggcgtgggatagctgcctgcctgcgtcgtcatcactgctggctgatgcgcagtgcggctagcatagctggttcggttacatgcacgccatgcatgcgtgcattaatcagcagcagaaaagcttgcgtcccccaactcatcgatccccactccacacatctcccttccatcgatcgatagatcagctaatccctcgcataaatcctcgatccggccggccggcggcttaattcctaggttttcctcctcttcagttcttcctcatctagtccgtccgtccgttgtcttcttccaagatcccagacgatgcaagcctcatcggcggcggcggcggcggcgtgctcggctatcaagccggcggcgcatcagcacaccgtgcaagtccaggaaggtaaccggccgccgccagctgacacacaactcttttatactgtcttttgttagtcttgttctttgattacttcggtttgatttgaggattttctttaacttgggtgctgcagataagaggggatcggaattcagggctcggtttggaacgaggaaactgtcctggggaggtatacagagattcgtgttttcgttctatatttagtatgttttttcaataaaaatcaacattccaggcatccgggttgggttgttcgtagatcaaatccagctagcctagatgcaccacaaatagaagaagatgggggataaagcataaaaccttaaaacatttgaactgcatgcgcatgataattgcaggatcaaacatgtattcaagtttttcactatgaagaaaaagattgtacatttgggttcctagttctccggaagagtttcaggatcttgcgatccttttaattgtatagggcggatctagcatgaaggcggtagagtctcgagcctccactacttacgtgaggaccatgggagcccctgcgaagcccccactaaaattattgggtttgttggaaccatgacaccctatatttgcaaaatttgagatatgccacccgtatctcaatgacatgtaagacccacatgagtcaatgacatgtgggtcagggtggcatatcacaaattttgtaaaatttgtgtggcatggttcaaattgtcccaaaatttgcaaatatagggcattactgattaatatgtcctcaatttttcagccactaagttttagaagaattcgaaggtgcatatttctgaaatgaagtttatcctaattaacaaattcatagttgtgtccttttcagtaactgtattttttttcctcttcttttaggagaaataaaataccttgttgataaaatggatgaataatttagagatgttagtgtgcactttcccccatgaaacataagttgttaaaatataattttgtccaaagtgactaatgtactaaacacttgtcctcaattacacattacaggtaaattgtcggtggaaaattctgctctacaccagtgtcaaaggcaagcactctcgtaaatctggggttaatattttcgatagcccactatgacaacttcacaagtaaaactaagtgcaattttaaatgctaccagtctcacaagaagcataaggaggcaaaaaagacaacattctccagtcctccaagtgagatgctatgccattgctggtgatcagcacgaatccatcgccactgagtttgaagaaatttgcaaagaagttccccagaaactgggagctttttatcggttttgccgaccccacacaatttttggcactgtgagtttcattcaattttgtatggcagtttcggatgcatgttgtctagctactgcttattgttcttggattgtttgtcagataataggaatcacttcagtttctctcctgccaatgaggagcctagatgattttactatgaaagcattatggggatttcttgaggtatcatacataaattttgtaatgaatgctgtgctcaagagatgttttaaattaaattcctgatgaaccctgtgctcaacagatgcttaaagttatcttcttaatggtctatagatatacaacagccatttatttttccttatgtgcaggctttatcctcttctttatgtatgaatatctatgttgtaggcctgaatcaactatatgacatccagattgataaggtgattttttacttgctgtttgaaaacattttcttctatcatgtgatatgtagtatcattgtgattaaatcatacttctttttggaggtcaataagcccagccttccgttggcgtcaggagaattttcagtggcaactggagcagtgttagtactcacgtccttgatcatggtatattaggttcaacgccaggaataaagaatcaattattctagtttgaataaaacaggttttatgtcaatacaccttcctcacattttgtttccttttgctagagcattgccattggaatcagatccaaatcagctcctttgttatgtgctttgtttatcagtttctttcttggaagtgcatactctgttgatgtaagtagtttttaccgagctttgtaagtacaaatggtgttccatgatcccatctaacatataaatacttgtattttcaatccatcatactctttttttcaggctccgttactccggtggaaaaggaacgcgtttctcgctgcatcttgtatactatttgtaagagctgtcttagttcagctagctttctttgcacatatgcaggtagtacaaaacattgtttacatctcaagttcaaattccttatttccctttggttagtattgaattcttcttgtaacagcaacatgttctgaagaggcccttggcaccaacaaagtcggtggttttcgcaacattattcatgtgttgcttttcttcagttatagctttattcaaggtaaatgcccaattatgttgactatatgttcacgtgagatcacaatggcttttcttcagtcatagccttatttcatccatctcttcaaatatcatcactgggaccttttctgaattttcaggatattccagatattgatggtgacagacattttggcgtcgaatccctgagcgtacgtttgggtccagaaagagtaagaacatatccaattctaccactggaaaacaaaataatggttctacatgtcattccagatttaaaaatggtgtaaaatcctatttttatctgatttaggtgtattggctctgcataaacatactattaacagcatatggggctgccattttggctggagcatcatctacaaatctatgtcaaatgattatcaccgtgagtgaattcttcacttctgaaaagaagaagaaaaattgttcatttcaaaaaaaaatttccccagtttgaaagttgagaagtccttttgctgttgcattgataatccaggttttcggccatggcctgcttgcctttgcactttggcagagagcacagcactgtgacgttgaaaacaaggcgtggatcacatcattttacatgttcatttggaaggtgattaatgatagtgttctagtttatacgatgaattttgttaaccaattaaacattggtaatgttaatcatttgcattgtttgtattccttgcagttgttctacgctgagtatttccttataccatttgtgcagtgagcactatatacacaagggcaagaaatttttgaccatgcacatgagcaattatatgaaacttgctactgtgatggcagtctgtatccaatgctttggagtgtgctgcaatatatgcaaatgtggataaaggcaattaggagcatacagtttagagcatatactgtacctatgtagctgctgacctttgagtaactgttgtttggagaagccatctcgtatcattgggttttttttctttgttgggctatctggctggtgagctgcatgtcaaagaggaagaaatactgacggtgggtgatttgaaatgcttcccagtattcatgtgtcaaaagatatcacaatggcaaattgtcaagcctgagggaggtggctcaagagatactactccatcccaaaatatagggtgtgtttagttcacgctaaaattgaaagtttgattgaaattagaatgatgtgatgaaaaagttagaagtttatgtgtgtaggaaagttttgatgtgatgaaaaagttggaagtttgaagaaaaagttgggaattaaaccaggccatacttttgtagttttttaacaaatattaaggaaagtggtaatgggggaattttgaacatttcattgctacaaacttaaaatttaagtgttagaaatagctatattttggagaggatggagtagtacttattagtggatatgtgcaaattggaattagcatctcgaattgatcataagttggatgactttttcaactattcggtgtaaaaaatttgaagggaaaagttttgttggttttaactcggaaacagtaagtgacttgaaaaacaaaactactagaaagatgtaaccaatcaagttctttcatttgaatctaaggccgtgtttagttccaaaacaattcttcaaacttccaattttttcatcacatcaaaattttcctacacacaaactttcaactttttcatcacatcattccaattttaactaaacttctaattttagtgtgaactaaacacagcctaagaaataagggtgcgctagttccagtgggcaacttctcccgccacatcgtttttcacgcgcacgtttcccaagctgttaaatggtgtgtttttttaaaaaaaatttataaataaaagttgcttaaaaaattcatattgatccattttttgaaaaaaatagctaatacttaattaatcacgtgctaatggcctgctccgttttccatgccggagggattattccccgtccctcactctcgatcggggcctaagagcaactccaacagagtggctaaatggctctccaagctaaattatagctaagatagaaaaaaaaaatctccaacagactctccaattgactagccaagccatccggctggctaaaaatcctatggaactggccaaatgtggccagccacacccgctagctaactgtgggccccacgcactatccctcccacatgtctcgctctcctcttccttcgctctcgcctcccgcacagcccatcgccactgcctccgtccccggccacaaccgccgccgtcgcctccgtccgtgtccacatccggcaccgccgcctccgtccccggccacaaccggcaccgccgcgtccactgccgcctccgtccccagccacaaccggcgtcgccgcctccgtccccgaccaagtccggcgccgctgcatccacccccgcctccgtcccagccacaaccggcgtcaccgcttccgtccccggccacatgcggcaccgccgtccgccgccgcctccgtccccagccacaaccggcgtcgccgcctctgtccctgaccaagtccggcgctgccgcatccaccgcggcctccgtccccaaccacaaccggcgtcgctccctccgtcgcgtccctccgccggcgctgcccctccgccgcgtcgtcgtccactgccgaggccgccgtgtcgtcatccccctcccctctcctctcctctcgcctcgcctccccacccatggtggccacgctcctccgccgtgcgctccacctccaccgcgtgctcccctgtcccctccccttcctgcgccggtgccctcctactccccgtcagcgtcctcccccgcctggccgcccaccgatcgattgatatgtgcctccgttgctctgcctcctccagggccgccgcgctctcgccatccacccagccaccgccgccgccgccgacgagctcgcctgctccgccctccgctgctggcccgcttggcctaccaaatacacgcccaggcatgccgacgcggcctgcctgcaacctgttcgacgaaatggcgcacaaggatgccgcctcctacacagccatgagtaatagaggctgacgtgcgggtcccagtgtcataggctcataatggggagtgtagatggagaggttgttggagtgaggaataagtttggcttgccaaatcaattggagagctagctatatagatgtttggagagtccaatttagagagactgttggagatgctctaagtaagttggtgtgaaatggaatggagaaggcccaaggttctgaagttggttctgatttctgagaatcaggcttatgccattctggttgggattacccacaaaacaagtatacagtcccttctgttgtccgggcatacgtccctctcaatagagtggaccaacaacatacacaccggttttagggcatgtttggagcagcttctagcagccgcagcttctcacataatctccagcttctctaaacagtttagattgtcacctagattcttagaatctgtagttgtataatacagaaaatgtactagaatccaaaagctggaaaacccagcttcttcaaattctcaaaagctgactaccaacgagcatattctcaaaatcttaaactcccttaagcagcgccttagactggcaggaaggcttttgcctcatctcaaatttcaacttggccaaccttggaaacaaaaaaacatggcgtaaaatgcaactaccttgattatatatactccctccgtcccaaaataagtatagttttgcactattcacgtttaacgtttgaccgttcgtcttgtttgaaatttttttatgattagtatttttattgctattaaataataaaacatgaataatactttatgtgtgactaaatatttttaaattttttataaatttttcaaataaaacggacggtcaaatgttgggcatggatatccatggctacacttattttgggacagaggtagtagtatcttgtcaagtggcaatattttttagataaagaaatagttcggaattagtactatcacagtcacaataagtcataatgacatcgtgtcaaaaaaaaagtcacagtaatgacatttgcccggcatgcaccaatcctcctatacatgtaaatatttttctttccttagtcattcgtttttcactttcgccgttgtacaggagtaaatatcacgtacgggaagctggtgcatttattagtggccatccaatcaatcagccaagtttttttcaaaaattacaactgacggtatcttatgtcatttccaacccaataattaagatgatgtccatagcattagctgccacctagaatgaaaaataatgtggcaagtgaataaatgaggaaagagaatgaaatcatgtcttgcataagacatggtttttacacaacatccaagacatcatctgagataggtggtattaaatttaagtatgaaataatggtgtttgtattggaagagaattgtctaatactagttttttttttgatgatatgaaatttatggaaactatttatagtatctttgattagaaatggccatagatttgccgatcactgttctttagagtatgcacgtacgtacacaaaagcacatgcgtggtcatgatgcatggctcccacaattttcaaacattgtcttgtacaataatattccgagattgtgaagtggtcgttgattgtgtacacgacgatctctcggtggccataaaaattttaaattaatccagatgtttttattattgctttctatattcaatcttagcttttaaaccactcagtataaaagttactccatccttcacataatataagaagttttaagattgaacacggttactaataaagtaggtagaagtaagtggtggagggttgtgatactggagatatgtgagaaaagtgaatggtggagggttatgattggttgtgaagagaatgttggtgaagaagttatattttgggataaatcctgagggctaaaaattgttatatttaggacggagggagtactattttgtcctaaaaagacaaatcctaactatgaacctagatatacttgtctaagttcgtagttagagatataggacaaagagatatatatgctaggaatacttttagttgcattgtttttattctttttaatggtagagaccctaaacacggccccaaacaattcttttagggtagaggttaaaacttcaaatccaacaagatccctattagacataagggaggcacccaaatcactcacccaaaatccctaataagtcttaggggccaactccagccccggccccatccacaattggaaggaacggtgtaatatcccaccaagcgagagtttgatggtggtgatgatagtaatggtgaagtttgagctctcggatgctttttttttattttgatggaatacgttggattctataagttatttgttatttaggatatgccatttccacggttaaaaaatttggcatttggagcctctatgtgttagtaattctcactctgctgtttaatgtgtcttctaccagtaggagtgtaggacagtaggatcactacggtttaattttagttgtggtgttttagggcatgttcgatagagctccaactcctaaattttatctgaagtggagttgtggagctatctaaacccaattccatttctttagtttattttgtgagagctacacctagctccgctcctattttaggtggagctagagctggagctatgctgaacaggctctcggtataagcagttcaccgcggttcagtgatacggttgtattctttttgtttagttttcgatcggacttcatgtttagtccagaatcttggtgaatgctttgatctgttaaatagtataatcttgattatgcactacattaaacattaaattttgaatttgaatttaaattgtgaatttaaatactgttgaattatatgaattagaaatatttatttttgaattgttgtgggctaaactaatcataaatatagagtgtatattgaaataaatgagaaaataaataggggctaataaatggagactactgccactgttgggaacccatctttgtcaccggttgggaacctactgttgtcccggttggtatctttagtcccgggtgaaataaccgggactaaagatccggttggtaactccaaccgggactaaagaggaaaacaacggcaatctcggttgccaccttttcttttcttttttcattgttttttgctagatgatttttccttcaattttctcccaaatcggatgggatgcatatcccaatcaaaccccaaatcctcaaatcaaagcataacatctcaaatcatatattcacatcataaatcctaaaaatatagcacaaatcaaatatatctcagattgaatccatacactgaatcataaattctcaaaaaaagaaattatacatctcaaacgagtccacggccgccgccgcctgcagccagtagtgtgcacaagttgaggacattgtttggaccgaagaaatgagagcagccctatttaaattataggagttttaaaatagaaattatcgctgaagatactctaatactgtacaaacatgatcaatttttttttaaaaaaaatacagctccacacgcctaatttcagggcaaacggcaagtcctgaaccataataacagtcgcttcgaccggcaactatccggagttagctgtgcggggagaataccctccacgtacatacgcgagagtcgcgtcgagaccgctctgcagtgctggacaccacacactagcactgtcacgacaacacggcatgcacagtggggtacatcaccaagctatagtacttagtactactagtagtagaaagtatcaaaaagctaaaaatcgagaactggagaagaagccgctcaaatcgtatgtaccacacgtactgtatgataggccacccgtttttaaatattcggtccgttttcaagtatttatcattgttcgtatttagattttatcacttgccattttgttcaagaaattataaatacttgaaagacatggtatcatcgaagtgttgcattctaaacatgagttttaagctttccttaatcgtagtttaattagtttaaaacattggtggttaagcttaaaatcgtggtgcccaaccgtgacatgtatttgggaatagtgggagtaattgtcagggaagccttttattttcaaacattgactactcgtcttttttaaaaatatatatatgcttaaaagatgacaaattactgcatcaaatagtattgtaagcatgaaactttggtgaattatattcatgaatcaaaaaaaacgcgaatattaggaaaatatctaatatcaaataattagaaggagtgaggcttcgaatccaggtcgtctagcccaccaccttttggagctagacggaagacccctgggcgtttctcatagtcatgaatcctatatcacatctatctgtcccacggcataaaggattttggcaatacaaatagatagccaaaataccttatatttcataacgaagttaataattgctagtttgtctaacagtattgtgttactatctttgtctcaacatattatcattcaaattttgtttcaaaatatgacaacttccccatctactcgttgacattcgcaactatatcttatttaatttctttacctacttattcattaaaaccaatcacaaccatacatcatttaatttcacctctccttttaactaatgtaaaaaagtatgtaaattttttgaagtgcttatatagttatattttaggatgggcggaatggtttatagctataaactccacaaaaaatacataggagtagcaacaaacacacacgtttaatcagccgaaatcccacatgaaaacagagcgtcttatcttatctgcatccaactgtactccagcatgatccacaacaccactcacctcatgattttcgttgtattcgttccagtcccaaaaccagcgagatggatgcacaagcaaccggtcactggttggtctctaccgtaccgaagtcgacaggaacagaagcagttattatatccaagagaaagagaaaaataaaatcttgacacgaacaaaaacccgactcgccgcacgtctccggaaaacgatttttttttcgaaacaaagaaaaaatggggaaacaaatccagtggcatttttcttttttttttttcgccgccaccggcagccgcttttatagcacacacccgtcaccacacggaaaccccagccaaggctactgccaccttaccttgcgtactacgcctcacttttaccaaactgacccctgcacctccactcaccgacagatgggacccactaaaggatagaaacgtcctttcctatccggcacagtgcgcgaaagggcggaaagggttcactgggccccactgcgtccaaggtttggcgtcccgccaccacccacgcacgcggggtacccggtcactgacgtatggggcccggctggtgggccccacgtgtaagtgggggtgggatgggagaggaaggaagggtctcgcggcgcgtcgtgtgccatgtacaggtggtggtgagtagtactagtggtgggaatggattattttattggccatatgtgggcttttattccgcgcgtttaaaaacccggacgccacgccgtgggctcggttcgcctccacgcccccctcatttcctcctcgctcctcccccaccattcccacatctctccctcgccttcctcctctctctctctccacatctccctctcgcttccacgcctcctccgctttggcggcttcttctctagggttcgtctcgactcgactcgtcgaagggaagctgctcccatgaccgcggccgacgctgaggcgtgcgcggtggccgcggcggcggacatcatctgctcgctccgcggggccgacctcgccgggtggacgccgccgtgggggacggctgccgcgaaggggaaggaggtggtggtggaggaggaggaggaggagctggcgtggccgacggtggcacgggggaagcggtcgcggtcgtcgcggcgccgctcgccgtcggggtcggggtcggcggcgaccaaggggaggtgggccaggggtagcccggcgtctcccctcgactacagcggcggctccggctccggctccggctccgccgcgtcgacgagcggcggcgaggacggggccttctgctctccaccgccaccaccgccgccggtggtgacggcggcggcggcgactacgcccacggccgcgcccaccccttctccggccaaggtacgtactcccagccgcgcgcgcgtgcatccctatctctctctcctgtttgttccttcccccgcacagctcgcgctcgcggttgggctgcttcgctttccgttcctcgtctgggttttttttgacgaaactacccctccgtgtcagcaacgagaggaggatgatggatggatgacttctcgatgaaacatcgcttttcctctctctcccactagtcccaccggcttttcgttcgcgtgaccttttttcttaatcccaccttcgcagcttcgctgcctacccattctttcacctccaaccttttcacccaggtcatttcggtaaaaactccatggctattagtacttcacccacctcgcagatctcctcgtcctcttcttctccgaacaatttcgggatctccacctccgtgctactactgctactctcgagctctgcgttgtaccagtagcactatgactctacgggtgcttgtacagttcacactttgaattcggggaattttttttcttttggggtggatttgtactaccatgtcatagcgtgtctgtttggtgcggttgactcctaccttgcggaggggggcagccgcggcaattcacaagggtaggtgggttccggttcggctcccactcccaagtctccaaccacgagccgcggcttaccgcttttgcccaatctgcccattcgcctcgagcctaacttccgggggcaatccggtcatttcgcccgcccttatcctggacctgacctcctctatcgcgttcgttgccgtgggaagtgaggagtcaaaccgacgcggcgctctccgttggaagagaaagagagaggggtggggtggcgccgccacgtggcggctgcccattggccgcctcgcgcgcgccgtgtgggcgcggcgcgggacacgcatgcatgcgtgggtgtgcgaatgcgaatgcgaaacacgtcgtggccacttggctggcgccacgtgggcgcgtggcgtttcaggttcttttctctctctttgctcgcggacgtgtcctggtgggatgggccccacctcacactgtggtgggatttccgatcctagcgggaaaaggaggcaaacggatactcaattttaagtgagtaaactgaatttcatatgggcttatttctttattctttttccctgcgagggaaggaacctcgtgcggggcccacctgtcatcgtcatgtacaggtgaggtgagagcccatgcttccattactggacaataggtgcagaaattaggagcacacgcaccgttggttaattaatcgtggataagatggcaagatgagcagtttgtttgtttgtgcgtgcgtgttgttgatctctcctatcatgtcgaaatgtgcttcatgcgggtagggcaacaatgaggggcagttttgtgggatcttggtaggagttagttaggtgatgttttcccccattagagccaagcttaagctaagctagactctctcatctaattcccttcctaccacctggaaaacaatattcttttgggtggaacatgcgttgcctgttgctttctttttctacggtcgcctccttaatgcagcagcagcagcagcgttggttggactgtagttggttggctctagtggcccgtgttgtgttgtttgatcctaccagcagcgcgttactagctacttccagtacagtattcgctgggtgtgtgatgatgagtgctagtagtagtagtataactgtataactaatggcgtgcgtgctcttctctcgcttacaggtgggccctgccggacggcgccagctgatcctaccgaccccgcctccccggcccgccggacagcgaccacggaagaagatggtaagctactgcagtcactcactcagtgtcacacatatgacccggcacttagcacaggaaaagcgcattttgtttagtgacgagtggtacaagaaagcagtcaggttttgttttgtttcacctttgcatttttctgcagtaaaagcacggtagatagatagagcagcagctttgggtctgggctttgatgaatgaagttactacgagtactcccaagttacagcttactactagcagtacacccccatcatttgcgcgattgcacaggtccggcacaggtccggcaaaagaaagtctttggcctacacagtagtctcagagcagtagagtcagtgactcagccagtcgcgtgcaggagatggtaggctgttcaaatggccggagtttttctttttaaaaaaatgttttctagttgcggagtcggtcacccagtctagaataaagcggcagctggtgcggccactgccaccggaaagagagcgtggtgagggaggcaaaagtggtatcctaaggacaaaggctgcctgcccgaaaagatccacgctcatcatcaccagatggtcctgtgacgaaacgagatcgaattttgatggcagtagtagaaaaagaaggatcgcgtttgtttcttggcttttattacggcttgatttggcctaaacttggttttcttgtcggtatggtgtgcagaggctgccggagattcagcagctggtgcggtcgctgacggtggagaacgatggccttcgcgaggttgattagttcttctttcccctttacgtgattttcacttctcacttggattatgctgttaatttagctcgaattcttatccgtttcttgtttatattctcgtccgaaaacaggagatggtggcgttgcagagagcttgcacggcgttgtccaaggaaaactgcaagctagaggtcagtggcatatgctgctatctaaccaaatcttctcctctttctcttttgtgcacatgtggcgtgcaatcgcttccaggttggggcgctgagtgcgcaatcatcataaaacccaaataaaaattctgcatgtttgatcagttggtatagcttaaagcataagtgatagaactttccaacttgctaaaagtagagttcccctgagcctcccaatggagaactagtggtcccctggcattgtgaatgcatgctgtccttcgatattttctctctcttccttggtgtgtgctttacttcgtcgtcctaggctcttcctggcttcctaggagaagagtgctatgtgtgtggcttggtttggtttggtggcgatcttcactccacatccctctcaaccaccgtttgtcctttgaaaacggatgacaaccggtgctgatgataagcctttcgcaggtttagatgtcgatttccatgctttctttttttgaccatacacgaactgcccggggttagctttgccgcatgagcacgtatttgttttgcgcggtgaaaggtgcggtgtcactgcatgtgtggccggagtgccggacaggatcactggcacacttgcagtatctctcttctcttgagctgcttagaagatagtggtagtaccacggtagtggcaagtagccaaggaccagtgaaagaaatatagtacgggatataaatgacacatcctatactggacagatcagactagatttttttattttggggcgagagaagtaaatactagggctattgttagtccgcaggacgcgtgtcgtgttgtgaaagggtgtcattctgaggagagtgacaccttagccaaatggtcacacggtatgggacctggaggtggcgatagacgttcgttatcttatctgaaactgaaccgtggatcgtccggacttggccatgcgtctcagcgtctgtcgtgttaatttagggtaagttggatttttctagtcttataggaagctctttgtcagttaggctgggtggagcctgcatgtggccgctgcttgcttctggagctgtctcaacacatgcgctgcttagctcctcctatctcgatgtatggaagctccggttagcttctactaatacaatattgtttgtaccttctactagtactgcatctcaagagtcatggttagtgacaagttcgtgtactatatatagttagtaacttataacaatagtttgccactgtgaggtggtagccgagctgtcaattttacggtaaaggtataggagtgtcagtgaggattttagttgattgccttcttgactttcgcattcgggatgaagtgcaagcaagtgggaggagctcgaattcttatcctgtttatccatctcaataatctcaagttctcaaccacctcttcacccatcaagctgcttgcacgtttggaagggctaggaaagtgacgtcccccaaaaaaaccctttggcattggcaaggtagagttggtgatagatgcagttcagctactgcactttgtctgcgcaattgatgcagttacaaggtgttctactgactgttcatgcatgcttcgttttcaaccagccgtacatgtctggaatctttcccccaataaagaacgccatgttgccaggccatgaccttaatctatgcacaccaacccggatcctggacatggtaatcccgtggccttctttaatgcccttagttcttgcgtgccacactgccactgcactggttctgtgctccacaatcacattaaaaatacagacagtgtactaaccagccagaatggttgggcaaagctctccccatttcatttggtccggttaacctgtactgcaccgttgttgtgcagtgtcatctctagagcctcgtggtggctgagtggtccatgcatgttttctctctctcccgtgtgtctttcgtctcctctggcataaagcacatctagctaggtccagccatggtaatggccaacattttggatcttcttagtcctgtttcaggttgtttatgcttggtcatggactcatggtggttgttcattgtccattttctcttatgcctcccatttcacctccacagagatgtctcttttaccaaaatataagaactacgctaggtagattgtgactacaacccaaatttcctttccaagtctactctgttgggctcatggattcataagagatttgccttctgcagtcatctgaaattatgtttcataaaaccttttttttctgaaatgtataataacaatcttttcctctattttgcagacaaggttagagaaatcaagcaaacgaaacggaacgaaatccgaggggcagcaagcaaggccgcagcctgatgagcccgcagccaagcaggaatctcaaaacggcttcgtgctgcctgacctcaacctcccagtggaggacatggctgctgatggatcagctccttgatgcatgaacggctccagattattaccgcggcgtcgctaaccagacaaaagaattttaattgtatatagaggaagctgggctacaaggggctctgatcgctcgctcactcaagatgaagctaaaggagataattaaggaccataccttatgcttgtttgataagttgttcagatttactagagtttagcaccagtgtcatatgatcctccaatcttactaatgccattttaggagcagaaaggaggatcggtttaccttgctttgtctgatagagttatagtagtttttatttaccctggccttgtgtgtcgatgaggcagagggaagattttactttagtagtacaagctccggacagtgtagcttggttgttcatctaagcactgtaagttagggaagaactatctcaatgttcttttgtttattctgttcaatgttggtgtgaatctttggctgtttgtagagtcctactgtcttgttcacggctgattacaaaacgggttgcatctgtcacattagctgcacagctcagctcatggtactctcggaaatgtccctagcactactccattcatcctaaagtaagtgcactcgaaatgtccctagcactcctgagacactactccattcatcctaaaggaagtgcagggagtgagtagataagtgtttgtctctcctaaactagaggagtgtattttgggacgaagtagataagtgtttgcccagatatatggctaaaaataattatattttagactgaaatatattattattattttatatgagcacggtttcaccattggtgtattggtgataagtgcataactacactccaaattttaatccacaatatttttagttaggccgagtttagttctaaatttttttttcaaacttccaacttttctatcacatcaaaacttttctacacacacaaacttttaacttttctgtcacatcgttccaatttcaaccaaaatttcaattttagcgtgaactaaacacactcttagttaaagttatactttcttttccaagaaaaaaagagcatggtcaggtgcaaatcattgtgaacgttgaattcaactgttcactgattccaactgcagatgtgaacgtgtcgcttgatctaatatagtaggagggggaaaaaagaggaaaacttgtatttgcgctaaaaggaaagaaaaaaaatgatgttgattaaggcaaatctccgatgtagcctccatatccatatcctggctactgacggtcaagtgaactgtgagcttactgcatcactctcaaaaagacaaaaagaaaaacgagccaaggcccatatccactcaaccgggtgaaggccaaaaatggaaatgaacaagtttactgtacatccctcatttgccgtcgagtttgcaattcatccctgcaacgcaataccaaatagaatgtgtccctcaacttctaaaaccagtgcaaatacgatccgaagatggttttgatgatggtttcagctgacgtgacaactacgtggtgttgacgtggcacttaaagtcagaaaaaaaatccgtgaggcaacatgtaagcaccccttctctttcccctttcttctctcttctggtcttccctttcttctcatcgcacgaacgcccacttggaccctatccgtcgttcgtgcggtgagaagaaaggtaaaaccaggagggagaagaaagggaaagagaaggggtggttagtagggctgtcaacgagccgagcttgagcgagctcgcttgcctaggctcgagctcaatacaagctagagccgagcctataaaatgttcgagcttttaaacaggctcggttcgagctagatcaagctcgagctcgactaccgagcttgatttttaattagaacaatgtatattttaaagaatattcttttaaaaataattaatttatggtttatcatattagtagaagaggaaaaggaataaaataaatatatgatgccaatacaaggcatacaaataacatatttcatctaccaatttattaaatagcaataaaaaatcatatattactagggcttattagaagctcgagctcggctcgacaaagctcgcgagctttgggacaggctcaggctcggctcgtttggagctcgagccgagctcaaatcgagcataggacgagtcgagctcgagcagctcgcgagcctcgagctttttttaacagccctagtagttagatgtggtcccacgatatttttcttactttaagtgtcacatcagctgaaaccaccgtccaaatggccttaagatcttgtttgcacattggttttaagagttaagaaacacattatatctggtattgcgatgcagggactgatttcagattcggcgataaattgagagatctaaagtgaacttatattccaaacgaaaaagggaacaacttaaggccgtcatagcacaccaggcctatgaagaaggcatgcatgttatgtgggccatgtaagcgacgggatacagattcatggtccggcccatttacaccccgcctaggctgattggcatttcagtccaagtatactaatcccctcccaacccctctctcccgttttccgcgtacacgcttttttaattgttaaacggtactctctccgaccccctaatataagagattttgacattttgtttgcactgtttgatcactcgtcttattcaaaaaaattgtgcaaatataaaaaataaaaagttgtgcttaaagtactttagacaataaaataagtcaaaaaaataaataataattctaaaatttttcgaataagacgaatggttaaacagtgcaagcaaaatgtcccttatattaagggatggagggagtaagttttttttgcaaaaaaaattctatatgaaagttgcttaaaacaatcaaactaatcctttttaaaaaaaatagctaatacttaattaagcacgtgttaatggaccgctccgttttctgtgcagactgttccaagttcccaaccgggaatagcgaacacagcctaaagcctaaatggtattaacatggaagctttaggcgttcgtgaaatttgtttaaaaaaagtacatgcccgaaatactgataaagatggtttttctttaaaaatatgcttggaattgtacccatgataatccatactcccttcgttccactccatgcatgctgcaaatcattctagttgtcataacttaaacttctttagctacgactgagtttagagaaaaaatacagtgacatctacaataacaaataaatacactatcaagttagaaatttgtaaggtgtgtttaataaaaaaattcttcattaaactcgatcgaagttagaaatttataacttatgaaaaaaactaaaatgacttccaatgtgaaatggaggggtagattctaatttagtaacaatgtgccgctcctttcacagtgtgaaattcacactagatataataaaaataatggcttcgttgtctcgtaactaattattagatttgttttttccaataatagtgtcacgttcttacgatatcataagtgaagatcacaaagtgtaggtgtcctatagtaaattttatttgctaagattgtaatctactgatagtgtacccttaggctcatttgaaacaaagtaattttgtgattggattcgaagaacttttttatggtcctttgaacaaaggaatgtctctctcaaatttatttgaaaattcttaggtttcataaatcaatacaatcttttagagggaaaatcctttatgtaatctctttttttcttatattcatatatattccctcgctccatctagatcctattattttcatgtatttttatatccataggatttcaagtgacaaggcacccgaatcatatgttttctctgcatgtttgcaaatcaaaagtcttccgctaccaactgttacggtataccccctccgtcccattttaagtgcaaccataaatttctatgcccaactttgatcgtctatcttatttaaaaaaaaataaacttagcatttttgttgttatgagatgataaaatatgaatagtattttatacgtgacttaagttttaaatttttttaaaaaaaatttaaataagacaggcggtcgaaactgtgcacgaaaaattatggctgcacattaacgtgacggagggagtactagttcttatcggtatatttgcaaatccacccctatatacgacatatacttaattataaaatccggccaaatggctcatcattaaggacatcaccaatgtatatggcaaaagtggtctatatagatgggacccatataaataaactttaactatagcaatcctcacaatgtatatggatacaatgtaatattaggagaagagagagaagtagagatagataatattatttatgtcatatgggtagtccatatgcatatggataccttttgctattttctttatatggactagttgcataatgttactaagtggctgaataaaatagtttattccctatagaccacttctgtagtacattgtggatgtcctaagcatcatggcatggcgatctccacagaaatcggcggtgacgcgtccatgtcctattggacaggcagggcgtttattgtgcgagaggtggggcccactcgcgtggtccatctttcgttcctcgtcgctgtccctgctttttccttccggtcacggaaaatatcacatttccattcccactgccatccactgtgctttttaccctcaagtagatagcggcaaagattcagaccaacttgttaaaagaaacaaaagtggacaagtccactgtatgaaaagtttgttagttcttattccctccgttttataatagataatgccgttgactttttctcacatatttgaccattcattttattcaaaaattttatgcaaatgtataagatataaatcacatttaaagtactataagtaataaaacaactcataacaaaataaattataattacgtaaattttttgaataagacgaatggtcaaacatgtgataaaaagtcaacagcgtcatctattaaaaacggagatagtattattgtctattagtacttgttagccacatctaaaatttaaattgtgattttggttttaaagctgattttgagttttctcgtcttaccatatttttcagccttaggttttgtcccgaaaaattgtttgttggtttattagtcacatcgaaaaaaaacttagagctattgttttcatcatctgattgttggtttattagtcacatccaaatattaaattttgaatttaattttacagttgattttgaattttattatcatggtatatttcctagcctcaacttttatggcataaataatactgtacatgtataagggttatattcataattttagttgctttgtttatcttcttttcagtcttatcaactgtggctcaacagatcatatatcaacatatcttgccccagtgtttacacatgtttaataatcttgaaatcataagctgttatttttcaaagaagaaaacacaagctgttggagcttgggttaatttgtgcaggtgttcaggcacatctctgatctatatactgaagagctgtgtttgtgagatgtggacgccactattaagtttgagaaggaaataaaataagtctgatgataccgtagtgccctaacgcccagcaaccatgaatcatcaatcggttggttaactggaaatttcagcgcttaattgggaatcatcatcgtcgtactatacagttcattctctgtattatttattgagaaaatgatgcgtccttcgctgatgtgagagattttactatagaaaccaccttcacgttcaaagtcactgcagagggtacgatagtttataatttttatatgaataagtgcaattccaatatttatttattttctcaaaataacaccgttgcaaagtccttacagcgccgaaataaattttggagaaatcacgtacaccgtgcacgcgaatttattttgaaaccgtcttagttttaccataaaatctcttaggagtactacataaaatgcataccagcgaagtaagcatagttaaactgattagatttttaggttggaatatgtctaatcagattgtgctcgtattaactattaattattctttcagtggtagaggataacaaaacattcatggtaacttcatcaataccaggatatcccagtccagctattcaaatgtactctctccgtccaaaaaaaagcgaatataggactgaatgtgatacattctagtacggacataaataaatccaaatttgtagtactaggtcgtatctaatactagttgattttttacgagaatggtgagtacttataggagagtaggatgtaatatgtgacttcgtgaaggtgggtgcccgcgctgtgagcgtctaatgcacaccttcactccgtggggtaatagttccaatcccgttcaagcatgagctactagaacatatccccgtaaatacgtgtgagtgtggtgtgtgcacgcctgatcctatactcgaaataaaggattttttcaatttctaggcacaactaagtagtactagtaacgctaataaaacgaactacaactcatatgtcgcttgactttttttttttgtcaaacttttttatatttgatcaaatatatagaaaaaatatagtagcattttcaacacaaaacaaatatattatcaaactatattcaatgttaatttaacaaaactaaatttacattttagatattgttaaatccttcaacaaatttaagcaaacttaatgaagtttataacttagaaaaaaaaatcaaacaacttatattaagaaaccgatcgagtaatttacacggagtctagattcctcccccaaaatttgatttttgatttttttttctttatttttctgatagagggaggagtacggtgcaatttactcctgcgatttgcaaatgagtcacgtgcacgcgcaaaactgaaatgggctcctcctattcccatcgctcctctacggtcccctcccactcccgaagaagatcctctgacttacttccctctaactctgagtcaccgatatatgggcccattaaatagagggcccatatgttagtgacacaagttagaggagcctcccgactcactccctccctccctcccaactgctacaacaacaagtcctcgtcctcgtcctcgtcttcgtcttcctcctccacctcgcgcgctgcagcagcagcagcggtgcgcgtgatggcgttccactaccaggaccacgcgctggcgatggacgccgcggctgcggcggcggagacgggcggccaccaccaccctgggttcgtcggggcgggaggagttgtggggggaggaggaggaggagggtgggagcgggagaaggccgccatcgcggcgcacccgctgtacgagcggctgctggaggcgcacgtcgcgtgcctccgcgtcgccacccccgtcgaccagctgccccgcatcgacgcgcagattgcggcgcgccccccgccgctggccgccgccacggccgcagcggcggccgcggcggccggaggggcgccgtccggcggcgaggagctcgacctcttcatggtgagggctaaattattattagtagtagtagtagtagtagcgccaatcaaatccccccctctctttctccagggcgttttactcttatttttgccaagctatgaggtttgcgtggtgtgtctctgtatcgcttttgcgatcaaattctcctcgcgtgagagtttcttgtacgattggtatgtgaaatattattctggatgagcgatatcgaaaattggggctggaaagggaaatgaaattggctttttttttttgaaaccgaagccaggataagctggtgttatattaaggaggagagagtatttacaagaaattggctagtggaattaggagtgaaatttggaaggaaaaaaataattctcgaaaactcaagcttcatttcattaagaagcagcagaagtatgtacagtacaagtgtacaacagagcggtccacaaagaaggaaccctgtagaaaaaacatcaccaaaattttgacttttggaagggttggattgattttgtcggagtagcaatggttccgaccatcgtttttgaaatatagtcctttgaattgaatatgctaaaattcatcacttatttctcattccttggtgtttgtttgcatccctagttggctagttgttgaagaagctctaagttatacttccattatctagtccttgtttgatttagattattgagtgtattattgctgtggattatgtccttcgtcatagggatacattaaatatttcaataaataaacttaacaaataggttaaaacaagtggtctaagtaagtaatatactagaagaaagattttttgagaaaatacttcttttgaagcatggagcaaataatccgttttcagtaatccggtgaataagctaaagggaacatggtatcaattaatattgtttcttgcatacaatttctgttagctaagtttatgatcagttgcctcttttttaaaaagtcattttgtttatcaggtactcttctttgcttggaaatgacaatcttcctaaggcaattttttttacttaataaaaaaatgtttttttttcttgcagacccattatgtattgctcctttgttcgttcaaggaacaactacagcaacatgtgcgtgttcatgcaatggaagcagtaatggcttgctgggaacttgaacaaactttacagagccttacaggtagcacaaaaaaatctagttgatattattcaacatgagaatagtggactcctgattttaggaagagaaacttaaagttattatttctctctgtttaattcatgctgatgtgcaccattgtgctacctttcgtccatttttttccttctccgatataaacttgacctcaaagtttactcctttgtaggtacaaaaaagtacaaactaattccaccttttcaaccatcataatcacatagcatttaactagcttccttcactctaccaaatatagtttacattcttcaatcggaattgagatatacctgtggttgaacctgcagaaaataatgagtgttctgtttgggagaactttagtgatggacataggactactctcctaatggcaaaagggaatacagaagtaaaatttgaccaataatctggtgttttgccaatcctcagttgtgactcttactgcaggggcatctcctcgtgaaggttctggagcaactatgtctgatgacgaagacaatcaggttgatagtgagagcaacatgtttgatggaaatgatggatcagatggtatgggctttggccccttaatgctgacggagggcgagagatcattagttgagcgtgtacggcaagagctgaaacatgagcttaaacaggtaagattatggcctgaatttttagtcgtttgtatgttgttgtataaactttaaacgaaatttcaaatttccaggggtacagagaaaagcttgtggacattagggaagagatactccgaaagcgaagagctggaaaactcccaggagatacagcgtctactttgaaagcatggtggcaggctcactctaaatggccatacccaactgtatgtcagctcacagataccattatcaggccttcctgcatttccttttctaccactgatgctcatgtttcttaacctttataggaggaggacaaggctcgcttggtgcaggaaacagggttgcaactaaaacagatcaataattggtttatcaaccaacgtaaacggaactggcacagcaatcctgcttcatcctcatcagacaaaagcaagagaaaaaggtatcgtgtcgtggacttctaacagaaattccttttacatatttttggtttccattttcctgtctctgtctgtttatgcctagaaaaagaagcaatgcaggtgatggcaaggccgagcaatcttggtagaacgtggttggagaagaagtatatatatgtaaataatgcatccattgtgaagaatgccagtatatttattgctcccaagatggcgattcggacagaagcttcctggggctaatttatacgaaagaaattatgtcatgttataattttagtcatgtgaagctatagtgcgtatatatagtgacttaccagagagtagtttttatgtttgctgttggctagtgtgcatttgtagttgggacgtgctggctgtctctctacagctcggtacaaccatgtatttataacgtgttgtgaagcatatgttgtaaaatcgtggaatgggagtgttctgcgatccccatatgttgttgtaatgttgtatattgatgaccatgctgcaacggcagcatgtttgtaactcgttatatcctcaggctcttgtgttgttacaaattacagaactatattgtctttaacgagcatctcctgttgaattaataatagccagacagtcagatttttgttggatatttggataggaactttcttaaattgagattcctcgtccttttcatttctgtgatgatcctgaggtcgaaccggttgatgattgctgttcagaagattttttttttcattttgcaagtgtgaactgcaactgtgagcgtggaatggcgagtagccatcaccgagggcgacttgtatttaaattgggttcagagaagttttcaaccaaaatctttgtagtaatatcgaattttcggtgatgttatcgattgaggttatctgtagtctgaaagtcccatgttcactttgaaaattagggtctttgaaaggcaagtatatgccatgataaacttccaatatggttggtggtaatcttcaatggcagttttatgtttaacatgtactgttgaggcacactcgagactcctgaactgcgctcagagaagtccagaacacaagcaacagagagagcgtttgggttggttttgatgtgaatcggtagagagccgtgtgttattttggacaatagttattgcaggactttccagtctcatcgaaaggccgttctcgcatggaaaatgacaaggaaaatatttcggccttttacatgttctgtgattatataaggaacatggcactgcacgaactaaacagaataatgccaatcacttgaaaattacaaacttcacagaatttcccttcattttggtgcataactttcttagtagcaaagaaattgacataaaattgttcagcaggcttctggcacacaaaacaagataaaacagagtgttgttctcttgtaaacgaagatttatttcaagaccatatcaaagtaacagacatgaggatgccttcagcagcaaaacaactgcatctttcgatccaaaaggcagttagatatcaaggggttgcctcaagaacatctccatttgcttcgccctagtcttgatcgacatatcaaacaccttctgcccaaattgaataactagccctcccatgatgctgtagtcaatctgcaggcaacaaataattgagtgcatgtcctttgaatatcacttgacagactataggcaactgatgaaccaaggaattaccttctgttcaatcaagatagttttgttcttcccaagaatatcttgcaaggtctccttaagttccttctcctctttttcggggagtggctaacagcagaaaaccagaaagtcagcaagagaaaccagctaactacagtacaaggaactataatagaagctgcagtacgtacaaatccataaatatcttgaccaattgatgtaagctagcataaagaattctagaagctgattcttcaacattttgtagagtgattacgatagcaacagttgctcagtattgtatgttgtatctccatgaggtatatcctcattggaaaaaagaaggggttatttttcatgtgacaatttatttaacgagaaggaaaagaggagtgaaaagtgtctcgaatttctagtgtggcttatatttgggaaagcgttgaaaggttaaaatacatatatttgaaatcagagggtataatataacaaccagacactgtcaggaaaaaagaaaggagatcaaaggcttcagacatcaacttacaataactgtcctgacaaggaccttcacctcccccttatgtgccatggtcaaatcaacaaatctctcagcaatgcgatcaatgtgcttcagtctgccattgtcggcgagcacagcttcacaggaaggaaaaaaaaccttaggtgctaaccaaaagagtacatatggaaaaagaactccgtgtcatctattaatgatactgagtacatgaattaaaaacaaggttctaggaaagcgttgatcagatagttagccctttcaaaataaaaaactgtaattattgtagcagatcaaactaaaactacaaatattgttggctcacattgaaattataataactgaaggtagcaaaccgttgatatacaaaatggcattggaataaaaatttctgaaaataatcagatgcatttggggtttgggcttgtcctcaagctacctctataacgagttggtttactatcaactgcaacaaagttatcataaacaaatacaataaacttcattagacataacatgtgtggaccagaagtatacccaagaaattctttgtgacatctgaaaaaccagcttcagcgaaaatttcagttattgccttcaccctggtctctttgggcactgacaagtccttaatgaattgagaaaacaatggactcttcttggatgcctctacaacatcgcgaatctcagtttcaactttgtccagcaagttagctttggccgctgtaaggaacagagcactagcatagttgccggtgccaccatacagagcttctggaacctattgtggcaaaacaaacacaacaaataagattaacatgagtatctcagggcaaaataagaactactcaaactgccaaaagtaacccataaactgaaatggaaaagcactaatcgaaaacaggcagaaatcatgttgagataataaaaaacaagaacaatgcatatacaaaatcatctaccagttgaatataccgcgagcaaattttccttcgatgaaacacagtctctaccagtattgcatcatcacatttcctaacagggagaggattcatagccataacaccacaacggcacaaaaataaaagacacgaatcattttccacaggcagcagtacaaacaaattgcacattttctcatgtcacagaaccaggctaaccagagaagctttcaccaatgacgtgtataactattaacattcccccctgttccctagcagtatcaaaactacatcggcatcacacgaaaaaatgtgagcaatccaacgagatgcccgttccaggttaccttgatatccttcccggtcggctttgccacctgcgacgcgaagccccttgagccctcctgcatcatcacaaccaatcacatcaatctcaacaacaacaaccaaccaacgcgatccaggcaggcgccgcatagccaacaaaaaaaataaaaaaaatcccccacaaaaaaaacaccgaaaatcccagcgagaaatggatgacctagatcgagcgtgggattcatgcgccacgcatctaaatcgaagggggggggcggggggctcccctaaactggaatgaaatcgaagggtgcgaagagggggaggggaagacctgggagaggtgggcgcggaggagggggaggccggatctgaggtgccgcgccgccattcctgcccctcggttcgtcccctctgcggcagcggtggaaggcggaggcgaaaccctcggtgcggcggaggaggaggaggaggagatcgaggtgaggagaggaggggaaagaaaattatggaggcgatgcggaagaggagagacggagctagctaggggtcgcaacttgcaaccactacggaagagagtggttcttgggccgtttaggcccagtgtcgcaattgagagaaactgttatgggcctcatttgggtgggccagaatccccgtttggtcgttgtacccatcgatcgcccccaagaatcttgggctggtttcagctctcacctgtccatttacggccagtttggttatggaattattttcgaggatcaccaacagtatacctatctcaatcccaaaactgattttgaagaattttagtctaaaaaccagctataacagatcccctactttcctacctgagttttggtgttcccttctcccgattactcgctccgtttatatgcgggcgcgaaactcgctcacaatctcgcactcccacctctctcctcccgttgccgcgcgtgggagatagcgatctttctacgcgtgaaaggaaaaaaaaaacggaatttactgttggtagtttaacagaatggcccacttttaagctttggggattgaatttaaagctatctgttggagggaggagttttttcacttactattttcagtttaggaaacctataaacaattttttggagaaatattataggtaatctgttggtgatatgtctattatttgcttggataatgtgggagttttagaagggattggaaaggagagtttaagggtgaactcccaccttttcaataactgtgtagggtagttaattgggagataattatactttctaagtatgacaagataaatatgagtcgtgcatcatcacttaaaatttaattcttatccatactccccattatttccacctctactactaaacaaaggactgggagtaaaaatgaaactcccatgatcaatctcttttagagctttagtagacctaactcgtatagttaaatttaatcgttggagttctgtcaaatagatccaaacaattttagatccacctaaaaagggagtggagcttactagagtgctctcataaaatgaactagagagatggagttaggtttagtctgctccacaactgtagatctaactcctaaagttaaatttagcagttggagcaatggtaaacacacctgaaatggtttctgaactccacctcaaaagaaaacagagcaggctgcagtgatatgagaaaacaaactagaagtgtggagcgatggttcgagctgctcaacaactacactatagactcttcttagagttatatttagtaattggattcctaccaaacaagctcatggttcacaccttcatttaaaatttcgtaatctaaaattgagaactctcctaaactagtttttttatcgataaatttgtcatcttgcttagaggcttgtttgttttggccccccaaaataaaataaaattgcaaatatcaggttagccactgttattacaaatttaggaatggattattatgtgaaattttgtaaactttgacatgagtgcttttatttatacttatatattatttatgtggtgtaccggtaaacggcaaatatatggctaatatgatgtacatttgtgtgtttataatgataagtgtgtatgtgtacatacgagcgtatgtttttatgctacggttcaggggggaaaaagaagtggaatggcatgtactatgaatttccatacagcatatgcacctccatttttcctaaccatgcgtagggaaagcgctagttttatgtgcataatgtacaccgagaaaaacaaaagggggtcaaatcaattgcagaaagatgaaagaacacatgcttcggcgctgatccgatcgatcgattgatcgatcggtctgggggattgggatggatcatggatatatgcatgaacaagggaccccgatgggtgtttgcggcggtttagctggacaggatcccggcttgccgggaagatcgataaaatacaagagggagaggattgcaactagtgcaacaaccaacgtagatcaattggacgactgcttcgttgcgagtcgcgagactggatctcggcctctccattcgttcccgatcctactgatctactcactgctagtactactactatggcgtcgttgagattggagggtaaagtgtacaacccacgtcgccgtggagatcggtgagcaaagtgtggagacctatttggtttgttgtgttctggaggggtcacatgttttaccctacagcgtatatgtctatgctaaaatttaggaatagatctttaaaacttgaatttaaaatcgattttaaggttttaatcatagttctttttcaatattgatattgaaaccattaagaacaaatatataaaaatcattttatcgttaatagatcgtttgtggtattatcggcaattagcccactgatcgatgacagccggagattcttttcggctaactgttgtgcgtgatggcgcacgcgtcgtgcacatacgcgttccatgcccgattcggggagcgaaatcgaccgccgcttcagtcacgacgggcgcgccgcgtccaccgaatttgccatcacgtgtcgccgtcagtcaccacatggccaatccgtcatctataccctctgtacgtgccgcgccaacagagagatgaagtccacagcgcaaacagtatccagatgatccactagacgacaaccatggcagattcaggtaacgaataaatcgcaaccatgaatccagaaacaaccatggcggattctaggtaacgagagattgttgccacgaatccaaaaccagctctttcttctaatatttctaatattttgacgtgcaatcttttcacgtgttcgcgaaaggaaatatccaaaaccagctcatttcaagcatagaagcagcggcaaaactctggcaagagagcaataaatctctgcaacaatagtcttataactatcttcagcaaaactgcaacacatcatacatgatgacttgtgactgttacaagagtacttaacaaatcggtatatctcacaaaccacaaaaaagaaaaacagacatcttattacaagcaaggacctcactctgtgttccaagacttgcaaagaccaaccaagcttaattacccttcaacatcagtttacattccgaccgaccgaccgattgactcccaaataactcaattattacccaggaaaagggggagaaaaagaaaaaaggaaaacatattgggctccctataactgactctagactaataacttattaaacgcacctctaagcaaaaggtataaatgaaagaatatggatctgagaccgtccattgcgatgcttctggacacacggctggtaactttttttgattacaagatatgaaacaatgaagaggtatgaacagatagatcctagggacataaatgaaggcatatttatatcagtgctgaattcctaaatacgcgatctggcagtagagaacttgtccaccgatgccccagaagtttgttgccggccattctgttacaatatcccatcccaggttgttcacctcagggttgcaccttatgggatgcagccatggagcgtaacctaccagcaatctccgtaaaggttggccgttcggatggttctgtcgaccaacattgctccattagtgatctccactctggatcacaagagtcaggtactgctggtcgtagagtgttgctcacaatgccacctgccaagagtagaaaattttacaccaagcttggcaatcaaatcatctttgtccatctatattgcacgtataattcctacgacagtatcagataaggatcatgtaaaatctgaaatgggaaatcaagaccaacctataataacaccataatgcagatctgcgtatggttcttctcctgttaagagttcccagagaacaatcccaaaggagaacacatcaacctgaggcaccaaggcaacgttaatgttagtttaatatggacatgaatgtagcaggtcaaatgataatatgacacaatcaatatgtagaccttttcggagaccaagctgctacttccattcagaagttctggagccatccatggaagagtccccctcacaccaccagagatgagggtctgacattttacttttgaaagtccaagatcaccaacctacatcatcgaagaaaattattacaaaatagctaaatatataggggaaaggacaccagtcacctaattatattttcaaaaggtcactttgttggcacaagtaaaatgaaatttgctggaagtttgcatcagcaatatatcagtccagccacatttgcaaatgcctggtgacatttcaaggtgttaaaagcaaatgctgctaagtgtttcatagaaaattcaacaaagaacgctagtcgatcaactaaaagaatactccctccgtcccaatataagtgcaaacctagtactgatgtgacatatcctagggctaggaatctggatagacaatgatgtgacatatcctaggattacgaatctggacagttgcctatccagattcctagtcatagggtatgtcacatccgtactaggttgcaattatattgggacggagggagtacaaactaagatgacaaacaagcaggctcaagaatttgtacagagaggtctttgctagaaagcagatgtttataatctcaagttatatcaagtagttaaacttttagaaacttcctcttatcagatcgtgtacccatgccaccatttgtgtcttactaacatataataaaacaaatatcagagctgctccatcatcctatcatacatatgtcatgctccatgaagctgcagcggaagatgcccaagcggcagcaggttccaaccaagcagatataatcattcagtactaacagcaattctgtaccaggcaaactagatatctatctggatcagaacagcggacaccatatgctcctaagaagtaaatttacaagaatgtgggataataatgctaaaaattaccatgagtacccagtttaaaaggacaatataggacatactgcctaaattacctaatatcaagtaccacaaatattacagataagggaaatcataataatttagcaacacgatgtagcaatctaataaaaacaaatggagcctgctgcttaccttgcatattggacgctgaggatcccttaaattaacaagcaaattgtcacttttcaggtcaaagtgcactatgtttttgttatgcaaatattccattccgaaagcagtatccatggcaattatcaatctcttacgcttatccagggtcctgcacagataatttgattcaatcaacaccatgcaagaccaccaattttatgtgcattagacattaggatgtaacagatcaaagcagaagataactctgggtgtaaagggacatacttggcattcttcagcaaagctgttctgagtgaaccattaaccatgtattcagtaacagtggcaattgatcccccaggtccatcaagaacaacaccataaaaggccacgacatttgggtggtgtagatcagcaagtttagatgcttcattccaaaagtcattccgctgcagtaatccaggatatatcaatgcaaagacagcatagccaaacataacaatctgaagtgtgagaactaaccatcttgtcttgctctgatggcttcccagcaaaacatctgtcattgattcttttaatagcaacatcagatcccctccatttaccatgatatacggttccaaaagttccagaaccaagttcttggagctcttcaaggtcattattctttataatctgcaacataaacatttgattggtaacagaactaactatcaaagatttgcacgattaaaaagctatagttcacgaaagtaacctgcagacgtccaagatcatcagtagctggaaaacctgaaatccaatctgctggtctgctcttgttaacctgcatgattctcttgcttagcattaaggatgacatgaataaggacacatctgagaaagtaagaaattatatattaacctcattggcgtgtgcttcagcatctactttaccagtgacagcaccaactccatcattcaccacaggaggctgaggctctgatgactttgtattagatgtaggtaaactgtcctcgacacttaccaaatctgggctggtcatatcatcacctggattgatgcgatatgcagaaataagattcacaacttacaagtacatatattgacaaggttttatcaggaaatatggttaagcagacaacctttgatgaatcgaccatgctctgtatgggcgtccttgtgatctgattgttggnnnnnnnnnnnnnnnnnnnncggaatattcagatctggccctttgcaatttaataaagagttgtgagaatgtggatccttcgggctgatgttttccctgcttgctaccctcttaggtctcggtggcaaagcatgtgtatttgtcactactttccaggggtcgtcattgccaaattgctggccttgtaagccagactcttggatttggtccacattgggagcatgatttaccaatgctgctgcaggtacctgagcattagcatttggagctacttcatgtggaacatccttgcgctcacttaatggatttacagcagaatttgcatagacaagatcaacaccataagccgatggaggcactccaccaggcccaaccgtagctacaacataactcgagtagggacccccgatgctcatcatatgtggcatatggctcacattggtgtgctgaacattgtgcaaataagagctggcaatggaaggtgatggtgctggttcagttggaaggactaccttaggttcactgacatcaaaaaaggtgttggtgttgctctgactaacttctcttgctcgagtatctgggaacccctgagagttttctggtatggcattctggggtacaccattctcaggaggcatcactggctttctttgttcagtagaggcagaactggcctcactagggctcaagcggagcgaatccatcatcctgtccacattagccatataagtcggcacagcagcaggtgccactggggacacattatcacggcgcgtcagtccatcctcacgatgccttgcattgccacttaggctaccctcacctgtaagctgattgtttggactattttgcttgacgggatattgtgccattccttggcctgaaggcaattgctgctgctgcggtggcagcggctgctgcataatgtgttgatgagagcttgagatatcagaatgagccgaacctggagaaactactctgtccttctcatttggaatcacagggatctggttaaatccataggttgaaggcaactgctgtggtggaacttgctgctgctgatgaacatacacatgctgatgcaagccagatgggtcaatgagcactgtgttcggaatcccttcaacctgctgcgcatacatcatctccctctcatgcggcacgggatgcatatgggtgtacccataagcccccatcggaactggcaccgccctctccggcatcataatccttgccacgtcttctggccgcaggctcatgtataccggcaccgtctcggggccaggccctccatgcatatcgctaccgtagtcattcaccactggatctgagtgagcatgaggaagtgccttcaagcacatattgcagtcttccagccttcccccatttcctggcatcgcctgattcagaccctgcatggcctccctatgatcgttcatgaacacaggcggcaacggtggtagctgcgacagcggctgccggtacctcgctgcttccggctgtggattcgcctgcggtggagccctcacttcagcagcaatctcctgtggcttcacagggacaggagccggagcagcggcattgctgaacacatcgacaagcggtggcggcgccgccacaccaaacgccgatctcgcggcatcattcgagcaagtagaggtgggggagagcgcggtcggagaaccgccgccgccgccaccacccgaagtcggcgccggcggaggcggcccgccatcggagttctgcgtcgacgagaggctcgcgacgctgtccttgcgcacaataccgttcaccgcctccagataccggagcccggcatcgaatcccccgccctccgcctcctccccgccgccaccgcccgccgcgtcggagatggggaagatgaacaccctcagcttggggctcgcgccggccagcttgtcatactcctcgatcatgttgtcgagatcctccggcgaggacacggagatgagcgcgtcgaggccctcgtcggggagctggtacttcaccgcgaagctcgcccccgtggcgcccccgtacgcctcggcgagcctcccgaacagctccccgagcgccaccccgcgcggcaccgacacgatccgggtgtcgccgccggcgtaccgcagcgtcccgtcgcccgggcgcgggaggatgcggccgccgaggctgcacagcagcttcatcctctcccccgcgccgccgcccgcgtcctcggcggccatcggcggcgggcgcggggccgtccagtccgtcccaccaccaccacctcctccccctcctcctcctcctcctcgggctggatctagcctagggttttggagggggcgaatcgggggagggagaagcccacgcgattgcgggcgagcggatccgagaggggggaggggagcgagctgctcgatgctctcctcctcctcggcggagtcgctgctgctgcttgcgaggttagggaatttttttgcgtagtagtatttgttgttgcggaggtggaggcgaaggggggagaggagtggagggagggagggaagggggaaggggaggggaggagtagactagactgggggacggtgcgtttgtactcaaaaacccttggctcgcttcggttgctcgttttctttgttatattattttattatttttggaaaaaaaatgggttgtcacttatcggcgtcggtttttcttaggttaatttggaggtttctatttggttgtttgggggttttcttagcttgattttttgcttttggatggctggagaagattggtttttcgtttaaaagttgggaaaattttgtgtgtatgggttataggttattgtagaagaaggtatgtgttacggttggtatttgggttaaaacagatatgtgctacaacagagagctttatgtttctggtaaaaaaacagagagctttatgtggtaagacagtaatagtgatctttatctggcaagatgttattgtctatcgtcaatgcctcaatagcgatttaatgttatgcaatatcttagtaatggcgtaataaacatatctacaagatatggtttacgtgtgtactcgaaaagataagcatccaatgcatatcgtatagatagaatcaacggatacggccaagactataagtcaatgtttctacgcactaaaccatgatatgagcgtcaaagatatctgacgtcaacaagattgttgtgagataatagctcttctcgggaatatcgaaagatatagcatcatgatccgtgtattctatactttcggttggtttttacatactaatgatttgaatctattcttcattaatatttaagatcagtgacagacaattatgcattcatgggtaagaaaaatatttttactaccataaagagagacctaaaatgagccacttcgtcgcctcttttgaagtcttgaaattattgtgtttgtcatataagaaaaaaaggtacaccatctattttggtgggatgaaattttaatggcctagcttactgcaaatacatatggacaacaattgtatatttataaatagtcatagagttgtatggtgaatataactcaatttcaaataacttgttgaattgcatgtgaaatttgatctatttatttgggggaaaaaaactgtacccttgagggaagaagtccatcataatcatgaatgcgtctatctaaacctactgtggccagagtatttagcatcgtcatgtaaagataaaattgataacaacttataagtcttccttttaggcaactttgcttgtctcaatgtgtttccaacttgtacatttttattgtttccttttccacaatatatttcagtggagtgcatggacaacccatcaccacttccatgctggtagtattatcagattcttgcattgcttatgcatttgctcaaacacagtcccatgcattcttacacacaaagccactacttactagtttggcaccactacacccaacatttaccaaggttgaaagttaaaaactctagaaaatcagagtggtgttgctaaaaacacaaagagagcaactatacatgattatacatatattattgttttttactggcatacaggtattattttactcagccatagtggtggctgcctgtctataacaaaaaccacagatctactccagtcacacaagaacaaaattgaagagcctcgacctgaccttaggtggcatacatttactggcaccccctcattaaaaggacaactgggcctacaggaatgcaccccagcagaatcttaaagtagttcagttcattaataggatgctttaggttgtaattggagcacctgatccctcctagtaccatgacagaagggggagtgctttgctttagcctttagcatcatcctcctgcagaagtagcatcctaggagagtatgccatcctcttttcatccatagaacacatgattctccaagctttccatagaagtggaactatttcttactaatatttatgcattttgcgactaaaatgaaaaaggaaaacgaacgcgaaatacttataagttcattataaaaatgatcgcgtcttcgctcttataggtatttcttttatgtgctaaaactaagtgtttttttatgtgaaaagaaggcagttccaagcattatggtggattaatcttgctggtcccgacagaagaaagatgaaacctaagaaactgtccaactaggacggcaaagcgagtgttaaacaaaatggaagaagatgggagaaggacgtcgccatgggtggcacagcgtggggcctccggagctcgtgtccccaatcaggggtgttggtgtccgccccaacatctccattgggcaagaggatactccactttatcaagtcctttgccagcttcctcacaggtggtgtaatcatcagcattgatcatctttaaccaccacctagtagccaatactcaaatacagtacctgctatctgtgtggagagatgggtgagtggtagtaggagaaatttgagcaagctgcagttagatgtaggacagagtacagtagctatctactatgtggacagatgaatgagagtagtaggataaatttgaggaataagcggttatctatagtatttgtcatgaattcctttgattaacgtgtaacgcgcaaaaaaaatcagctgaaaatgacggaggtagtaaaattttagagttcagataaatctaactatggtgatgatttaatatgaaaattctattttgaatctccatgatttcaataaaattgtaccgtaggtttttcaaagaacctgaacaactgaccgggttgctgtactataaatcccatgctggtcattttaaaatatccatagtttataacaagatgattgagttaagctccgatggaatctcctttgtattagagttgtttgcatgcatatctcgattaattagaaatgaatcttgtaacttaacgtaaggtaaggttattctacatacaggggagattgtcaccaggtgattccaagtaatctactccctccgtcctataatataagggattttgagtttttcttgtattgcttgatcactcgtcttatttaaaaaattttagaattattattttttttgacttactttattatccaaattactttaagcataacttttcgttttttatattagcacaaattttttgaataagacgagtggtcaaacaatgcagaccggtcatcttacctgtcgtgaactgtgatctgacatctatttcaaagaggacaataatttccatgttctaggtatgggccaagaaaaaaaacacgcacacttttgattactgaataattaaaccacctcgcaagtgagatattttagctttatgagatactagtttgctgtcgtgcatggaataaagagggatgtgattgtgaaagagtgaagcaaggatttcgtccccacgttgaacccttaatcaagggcaagagggtgtccaaattagttgatgatctgatcccggggaaaagttcatccttaaaccgtgattttttagcatggtttaagactttaagctaattggagacgaatgctgatgaaaagaaaagaaatactatacctaagcgtcttgatgcattcagttttggatgcaccctgtactttttttttttactcgtctccgacgcacacggcaagctgtttctgcgtgttcttcttgtcacatagcctgggatttgctgtgaccaggagggagcatagtcaccaccagccagcctcactgtcacacactgttttgcttaagattccttgtaccctgcactttattggaatccaggtccagttaagtgacagtcaaaatggtaacagtgttgagctgcctgaccacctgccagcaaacacaccttgatcctgtcacacagcaaaacggcttccgaagaggcatcctttgtaggattccaatcgtacataaaacaaattatttgacatttcgaaacagaggattggagctttctacatttcgaaacagaaaattctttagaaatggcttaatgcatgtatatcttagaaaaaaaatcagtagaaaacatatcctatgtagacaaacttatatgtgtatcgtgcatatcagtaacaaatatcaccaaaacttttagacaaaaacttccaataatattttacctacatgtatgtaaagttttaacttaaattcattatattttagtagcacctcaaaattacagttgtaatagtataaatctattagaattttattttttttatctctctatgtataaatttgaaggcgagactttacacatagacgtaacatgattttaagtacatgttcactttttctttactatttcggtaatatttgttagttagtttgaacggtatgcatacgaaagcttatgtgcatgacataagttcctaagttagtaagagctagctctaacctctttaaagtttctctaactctatctctcctctcatacaaatttttatgtttcttctattgtctgtctaaatgattattttcgtgttttaaaatattttatgttacacaagtacttttattaaaatcctatatttttttcatttttctgtgtttttcaccattccattatttaaaagggatctcagtgtgctcttcgattcttcgagaaacgcacatgggtcttccggctagctccacaaggtggtgggctagacgacctggtttcgaagcctcaccccttctaattattgattaggtccttccctgatgtacgtgttttctgtgctcttcgattcttctgttatcccatttaccactttcggtcgtctgaatttacaccctcaactgttttcagtgggtatgtcgtcgtaaaagatcgtgttaatctaggggaaaaaacatctttcacgcataacctactaataaagaagattagtagtagtaaagaagattactggttcactcccaaagcacatggccccaaatccccagcctgtggggaagcaagagggcacagatatcctcaagctcagtcacaggatcacagacagactcacagtgttagcctcctctccgtagcagattggcagatgagcaggacgataggactagcagtagctagtgcaggtggtgtttggttctcggagaaggtgggtgggatgcagggggcgagaccactccctagtttgattcatgggtgggatgatcctagtttttatttggtgcaagcgataaggaagaaaagggttggatgttgcctgaagccatcgtcaacccatcgtcaaagtgcttgacacaccccatacatcgaacaaaataatgatataaccgtgaattcataactggtagtaggttattatatttaggataatatgagtattttagcggtaaaaaattaccttttataagtaatagtattagattattatatttaggataacttattctattttggaacaaatgcttaagagcttacgatgcatgcccattataataacatactatcttcgtcccaaaataagtttatttttcacgcatctcatacatactaatacaaaaccagaatactagaatactgtcacgccctgaagtttccctctttgctttaaaattcataaaataaatcgtccgaagaaatgatttaatttaacctagagatgaatccctaaattaataaatgcaaataataattggaatcggtatgtggaatttttcttgagttctacatgtcgaaatgtgctaacaagatttttaatggaattttcagagctctagaaataattttaaccaattaaaatcgagcacaagcaatatttaaatccctggaaaatcccctttttccttttctcttctttttcttcctttttccttcctttttttcctcttattgggccgtaggcccacttcctcccgcgcccttcctccttgctgggctggcccactccctccctcctctctccgggtcaccgacaggtggggcccacctgtcggccccttcttccacctccagccgacggtggcaatcaccgccgaaaccgccgcgccgccgccgctttccccgctcctcccgcacccactccgtgccccacgcccctccccacattgtcgcgacgccgccctcgccttcccgcccgcgccgcgcgcccacaaggggcggattcgaattttgaatccccccagctctctctccccactcccccacgtcggtgagaaatccggccgcctcccagcctcgtccgtccctcccgagcccatataaaccatccccgcattctcctcctcatttttcctttttccatcggccgctcccgagctctccaccgcgcccgcaccgtgcgcccacccgcagccgccatctccactgctccggccgcctctagcagccgctagggccgccgccgcaccacgccgccactgtcgtcgggttcgcgcggccgaggtccgcctcgtccacccctcatccgtcacaatccgtcgccgaagatcatccgtcacaatccgtcgccgaggtttccgcttgccgtggactccctctctccctctaacctctctcttttcctctcttagggtgtcccggagctcggccgctgttcgccgtcgccctccggtcgctcgccgtcgccgttcgtcgtcgcctcctcccgcgccgtccgaaccccggtgaggcacccctcccccgtttttccccttcctctccctcctagcgccgagccggcgccgccgtcgcgccgccgcgtcgccggtcgccgccgtcggtggccgcttgccgccgcccctccatggccagccggcttggagccaagccgagcccggcagacaccacccccccctttggagccgctgccggtggggtccgcctgccaaccactccctctctctctcccattgagtcactgacccgtgggtcccgtttgtcggcgccgccccacccccccccctcgatgatgtcagcatggacctttattgcgcaataaaatccgttaaggccttttcttttatagtaaaaacacatttaatcttctaaaattcatatctaattcatccgaactccgtttaagtccattcaagtctcagtaaattcataaaaatgcatagaatccattaaaaatggttttgtttcctgtttcagtagtcttatagcatgttttgcttgtgtgctttgtttgtcgcgtagatctcggccgtttcgtcgctctacggtttctcgaagacgttgttgtggtctcatcagtgtgagaacaaggcaagtcatgcattacaattgatcatattgtacccaatttataaatgtcccgcatttctattaaatgttgcattcttttacaatatcatgtgggatgggtcttactactcagccatatattgtttacttcctccggttccatattaattgacgttttggagaaggttgaggtcaaacttttataaatttgaccatcaataactttaaaaatatttagtttgaaggaactagaacaacatatatagatttgtcttttaaagtactataataaaataaaagtaaacatgcatttatttattatatatattataatagaaaaataagatcaaatatgtatttgtagaccgtgtcattgtccaaaacgtcaactaaaatggaaccggagagagtatcatctattttcatcaactccgatgtaataagtgcgcatgtattatgagtgtgtatttggattgtgttttaaaataattcttaaaaataaatttattttaaataaacaagaggagaaaatgattttattattgtgagacggagggaataaccgcgagaaattcaggtgttttatccagttggaagcgagagggggagagaggccacatgggccacatgcccaggaatccagctagccggacacccaggtggcttgcaccctcttgcagtcgcgcggccttctgcttctttacaggttttgccggtactcgcgcgcgccccggaactcgcgtcgcgtcgcgtcgcccaccacttcttccccccgtctcgcctcgcggcgcgtcaccacctcgccaccaccaccgcgtcgcgtcgcgtactactcgcgtggcgcgcctcttattctatgcgtataagagcaagtattagtacagtggactactcatagcaagtttaataatagtatagcccactactaactccaaatcatttatagacaatataatagtcaattcatgcaatatttgcttattatactattaatatctagtcccacctatcatacgcacattacgtattgcagtccgtgctacagatggctacagatatgtaacttgctgctcttctctcttcctttatctttttaaaatatgtttatagttggcttatagcctgctattgtacctgctctaacttcaaatcatctatagccaagttaatagttgattcatataatatataatagttacatataaatatatattacactattaatatatagtcccacctttttatacacataaaacattttgaaatccgtgttgcagctagctacaaatttgtaacctaatttccttcttagggcacccgcaatggttatctataggctctctacaagagatccatgtcaacatattttcttacttggaagatattaaatgaagagagagagcaaaactatctactaacctggagatagtctatagagaaaaacgaggcaatgcattagagagctatagataccgatgtagacatactattgaggtgatttactattaatctagtctattgctgagatgtacatgttttatagagagcaacttactttaccattgcgggtgctcttactcttctctaaggccctcttatcacattcacttgtatttatagctaacttgtagtctgttattgtactcgttctaaggccatgtttagatcccactctaaattttttcaccctgtcacatcgaacatttaaacacctgcatgaagtattaattataggctaaaaaataattgcacgtattgcgactaatttgtgagacggatcttttaaacctaattgctccatcatttgataatatggtgctacagtaaacatttgctaatgacagattaattagacttaataaattcgtctcgcggtttactgacggattatatataattagtttttttattagtgtccgaacaccccatacgatacgctatataatatctaatatgacacgttaaaacttttacacctgatctaaacaccccctaaatcacctcacctatgtaccactgtactatccaccgctcccatgtcggcattccgttctttcagctgcgatttcctctctctttttttgttatcttctccgtgggtttctccgctcttctcacatggatctttgaccggggaaaagtgatggatggatgctgtgcattttgtttggtcacttgtccattcaggttttgtttggatctagtcttagatcgtggagatcatccagtggcagtactagtactttgttactgtatgtattattcaggatggattgcacatttgattagtatttgcatgggcagaaggaatcaggcaacagtttaagaacacaggatgcaatcacatttggcaaaggctttttagctgaagattggatactcctctcaatctgtcgcctcaaacaagcagcaatgtatgcatcgcacgtgaggtcaatgggaggggagattgatgtcacgtggcaagccagaaaagaatgggcatgttcactttgatttcattttcaaccttaccaaattttaggaaagttgctaaaaaaagtgactacatttagtttgctgtcaaattttagtaactatataagaaattttggcaaactatgttaaaattttggtaatgccaaaatttagtaaggttttttttttgcaacaaagtgaacaggcccaaagaaaacgtcttcgtacatttcgcttggtcgacatggcgagcacaggagcgaaacttcagtaaattcattatccatcatagcacaagtatcaataaaaaaaataactaaaataactttttttatcaaattccagtgtagatattacttattttttctacttttaatgtacttgtttcatactgccacaaacttcaatataataattatttaaaaataaatttactttagaacaaatcagagaagaaaaatggtgttattttaggaccaagtatgtccgatgtggttaggcagctgtgacacatacggatgtttctagctgcaaccatgactgtatttaattggaccagtggctcagtactcctcccatacctgccacaccagacatttccgcacctaatttgcttttggttactagggctacatttgctgcaaccttttcttcaatcttgtctctttgcttgccttgcgtacttggctagtagttggtcgtcttctgtttttttatgggagaaaagaggcccatgaatgttcttggatcacgataggccgttctaagtctacaagcctggtagtgaggctggtaggcccaataaattcggcccattgaatggcccaatcctgacatgaaggcgagaatcagtgggctccgtgtgcaggtaatcagattctggaagtgagcctcaccatcaaaggccgtgtgtctgtggcccttttaagctgttgctggtttgcgacgggaaaaagtccacttagactcccttaattgttcaccgaatctaattcatgagccttaactgaaaaaacgggtagaacgactccccgaattatagaaacgagtgtattttcactcctccagaggttttggagggcggtttttactgacgtggtggtgctaacccgatttttattacacatggcgcttatgtggcattagaatttaaaaaatatccgtgggacccatatgtcattcaaacacaaaatatattgtgggacctaccaacatgtggggcccacatgtaatcctttctccttcctttcttcctcctcccttcctcctcccttctctctcttttctctcccccttttttcttcccccttcgaatgagcagcagcagcaggttcagcccaccaccacccaccacattacccgcaatgtctcctgccgcgcccgccccagcgagctcctcgccatcgtcgaccccagcggcgccgccaaagtccacccttctcaagatcctcaccggccgcctccacccctccccgcctcccgacctgctcctcctcaacggcgtccccgccaccaccgccaaccaccgcccccgtcacccggcgcgacgtcctcttcccgctcctcaccatccgcgacacgctctgcttcagctccagcacccgcctctcccccaagcacatcgacgcctgcgtcgacactggagctgacatgggtggaggcggaggagaaagaggcgcactcgcctcgacaccgtgccgcctcggcgtcgtccgccgtgcaccgaccgctcggtcgtgccgccccttccgccgccgctgcacgcagtcgtgtgccgtcgtcggcctttctctctcaaatcccgtcgccgtcgcccttcccgtgtccctagcgactgccccgagtcgccgccctagccgctcgtgccttcttcccccctttcaccgcaccgcttcttccgccgcgctaccgtcgccggtgactctcggtcttcacgccgtcgtgtgtgcgtcgcagtggtggagtggctcgaccaaaccaaccgtgcgagccgcgtatcgctccttgcgcgcagccatgtcggcactccggcgagcttcgccgccgccgccggtcgccatcgtgtctcctctccccaatccaagccggtgaatggattgcccatcttctcctctaccctccagtgctagcactttcccccggatcgccgccgtgagccgtccgatccggcgccccctccttctctcctctcgtcttgccaccgtggctgcccacgtggcgttgaccgaccctgcccatgtccagtcagccggtcagccctcctctctctctctctcccgtgcttgtgggctctccacgtaagcggcacgtcgacgacacatgggacgaaaaccgggtcaacaccaccacgtaactgtcacgtcagccaaaaccgcttgcaaaatcacccagtaagttaaattacacctgttttaatagtttaaggaatcatcttatctggttttctggttaagggtacaaattagattcgctcgatatttaagggagtcaattggacttttttcctttgcgacgctgctaggcccgtaaggctatacgacatcaaaagttacagtacgcattgcgctttaggactttctttcttcatcttaaaaatcgaattattgacatatattatatgtttcatgcttcgaaacatatattttcttaaagaaaatttttctactacattactacattaactatcactattgcctctttctcctagtagttgtaagtagtagtgctagttatttttggctattatctaaaaaaaagttatttttggctgccctggcggcctgttttttctttcctgttttgttccagaacatgaacaatgttagttagatcatgttttgtcacttgaaagcttccgatagctggagttatatattacttcctccatttcacaatgtaaaactttgaagcattgcttatattaatatagatattaatgaatctagatatatatagtgtttagattcattaatatctatatgaatatggacaatgctagaaaatcttacattatgaaatgaagggagtatatcagaagcttttcaaatataactagtgtctacatacccacaaatccattggtcatactcgtgacaaaatgcagaatgcaatcttttattgatcggtggagctgaagaagcaaagcaaacaccttgtgacgagttagatgggatcaaattgcacacggaccgcaccgggtacttcgggtacttctatagttaggacttgttctttcctccaataaaagttggacaaaaatttagatatccgtgacacgtttcatgtgaaactttctatataaaaattactctaaaatatcagataaatataatatcagataaatatatgttttaagtttgtaatagataaaactcaattaaccctatgttaatagcatatcgttttatgtaaaatacttaatctccatctgcatgagtttcaaaaaccaccttagtccaatgtagcagcagcagctcgcgcacacgtgcacgcgccaattcgagtggcgagtactgcgcatttgaccgtccaaaagcgtccgctagcttgatccacgcacaacagtcacgttacaaaaggggtggcactcgtagactggacagtgcaagtgtggaccagaccgtgtggtggcaatggcatattggcatctgcaacgggcaagacggcgaggcaaacggctacctccactcaactcgcctcctcgccttccccatcgcatcggatccaccaaatccttctcggtttgacccagcacgcgcatccggtccaagtccaaccaactggctgcgcagcatgcaacgcagcaacgtccatttctctctttttttctcataaatccccttaatttttcccctttctccaaaggcgccaaattttgcagaaaaatccaaaccccggctcaatccccaaatttcgtcgtcatatcccccggcgaaaaagaccaatgcgcacgcgggaatgggagtacactcctactgcgccaccaaactcgcctcgcacacgcgcgggcccacatgtcattcaccgattcacgagtccaaaactaccgcggtaaaaggagggagagattttttttcaagactaaaatcgccccaattctgggatacatcaccaatttttcacaaacatctcgatatgtatcgaattacataggaaaccatgtgtcgaaaccatgggaacatttcctctaagctaatagtgtagtaataatctcacaatttttgatgctgtagtttaatcatgagtacacagtttaatctctctatagtgaagaagagttagggcgtggaggaggagacaggtggggtacagttcatgagatggcgatggccgtcgaccgccgcgccggcgccgccaccggcgagggcgggagccgggaggagaagttcttgtaccggaaggccgcggcggcgtcgtctgcggcgtcgtcgtcgccgtcgccatcgtcgaagttgagcgcgtagctgagcgggtcgtacccgaactcccccgcggccacccgccgcctccacctcagcttctccccgctccgccgctcccccggcgagccgaagcagcagcacaccgtcgtcctcagtctgtgccttagcgacgacggcgacgtcggcggcgatgcctccatcgagctagctctcgccgtagtagtggattgggatcactggtgattttttgagatgaattttccgatgatgagatggtggttttggtttgggtggagagacgaagggtgcggctaaatagggacgggcctctgacggcgtgaactgggaagtgcggcggctagctactactccctccgtctccgtcccaaaataagtgcagttttacactattcacgtttaacatttgaccgttcatcttatttgaaaattttttatgattaatatttttattgctattaaatgataaaacatgaatagtactttatacgtgactaaatattttcaaatttttcataaatgttttaaataagacggatggtcaaatgttggacacagatatctacggctacacttggtttgagacggaggtagtacggagtacgcggtgggggaagcgccgttacgcgtgcagttagacgtgggggccgtttggggattttgcttagcgtaggcgggttgcggatgacgacgtggggcccacggctcagcgggaccagcaacggatcgatgatgattgatgataacggtcggtcgtgcaggcagcctgtcgcggatgacaggtcagggctaatacgatcattatgctgttgcagattagcatgagcacatatgtgatgaactattagggcacccagaattgttatctatagactctctacaatatatctatgtcagcatattttcttaattggaaaagattaaatgaagagggagagcaacgctatctactaatctttagatagtctatagagaaaaacgaggcaatggattagagagctatagatatacatgtaaacataccattgaagtggtttactattaatctagtctattgctgagatatacatgttttatagatagcacattattttactgttgccggtgctcttagcgattctacaaatctgtaaatacaatgaactgattgtgaaaattcaggctacttctaagatgtgaagaagattgtactggcctactgctattaattactctctccatttcaaaagaaattaatctaagatgagccacatttttatataggttgattttgattttttttggaacgaaacaagtaaacttattttttccattggcagtcacaccagtttgcaatcttggtctcctcctgggctacgcaatcgcgtcaaacgtattagactccgtaccaccttaattaagaccccttccccaaataggagtataataataccccaactaatcatcgccatatctccgtgcaaaaccggataagaattccacacagccgaaagagcaaaataagctcacatggcggccgatggcgtgcgttcgtccagctcctccaaagacccacagatacgcatagaacgcgatagccgactgattaagattctcttcagtcaaatgaacaaatgcacagtaactttgtcatatgaacttaaatattatcgggtttatatatcaataataaagtcacgtgacttcgattacagaggatcctcgtcctaagcgacaccccgaaagcggccccctccgcccgggccgcgttaaggcgaaaaaaaagcaagcaaaaaagagattagaaaaacgtttatgaacgcgaggcgaacccgatgctagcccgaagatatcggcgggcggcggcagcacgggcggacgagaaggcgaggggatcaaaggggaaaagcctggatagcctctccacgtctgcttttcgcgacggcgaccgccgccagctcgagtggtagctagtggtcggctcggacgaaaggatcggaatcagctgctgctttgttggctgtttgctcgtcaagtggcctcgctgaggtgcggggtgcagtggatcggagtggatagggcgaaatgtcctgcggttactgtcggttttggttcccgcgatgcagggatgcaggctgtttcgagcgcacgtagcacaccggatttgtatggctgcaacggatggtctttggattaggtagagggaaaaaagcaaaccgagtccctttgtagtgttttgtgtaattaaatttctcgatcgatatgttcatgattgtaacattgttgacgagtaatccaatagagctcgtttatatgcttatatgttaaattttataaattttaattttatagttgattttgtggatttttattatggtttattttacaataatcgctaataacatgtatatactaattttactaaattaattttaacttactaataaacggtggtttatataagcataaatataagggaaacaataaagccgatatttttatttgggtgcagccgtggaggcatctttgataatcggaccgatgaatggccaaatgaacaattgaagatacctctgagaacgaccaaataggttatgatcccgtcagctctccatgaaatgagagctctgactgcagagtcttaacgaaaataataatgctactaattcgcagatggagtaaagcctgacgcctaagggggagtttggatgggttaatccgtcacatcggatgtttaatattaattataagtattaaacgtaaactaatgataaaatctattttataaccctagactaattcgcaaaataaatctattgagcctaattaattcatgattagcctatgtgatgctacagtaaacattctctaattatagattatttagacttaaaacatttgtctcgtggattagctcttatttattatgcaattagttttgtaagtagtttatgtttaatactgtaaattagtgtccaaacattcaatgtgacatagactaaagtttggtccctgaatcaaaacacccctctaagatagtgtcatagtgcactagtgctacatgaccgaattatctactacgaagtacaagcgagagataaggatcagattcacaatcaatcacttttctcctgcgagataagctactataagttgcgccacatctcgatgccaaaacgaacggtggatgatgtcgtagccacgcatgctatatgaatggatagatatataccttcccttcctcccgcaggaaagaactagcatcactggttcactgtctcactcatcaaaagcttaattatgtaacactcaaaagtgcccattcgagaaatacacgtaatcaaacgatttgtttaacctgacgattttctccttgacccatgaggacatgagtcacgtcgcaccattaagctccaaaaaatatgagacaaaattgctgacaggatcacaggattgggttcagtctcgatttgccgatcgaacccttggaagctgtgggctaatcacaggtgcatgtggcacacagtaaattgcactaaaacagagggctaacttgtcacgtatcgcaacttgcaacgtacagtacccttttgtcggaaaaagttaacctaaatttagatgcgatgtaaactaatacaataatctaaatatatatttttttaaattcattgtactctactgtgtcataacaaattctagtttatttgtttttcctttttgcgcaggaagtaagttctcagagcaagtttaacagatgaactcactatcacttatcagtctatcttagaggggcgaatgcctttttctcgtgaaagggagatgcctaatcgtatcggttactgtgtgatagtctgacaaccatatggcgtcccatgagaacaaggataaatcagctataaacttatcttaaaaaagagaaaaaatgcgttagctctcgtatagtaagagttaactctatacgtgttttaagataaacacattgaatgtataagtaagagaaatagtgaagagaagaaaatttaaaggtaacttaatctattatatatatatatatagtaaatttgtttggtgctccatggtgcccgggcaccattgttgaaattgagtatatacctaattcaaatgcaattaaaactttttcaattacttaggtattaacattaactactttactaacaagtttaaagcaagtttgaactgaatttgaacttgtttttgttagatgttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatacagtgactggaaagtatcaacggccaggcgataattacgataagttgatggctgcaagcagttggcctgctgccggattgctttcgatcaatgtcgctagacgctgcacctgattaagggtattcccaacccaattactatgatagtgtccaaagtattaaataagttgtcacctagaacaaaaaaaatgatgtggcaagtgaataaatgaagaaagagaaggaaaccatgtcttatgtaagacatggtttctacacaacattcaagatatcatgcgagataatagtgttgtttgcattgaaagagtagtctctagtactagtttcttgatgatgtggagtttatgaaaaccatgtctagtgttatgggttgggactgctctaatgacgtgtatagacgaaatctccgaaagcaaatgtatcatgacagttataaatatgagagttttcttgcaaaatcatgtaaagttataaatcctgcgaaattttcctcaactattaacaactgccatacgttgcaacaaacttatcatcttcgtttcaaaataaacttacagtacttaataaaaatgtgacacaatctagtacaacgaatctgagcatctctatccccatacaatgttagctataactacaagaggaggaccaagacaacggagagagatcccatatcaaaacttcaactcaatatccagttgaattagccagagaaaagctttcccaaatcttgtaactttgcaaataagagatccaaagatgaacacgacaggagtagaatgttacatttccgagcgatcgatctaaacctatatgaaccacatgtttcattatttttcttccaaccacggactcacatctgtacacatgctccctggctgaatccagaaaggggttggacatttctatgctattggaagtttggaactcaggctccggttgctcgatctcatcgtcgtgggcaatcaacgatgtttctctgtcagacatatagaagagaaagctctcatttttgcatgcacatttctcaagcgaccagacatcatgtttttttaaaaaatataaaaaatattttaaaatacatcaatttatattaaaatttaaaatagtaaaatacttcactaatcgtatgttacactgtaaacttagccaggtatcgtaagcgcgtggtaattggagttgagacctgagacgtggcatctggcacgcgaatgagtcacgtaaattggccttgtttagttggggaaaatttttaggtttggttatcacatcggatatacagacacacatttgaagtattaaatgttgtctaataacaaaacaaattacagattccgctagaaaaccgcgagatgaatttattaagcctaattattccatcattagcaaatgtttactgtagcatcacattgtcaaatcatgacgcaattagacttaaaagattcgtcttgcaatttacacgtaatttgtatattttttcctacatttaatcctctatgcatttgttcaaacgctcgatgttacagcgtgaatttttttattttggaaacttaaacagggccatacgagaaggaaaaaaaaaatccgcgacccatcggagcaaaaaccacaccggcaccggcaccgcgcgaacggccgcggctcgcgccacgccgacgctctcccgccacaaccgcgggattcccccccccccccccccccaccgaacttacctaagcgtcgcctctcgtcttttttcccgtgcaacgttgcaagtgaaatcatcaatcgtgcgtgcgctgcgcccgaccatggagctcgcggtcagagcagccgccgcggcctcctgctcctccggcgcctcgctccagctcccgcgggcccgagccccgctccgcctccttggccaccgccgcctccccgctcgccgggtggctgtcgaggccgccgcgatcgccgtcgagccggtgagttttaagtcatttgatgttgccgcccctttgcctgacaggtgttcggcgttatgcggacctggcagcaggtcagctactaggtggtctggagctagtggaaatctcgcagcgattcttttttttttcttgcgcactgaggcgatttcttgcctctgctgtaaatggttagctgtttctatctcttctttgctataagtgcataggaggccatatatctgcaaagaagcttcgtagaatactgacaagatacattatctgtggatgatcagctgagaagttacatggacttatggacctataagttttttgagacttgagactagtgaccacttgggtaaattgggtttcgggtacatgctgatgatgactagcagtaacggggcacctacatataccatggtggttttgacttctgcttattcaaggtgcccacgtatgctggggcagagatgggcttgtcaataatcacattgcgtctgaatgtctgatgtttctcattagaccctgccctgctgtttgtgtgttatatcttggacttttggagttccaacctgacaataacgatagcctttttcgttctgtgtgaaactaaagaatttggctgtagcttctttgaagcaaaggctggaatgaattccattattaaaaaaaaaactgaagaattgattgtctctgtgttttacacttaataggaaaacaaagtaccgcagagtaacaattcagaagccgaggtgtttgcatgccctgtttgctatgagccattgataaggaaaggcccatcgggcataaacttgtacgtacaatttcatttctacattatgttttgcatgttttgttagattggcatttatgatatgttccttttatgcatgctccaggccatcaatttataggtctgggttcaaatgttcaaagtgcaacaagtcattcaccagcaaagatatcttcttggatctcactgtcacttctggaacaaaagaatatagtgaattgaagccagctagaactgagctgttcaggagcccactcgtctcatttctttatgaaagagggtggcgtcaaaatttcaatcgaagtggattccctggacttgacgaagaggttcatttctaggacattcccttcgttgtttgatatctcggcgttactaaataacaaagtctagccaacgtgacctgtggtgtaatatatttctgtttcaataagtaaagaagcaatgttaattcaccaagtgtttactatagaacataatcatttcttatgtatgtttttctgatctgttgttggtttcatcagtttcaaatggctcaagattatttccaatcagttgctggtggtgtacttcttgatgtaagctgtggcagtggcttgttcacaagaaaatttgcaaaatctggatcgtactcagctgtgattgctttggacttctccgagaatatgctttgccagtgttatgaatttattcagcaagatgatactcttgtaaacacgtgagctctcttcttcatgtctctgaatttcgttaatatcctttctgcttttcgtgtgagtacaaaaaattacagcatatgtcacacaaatgaaacaagacataaccttaaccacttctaacataaatatattatcaattaagcattttgcagagcatcactttgtctgtttgaagttactagtttatgtagtttaatttaatctatgcatcaattaccaggcaacacaaaaattacgtgattaacatccaaatgaactgcaattgacacagaattctattttctccatctggtgctttttaagacaaatactccaatctttatttagttcatgccaggtgcacaactaactgttttcctcttatgcttacacagaaatcttgctcttgtaagggcagatatttcgagactcccttttgcttcatcttcaattgatgccattcatgctggagctgctatccactgctggccctccccttcgaatgcggttagtatctgtccaatttgctctcatgattaaggtgactaatttggtctgtatagcagtattggagtctccagatttatgataatgaattgttctgtaaaactgtcatcactttaaactgctttcacctgaatctctgttcttctgctcctgtttaattatcaggtggctgaaataagtcgagtcctgaggcctggtggtgtctttgtagcaacaaccttcttatcttctcccaggaacaatcccttctctgttgaagcgttgcggccactgagacaggtaactttttctacttattttctgcttatctaaccctatgagcttatgcagtcatactcacattgctgctttatatactgcagattgttggaccagttaacaccagctacaattacttcaccgaaggagagctcgaagacttgtgcaaatcctgcggtcttgttaattacagcagcaaggtccagaggtcgttcatcatgttttctgggcagaagccgtagcctaaaattacatcaaaacctttgtagccaaagtatagctgtcaattctacaaaagtctttgtaaaatgccattcaccgatacctgcatagattagacccagcagaagtttttgcttggaattcctctccctgttatgaagatatagttgtcacatgtatactgtgcttcagtacagtgatgtaccacagccagggtgtatttcacacctggaagaaaaaaaaaacgttctagtactattttcccaacttgtatagggcctcttttggaatggaggattttttcaggaattgaactataattcctgtggaattcctataagattcctacgttcgaaagggccttaaatgatttatttaggcccataaactttcaatctagggtttataagtttgcaaaatttatattagtactacctccgtcccaaaataagtgcagacatgagtttccgcgcccaactttgatcgtctgtcttatttgaaatttttttataattaacaattttgttgttataagatgataaaatatgaatagtactttactcgtgacttatgtttttattttttttttcaaatttttttcaaataagacgaatggtcaaagttgggcgctgaaaattatggctacacttattttgggacagagggagtagttcactacaagtccaatctgccaaaaggttacatcaacatgttatgtgtgaatagcgaccagagttgagttgtgggactggggacaatcagaagacgggggcgtctaagtgtctactccctccgttcctacaatataaaggattttgagtttttgcttgtaacgtttgaccattcgtcttattctatttttttttcaaatataaaaaacgaaaagttgtgcttaaagtactgtggataataaagtaagtcacaaataaaataaataataatttcaaaattttttgaataaaacgagtggtcaaacgttacaagcaaaaaaaactttaaatcccttatattatgggacggagggagtaactattagccatgtttagatttggtgtttaactattagtcactcatatataaataacagctctcatgtgtctttgacataggggtccagtgacaagtgacagatagttaattgtcacaaagtggtaaatatttaaatctctcccagaaaagggctggagagaggtgatccgtccgcccatgggctgctataaaaagagtgacggcccatctagtgggaagattgggccctccaatctaacgtcggttcccaccgcgtaaacggcccagatctcacgccagcccggcccgcctgcgcccgca

SEQ ID NO: 47058 - DNA, 3065 bp, Oryza sativa
tgtccccgccgccatcgcgctttgagattcgtgcgactgacgttggaggcccgtacgtggcgcggatcgaggggaatcgcccccccccccggtccctggctggactccacctctccgcgacgcgctcctctcctggcgaattttttgtttatttatatttgggagtaattggctgcgctcagctccggtccagcgcccggcgaattccaccgttagcgtcgctagggtttcggtggcctgcgcgcccggcggtgggggggggggggtctggcggtctagggtttgcggccgcggcttgcgccgtcgcggcgcggaggcgtcctcgtcgttgttgttggtggggcggtggcggaagccatgggcgacggcgagcgccgcgaggacgagaacccgaccaccagtgccgcaggtaagctcgattccacggagcttgttgccttttggtttggtttctgtggtcccgcgacgcgagcttcgatccccgggtgggactgtctagggttgtgaattgctgcgacgaggaggcagggttttgatgcgattcggtccgcgcgcttgtgtacttttgtgttttttctgtggccaggcttacacattacgctgtaaattcggtgcctggtaatgaaggttggatttgatgagctgcagatttgctgtctggtgtcctatatatatatgattagatgatcatttttttttgaaagtttaggaggggtttggacaaaagctgtttctttcagcaagctccccgtgctgtcttatcaattgtcatgaactttctaagccctgaaggaataccagcatgctagtatcttttactatataaatagttatgtattctttccgttttgaattgtgactggatagccaaccaatctgggtaaaacgagatgcccaagatcatgcaactattgccacaactgattactatatatatatattcattttagagagcagaattccatgtccagttgtactccagtttcctcatctaaatatggaattcataatacatatagtaatgatgaattaaaaaagatcctttagctggataagggcatactttagccaagtgaattttcaatgcagcatgcatggtgctcattcctgtgtctactagggaagtgaagctgtagaatgaaacaacggactgtctaagattctcaattgccaaaagatcacatgaaccctctgagaatcgtttatggctgcaaagcaacattcttctgtttatacatgttgcattacaagagtttagcatcattctgcgagccttttttatcagtctttctaagttccgaatttgactttgttgatgagatgtcaattctttaaaatctgaattcataataacaccatctgtttttgtggacaataattttaggatgtgagttgcagtgtggggatggacaaaattgcttttaagttttaattgttttgtccttttcttctacaatctggattattgatttgccataataattgatgagtgttgattagacttgatcaattagtactgagttaattgatccaaccagttatgctgttgctatttttgttatcctttgcagatgacgatgatgatgaggattatgatgaacctggtggagggaatcacttcttgggcttcatgttcggcaatgttgatgattctggtgacttggatgctgactatctcgacgaggtagttgaacaatttttgaaatggtggaatatcctttttttgttacatgtttttttaataaaaaaatatcatgctgcctctagcagatatactgcagaatatgcatgttagttagcatttctgtgtggataccctgtgatttctcctagatgatatagtccagtaaagaacttgttaggtgggaggcaattttttatttgccactgaatgattcacacaattcctttacactgagatgtggacagagtgtgcaaattaaaggattgggtaaatttacagcagtgtaggaggaatatatgcaaaataaaaagtttgctcaatgtaatattgatgtactccctccgtcccaaattataaggcctatatttttttacacggtctacaatgacatactctgaccattaatttatttcatattatgttatcaaacaactataaaataagtatcacaataaagtattttaaaatacaaatataatgatataacatgcatcatacttagcatagatatagctagtgtaattattagtcaaaatttattgagtttgattttccttgatacaaggacgccctataatttgggacgtagggattattgttttggcagtatggatgtagtcctttcatctcaccactcaccatcataagttaatttcttggcactacagcagcatggacctacctctaatggcggtccattcactacattttatttaacatgagtcctttatttttttccctgaacatttaacttttatatatttttctaattagagttaccaatttcttgataggatccaacataagtactgagcatcttataccccacaaactaataatgtgtcagtattgattttgttaccacacgtccacaccattggatagagttagtattgtatacaatgaaataagttatagccgcatttctgttgtatcacttctattttccttgatttaccaggatgcaaaggagcacctttttgcactggcggacaagcttggcccatctttgaaagacattgatgtatgctatcttataatcattgttaagttaatttgacttatattttccttgtcaaacaagttaatactgtcgttttcttatatagctgatcaagccttctgcagcaccaactgatccttctgagcaaggtaaatcgcaagttcgtaactctataatgcatatttttattgtttcttcgcctaaccctgtttataacaattcattattttctgccctttctggcagctccagtttctgttctataccaaatcatataaaataattgatgcctgatccttttactgtcctgtagactatgatgcaaaagcagaagatgctgttgattatgaagatattgatgaagaatatgatggacct

SEQ ID NO: 47059 - DNA, 1580 bp, Oryza sativa
taagcggcacagaggaggagaggtacttgttctcaaccctgtgttaataggatatgcattgttttagcaatgttggtatgttagacctttttgtaattccgccaccagagatacctgtttctgcaacttattgtttgtagaaattgagaaagggcaaaataattgtatgatagcctttcaaccagcgtcgtgcttggttttgttattcacctttagagagttgggactagtttttctcaactaaactgtcccattgtgttgtgcgttctcaacaaaatagtttgttttgatcaatattcagtttgatcatccccgtcaacatcatcatctttattaattctcttttggcacgttcatctttagttttttaacatatagacacccgcattttgctacaagggatgtgatacccatttgtgagatataggtcggataatgcagataatccattgttgttttttttgcaagactatgaatttaaacttaatttatttgtttgcatactgatgcaggttgagctctccaacatattggaaaaaatagttgaccacttgcggacaatgagctgttcattccttttccgtaaaccggtgacgaagaaagaggctcctgattactttgacataattgagcgtccaatggatcttggtactataagggacaaggtgcgaaagatggagtataaaaatagggaggattttaggcatgatgtggctcagatagcactgaatgcacatacatacaatcttaaccgccatccccacatccctccgcttgctgatgagctcttggagttgtgtgattatcttcttgaggaaagcgcggatgtgctagatgatgcggaatacgcgatcgaggactagtgcacactaaccagatatggcatttagatcttgctatattctaacttagatgctgtaatgctgacctgtaggaggggggaagagcacctgtagaatttttcattttaggctctggctatggtatacctgggatccccaattccaactattttgcctcttgttggtattgggagttgggagttggaatgtacacaaactctaggttagacattgagggcccactgtaactattggcctcttgctgtaaaaatgtagcgatgtaattttttgtccatatccatggccttgggtgtctcaaattctgatgttgtagcattacatcctatgtgaatggcatctaaccatgagtcaaaggtgcaacacgtcaaagcatgtgctaaaggttgtacccggtctaacctgattggtgaaggtcccttcaaatcctgcatgattagaggcttaccatgcaactatgcgaagtcaaaacctgtaattgtaactgtaacgtgagagatggtgtaccggcagtacaagttgtttgagttgctgccagatgatgatgtatttgatgttgcatgctttgaatgagtattcaccgctcaacgatatcattggatggtgcagttcatagtttcatacctttggtttttggtttgtgatgttgtagcaacagaacaacaagtaatcatccattaaacaatcaagtccctttctcctacttgctgaatgtactga

SEQ ID NO: 47060 - DNA, 12752 bp, Oryza sativa
aatggcagtagtagacgaagaccggcaagtccttgggcttaaatctcacgagcatatgaccaattgaccatatctatgcacgcgacaaccaaaacattacaattccacgagtccgcgacctgttctactcacgtcaccccgcatccctgatcaaacaaagcatttgctcgggagcttgagctcgagctccgtaggccggagcagccatggtgtcgtcgtcgtcgtcgtcgcctcgccggcgagctctcctcctgctgttcgtcttcgcgtcgtcgttctttgccagcgctgcaggtgagagggttcttgagtagttttgtttctttgatgaaatggaaggcgtggagattgatcgatcgatcgatggtggcgtgccgtgtttgcagcggcggtgtcgcggacgaactcgtcgtcggcgttcgtgctggcggcggcgcagacgcggcggaaggatccactccgcgggctgaggtactacaccggcggctggaacatcagcgacaagcactacctcgccgtgagctcctcatttccgtgataaatttcagctcgcaatgcgatcaccttggtgttctactgttcttcctgcctggttcttgatgctgacgccgtcgagttttgctatgcttgtcgccgcgcgcgcgcagtcggtcgggttcagcgcggcgccggtgttcgttgtcgcggccgtctggttcgcctccctcgcgctcgccgcgttcgtcgcctgctgctgccgctgctgctgctctggcgccggcggcggcaacggcaacggcggttactcctactcccgcgccatcttcgccgtctccctcgcgctcctcctcgtcttcaccgccgtcgccatgtaaaaccatttctcctctccaagccatttcatattacaaagtacaaaactgttcagattttttttctagtataagtttgatcaaatttatacaaaaagtttagcaacatctgcttcattaaaactagcattaaatatatttgttttgcattagaaatgatactatatctctttataaatttagtcaaatctaaatatattttgataatatatttgtttgtggaaatgctactatatctttttataaatttagttaaatttaaataagtttgataaataaaatcaaaacgacctataatacgaaacggacggagtaatttctaattttggacgccgccgccgtcgctgtgggtgcagaatcgggtgcatcgtgctgtacgacgggcaggggaagttccacgggagcacgacggcgacgctgcggttcgtcgtcaaccagtcggacggcgcggtggcgagcctgcgcggcttcagcggtttcatcgaggcggcgaaggcggccgccgtggagaaggccaccctccccgccgacctccaggggaaggtcgacgacgtcgtgcgccgggtggacgcctccgccgacgacctcgccgcgcgcaccaccactaactcccgcaagatccgcaccgcgctggagaccatgtatgtgtgagattttcttggtggacgccatgacctcgtcacttccatcatcaagaagatctcgtttgacattctgtttgccttcttctcgtgatcgcagaaggacaatcctcatcgttgttgccgccgtgatgctggccttggcgtttcttgggcttggtgagcataaagatttctttgctggttttggtgaattttgtcaaattcgtttgtttctgtattcgagtaaataattgacaaattcttgttcgattttggtgcagtgttctccctgtgcgggctgaaatcactagtatacacgtaagtacaacatcacagaacgtacatagacttgtatatagtacaaaatttttttttactgcaagtttgtaaccttcagttcttctgcagcttggtgatttttggatggattctagttactgcaacattcatactgtccggcacttttcttctcttgcacaagtaagttgttctcccttgttactgtcttgttaaatatattgcttgattaaatataatttgaaaaaaaggtgagattttgatattctaaaatggattgagtaaatttagtcggcaaaaaaaaacaaatttactgaagtggaatattctgcttctgaaaagttaaaatttttttgtatgaaccagacgtactggaacactttgcatctcagtctttacattgactagttacatgcttgtatgttataatgggtcaaccccatataattaggggtagattaggagtcggtatgtcggtgtgttaataggctaggtctatataattagagataaatgatactctttcggttctaaaatatagtaacttttagtttttagaattcgtttcaaaatataacaacttcttcattaacattctcttctcaaccaatcacaatactccaccgttcaattttcccacataccttcatttcttctccaatcacaacacttctccatttagttctatcaactttcttaataactacgtctaacttttaaaatatttatattctgaaacgtagggggagtattacttttcacgtacgcactgaacacgttaggacggtgggatgagaggagaacgactatattttaagatagcagatatcagttaaatctgaatcattaagacactaacacgagctctgctctgcttcgtcgtgctcgcagcgcggtgggcgacacgtgcgtggccatggacgagtgggtgctccacccgcagggccacacggcgctcgacgacatcctcccctgcgtcgacgccgccgcgacgtcggacgcgctccgccggagcaaggaggtcaactaccagatcgtctccgtgctcaacaacctcctcgccaccgtcgccaacgccaacgtccccgcgtcgtcgccgccgtcgccgccggccagctaccgccagtccgggacccccgtgccgctcctctgcaacccctacaacggcgacctctccgaccgcgcctgcgccgccggcgaggtcgccgccgccgacgcgccgcgggcgtggcggggctacgtgtgccgcgccacgggggcggcgccgtcgtcggaggtgtgcgccaccaccggccgcctcacgccgacgatgtacgaccagatggtcgccgccgccaacgccagcgccgggctgacccagtacggccccgtcctcgccgacctcgccgactgctcgtacgtgcggcgcgcgttccaggcggtgacggcggcgcactgcccggggctgcggcggcacagcggcagggtgtaccaggcgctgctcgccgtgtccgtcgccgtggcggccgccgtggccgcgtgggtggcgcactcacaggagcggcggcggcggagcgagacgaggcggttccaggtgtcgccgtacaggttccccatcgaggagaagtcgctgctcaagagcccccggcggccgtaccggcgaggcgacagcggcaggatggcgaggtagaagaagacatcgccatggatggatggatggatggtacagtgtcgaacaccttgggacgctgccacgcgtgttgagcagtttaggatgtgtttagtgcttcgatgattattatattgtactgattaatgatctccatcgaccatacaggttatacattgtacagcttgaaatgatttcgtgaaagaagtgtgtagtttgagaaaatgcaatatcgtgctcgcccacgtcgagaagcactgcctctttggtttctaacatttcgccgatcctattcattagccctagacaacaaaacacaacagggtatccgattgatctggcgcccattgcgatgatcggaaagcagcacaccatggatcacacgtagaattgaatcattagcccaaaacatcgcaaaaactacgggaatcagcaacaaaaaataaaaagaatgcagacgtgaactatggatagtggcaaatgatctccacctaaaaaataaaaaataaaaaataaaggcgtcctctcctcgcagtcgtgccgcggaagattggaccggatcatggcggcggcggccgccggagacggcctcagaaactgcaggacccacacatcaaaaccctatcgccggcagcaggggacaccacgcgtcgagatcgatcgagaccaactcgcacccgaaaaatggcgaaagagaatcaaacagaagcagagagctcaaaatcgaacgcacatggcgacggcacttcgccgatcgccaccgccgcgcggtcctatacggagagcccgctcgatcggccgccggaaacctaaccccgcccccgttcgcgcgctcccatggagatggcggaggagaaggggaaagcttctccagatcgaggaaggcggcggtggaggtgcgaaaatttggactcgactgacttgtgggcctcgagcttttcggcgttctcgccaaatggcgtgggctctattgctttggatcaatctagacgtgggccgtagctggcaggacttggcccttttcgcgttcgtgtgatcacgggacaacgctgggctcgttgacgaaagacgggaaacccgtgacattcgggcctgttttttaagagctccaactcctaaattttgtttcaggagagttgggttttggagtgaaattgtggagcaggtctatactctactctatctctctagcttattttatgataacactctacccagtttcgcttagaaaaggtgggagctagagctggagttgtgctaaatagacccttcccatgtcagactcttagcaactcctctctttgtcttcgaatataacaacataatttgttccaaaatataataacttctccgtcaacatttttttctcaaccaattataacacttcaccattcaatttttcacctacatccacttcttaatcaatcataatcttttatcatttaactctaactactttcttaatgaccgtttcgaactttaaaaattcttacattcttggacggggtaataccgttttttttcagtagctttctctttacataatataataatgatagatataacgatttctttatccttttaattaatggtatgcctgaaaatgcgtagcaaccgtagcattttataagaagaaaaaaatgcattgctttttagggggaagggaaacgaacattcgtggtaatgtacgctcaacacgcatgtaaactggacggcaggatgcatcatagcggcaaaggcggcatgcagcagcagcagctagggccctttgtggatgaaagaaatgaaaaccccaacccccacccatatccaggagatgtagcgagcatggataatctgataatgctagaggccagattagggaccttaattagggacgggccttccaccataaattaatacatgtgtcgctcaatagttgacggaaatgcagctgtacgttaggagtatatataacatatccacaaccacagacaccataacactccatatttctccatctcatgagacaagaccggccacttgtactagtaaccaggttccataattcttcttgacgctttaaatagtaacacgatcttcgaaatatgtgtttaaatatatttttctattataatatatatataataaattaatacgtttttatttttattataatactcataagataaagagtgaattgtactttaagccacttttgtttacctaagtttcatttaatttggatcaccctctatctaatcttctcactttgaactagttttattttttttaccatttttcattttggactgtgcaaactctcttcgcgagcacaacaacagaatcaaacacactctcatggcaacaatattccctatttacgtgcaattcacatctttattaaatgagaggtttgatgttgctatacaaaagtgttagggtggtctaccgtaaaaaaaaaataaccattcaaaaaaaaatggtggtctaaagcacaacaaaggtaaaataaccaagcctaatgtgaaaagattggatagagggtaatccaaaataaaacttaggtaataaaaggtgattcaaaatgcagtttaccctaagatgataaatctatatatgatattggtttagtgcctttaataaactaaactagctgtgtggcccgcgcaattgcgcggctagcacctaaacaaaatcatatatttttagtatgattttacttaaaatttattaaatagctatctcattgtcttaagagtttgaaagaccaaaccttatcattcccgtgtttctaattatatagttttttaaaagtcacaccagttgctaccccttatgacatctccttctttatttgcttgttcgatctaccactatttctattcattcttcttggaacctttaaaaattggatcttatagtttttagagttttttttgtcacgttgggtttcgtttttataatttttaggcgtcccgtcaaacgttgctattatactcctctatggtccgtccactatctcttctctttattgtcattgagattttaaaaatcgaacataattattgtttgggttcatttttactttctagaagtcccgccaaaccgtcagcggctttgccattgtatttctctacggctcgcccgctgtctcccttctttattatcattgagattttaaaatcaaacatgattatcattgttttttttactttttagaagttccgaacctttaaaaattgaaccttgtagtttttagagtatattgtcttgttgggttttattttttataatttttagaagtctcgtcacacgatgccactatgctcctctatggcccgtatgccgcctactctttattgtcattgtgattttaaaaattgaacataactatcgttggaattcattttttatttcctagaagtcccgtcaaccgttggcggctctgcaactatactcctgtacaccccgcccactgcttctcctttttattatcattgagattttaaaaatcgaatatgattatcattggggtttttttttttactttttagaagtcccagcaatcaccttgttcgtttgcttcacggcctttctaccgtcccttgttttaatcgttattagtattctatttggtgttttattaacagtttttatatgttgtatcaaccgccaccactctactctattataggcctgttacttaatttatctcgtcatgtcttttagatggtcttttctttcaatagtctttatttttatcataaactttagctatttataaattgtattccaaattgaaaacttatttttcattttgtaattttagaatttttttttcaaattttaattaatatcgtattgtgttcttttaatatttttattttttattttcaagagaaaagcccgtgcgctgcaacgggtgacaactattttagtcttaattcactgtgagaattcgcttggatctatatatttctataaaatcataagctgtggttaggagtctgtttgtctaaagtcagcatgcgaatttttttatacgactcctatatttccaaaagcggacgaacttaaaaatcaactcaaaggatatatattttttcaaaagcgaacaaatttataaaccgactcatacacggatgacataccaaaataccgacaaaagaacatcttaaattttttataatagtagaggtttcttttaaaaaaatagtagaagtagaagagaagagaagattacggacaaaaagtcctttttcgaggcaatcgtacaggaatcggacctttttatttttttatacggtagaagtttttttttctcttttttttattttttcttgcctttttttctccacagatagtcggactttttttatggagtcggacgtttttttttacatagaagttctttttctcctttttttctgtttttttataccggcaaaaacatcttcaatttttaatagtacagatttcagttgtttcaaaattgtattcctacttgaactctcttttaatttttctaattttggatattatttattttttattctgaattttaattaatcacatattgggttcttatgtggattcttctttcaatattattttttttaattccgaatttcagctaattttaaattgtactcctatttgaactcttttttttttttgctaatttcggattttatttttatttttattcccaattttaattaatctcgtattgtgttcttatatggactcttcttttaatatttcatatttttaattccgaattttagctattttaaaattgtattcctacttggactatccttttttttttaattttagattttattttatttttatttcgaattttgattaatctctcgtattgggtttcttatatggaaacttcttttaatattgcttatttttaatttcgaatttcagctatttttaaactgtatttctacttggactctatttttttttctaatttcggattttattttattttttattttgaattttgattaatctcgtattgggttcttatatggactcttatttaaatattgcttatttttaattttgaatttcagctatttttagattgtatttctacttggtctttccttttcttttttttttctttttcttcgattaatgtaggaatttctagcccctacagcgaacgtggtgcctcctttcaaagttgttttaataatataatagatagatagatagatagatagatatagatatagatagatagatagttattgatagttgaaattataaaaaggtatcttaactttatttaaatcgtaaacaattatggaaccggaggaagtacgtccggtgggctagccgtgtgggccggggccgggccgccggccagcgttcgcgacagcaagtgcgcgggcgcaatgatcctctgggaagccaccgcgcgcgacgcccccgccttaattttgacgcgcctacgcacaatacaacacgtacgccgccgaagccgtacgtcgcgcgactctcgcggcacgcaagtctcgctcgcgcgcgggttgttggtagatgcgcatgggtggcaggatttggcgctgatcgatcactcgaaacacgggggctcacggtgcgcgacgcgtacctgcagctataagctagccacgggcacggaccttaggtgtgtgggtgggagacgacaggacaggcacgctagtaggcttaattcatctcacgcgtcatcgcttgactgcatgcgccaagtgaggggccttcagagcttgtactgctatcatgaaaaattctaaggaaaaattagaccgtctttagttcacccccaactacctaaaactttcaacttttcatcacatcacatcacatccaaaactttcctacacacataaatttccaacttttttttttaaactttcaactttccccaaacttctaacttttttcaggaactaaacacagccttaataacattcatacaaaatgtacatatcagttcgtagcattttagtacaaactcaactcacacgttgagatacacagattttttttatttcttaatgtgtaggtcaaatttaaacttgatttttagtggagtgctaaatacaactatactctatattatcttcttttaaaaaaattaagtttgtaacattatttacattggatttaaaagaagaaaaatacatgaatgacggaatccactatttttttttgcggggaaaagggaatatattactcctcacaatcaatgtgtgagatgaaattacaactattcttaggccaaaatttagacatagactcacatcgtgccttatttgctaaggtatggcttacacgattttggttacgatggcccttgacaattctaatctccctatttccagctaacaagtctttcacctctcggacaagaaaagccaggtctgatttatccttttcctgtgatttgatcatgtgaatagccaccaggcaataagtttctacgatcaacggccaaagagtccattgcaaagccagagctattccactaccctttaatatacgatcatacaaaagtcgcaacctatatgtgttgttaacatttactaacactagtacgtagcactagggtgctgtttgactctcgaattctactagtatcttttattattctgtttagagtatatatagcctcgagaaaatagtacaaagtactacgcaattttcagaattatgaaactcagaaaggtaagatctttttcagacatcacgcatacaaaaacaagcttgcagtagagcggtagtagcatttgtttgacgcagctaggatcaccctaagattccaaccactccctgtttaccaccacacacaaactttgtttactgcacacttaattgcccttttacccatgcctaatgacctaatcttgtgacctttttgaacgctcatagccgagctatagctacaagacagacaagaaaaaggtccacatggagagattccaaagacttgctcagtttaaatttctccccctatacatgctactccataaatcccaaaatataaaaaaattaagttgaatttgacaaatcctaaaaccatgagtctatacagtctcttgagatatactccctccggactgataatacttgtcgttttgaataagggtgaggtcaaactttagaatatttgattatcaatcatttttaaaatatttatctttcaaatatggtgactacatgtatagattagtcttaaaatgtattttaataagatcatatatttgttaatatttttatacatattataatagaaaataatggccgaagttttttttttttgagactatgccattgtccaaaacgataattattatcaacccggagggagtagtactaggatggtataataatactgtagtagtatcagcaaataatactacatcctttcatgtaatttatggcctctctctgtgattttattactgccaatccgacgtgaacgtgtagtaacagcaacagtagtaacaaacatgcagtccctaccatcttctgaacctgccacactttgtcaccgctttattcgcgtcctttcagcatttacgtatgctacctgaccataccatgccatgcgtggtccacataacacatcggccatcatcctgcctccatatcgactctcaagtagtgacattattacaaccaaaaagaaaagaaaagaaaatctcaactgaatagatgagattaatttaggtcttaaatgaaaccatcacgaacttgaaccataaaggccaatgcaactaatgcaagtgctcatttaattaacaaatactcctactaacaaacatctctgcactgatacgcggtagaagcgaaagccatcagatatcgtatagtactcccctttttgcaggggcatgcatgtgatgagcgatttgcatcggatcaggctgacagctttggcgtttttgtgtctccttttggcttaagatctactacttctacacctcgatcgatcgctgctgtccagtgtaccagagttcaaatggcctatttgagaaaggttacagtgtaacaaagtttaaatgacctatttaagatagtctaaaattctgagaagttgcttgttagtaactactccctccgtttcacaatgtaagtcattctagcatttcccacattcatattaatgttagtaaatctatatagatttatacgtttagattcattaatgtcaatatgaatgtgaaaaatgctagaataacttacattgtgaaacggagtaagtagttctttttgtcaaaatctgcgtgaaaagttagattgtttggtgaagtttctgattatgtaagaagccgcaggcctgcacctaacagaggctccccgaaaccggtccaaagacccaaacggttgtgttggatcttgtagtcttgtcaagaaaccggccaagccccatgaaactccaaatagtataaaaaaaaagtcaagatttgccttaaagatataaatacgagcccaatttatttagtagctgccattgcaacgatgtgcagtaataaactagtaatagtagtatagcatgtgagccgagccgtgcagctgcagctgcatgcttcttcctccttcgctatatatgcagctgagctgcacacacgatgagcagtagtagtagtagtataatttggtagtagtgagcaagtgaaactgcaagtgagctaaggtgcaagaagagagaggtggagatggattggtacgcgtggctggcgaagaccgggttggcgccggcgctggcgtacgagtacggccgcctcttcaaccagaacgagctggagcgcggcgacgccgcgcacttcgaccacgacctcctcaagagcatgggcatcgccgtcgccaagcaccgcctcgagatcctcaagctcgccaagaaggactcctcctccgccgccgacgcaggcggtggcgactcctcgtcgtcgtcgtacgcgcagctgatcgcgcgcaaggccgggaggtgcatcgcgcggtgcgcgcggcggctggcgcgaccgcggggtgtcggtggagggagggggtcgtcggtgaccgtggtgccgaggatatgcagcggcgacgacgccgtccgcgtgggggcagtgcaggcggcggcgacgaggaggaggaggagcgtcaagaagatggtgctcatgatcaccgacggcggcgccaccgccgcgaggggcggcgtcggcttcgccgccggccggttctcggggtcgcagaaggcgagcctgatgttccacgactgctacgaggaggaggacgacgactacgaccacgaggaggaagcgcggtgcggcgacggagccgagggcggcgacgaggatg

SEQ ID NO: 47061 - DNA, 1366 bp, Oryza sativa
  unsure (1)..(1366): unsure at all n locations
tttcccctcataagtgaaggtgaatggagggaacatgctctcgttcgatatcgtcatcggcatgaccatttctgtgcaggcctgcaagagaagttgcttcagaaaacacaactagtatctatctcagtattgtcagtggcattgtatcaatcacctgccatccccaaccactgaggccatgggggtcttctccatcctctaactggaagcatgtttgatctcctgtgtaattgtagtacagactcgccgctgcgaaagctttgtcaacgatgtctgctcctgcagggaagccgtggatgatcttgcacatctgtagaaatttcatgagaaatttactgagaactgaaattccctgggaattatatgttcagtgagacagaagaacaggcatggtttctgctcagctcagtttggtgtttctgacacaatcttggttatgcatttggttgaaatgtagagaggagatttggacattgtttgcagaacataggtagagatggcaacctccttgataggataggcaggcagattcatcaggaaattggccggggttggatagtccaccatggctgtgtacacaaatgctgtccatagccagtttctgaacgagtaaaccgatttcacagtcctaaaatttgagggaggaaaaaggcaatattgtgaactcaggttagtgtaaatccaatcaatgtcattcttcatctattcagaagttgggaagatgacctttaatcaaagaatgatcatggctgtcatatatataactgataaggtctatgtcatttttttacataaacctgttctgtctggtatcttatctatcaatatattaggcaatccttattgccttcttaaaaatggataagttttatgccacctgtaaatttatatagtttcttacacatcacgacaatgaagcataattacttgaatttgtgtgtgtatattatccttttctgaatctgcatgctatttttcttttcttggtattgtttggttgatcacttgcactgcacacatctggaatataataattacaatgatctcaattttctgttttcctttatatctaataagactataagacgtggataaaattttggatattcgtggcacgtttttcaaactactaaatggtgcgtttcgtgcgaaaactttctatatgaaagttgctctaaaatatcatattaatctattttttaagtttgtagtaattaaaactcaattaatcatatgttaataccacctcgttttacgtaaaacacttaatcttatttttcatctttatctttaggagaaaagaacaccacctaggtagtgtattaaaccagcaataaacttacttgcangctctgaagttttgctg

SEQ ID NO: 47062 - DNA, 914 bp, Oryza sativa
caatactatgatcagggctcattttgaactaagggttttaaaacatttttgtaggatttcatataaagtatttagctttcgaagaaaatacttgtgttctaaacgagcccttatttggtacttcctccgtcccataaaaaaccaatctagtactattttgcatatactattttgcgtggaataccatgaattgtggctaatgttacttgagtggcttgatggatcaattccctgatgtgcttgccatttggatcgaccttgtcagcaaacaagtacatgaaagtgaagggtgttatcgatcgaagcctccaatctagcgcatcaaggactagaagctccatccgaaaaattgtccgatgctcaaatatgtatcttgcatcctccatctgtaaatgtacaacaatgtgcatgtatgcatgttgtaagaaagtattttcgtaaaggaagtactatcagaccctaggatgaattaatattgacagaaacaatgcaaatataccataaatggaacaaatatttggttaagagcacttaggccacctttggaacacaagaatcgtaaacggcaggaatagaagaaaaaggattttggtagaaatgcatatgcaaaatagagaaatagaaaacacatgatgaatggttatttggaaagaccataagaaatgcacaagaattgaatgagagagatagactcaaataaatttttcacgaggttgaatcccatgctaacttttctccaacatcttcatggattgagccattaaaaaaatcatagatccagtcctttgtttaaaggaccatttttttaaaaaataactataggattaaaatcctaaaaagaattcttcattttcctttgttccaaagaggatttaattgagatcaaaacatcaatgtgattgagtgattggttt

SEQ ID NO: 47063 - DNA, 1313 bp, Oryza sativa
ttaggggggcttgtttgcaaaactgggtgcatgaaactcagtgaagtgtgctctaagcattgaagtcactcatgtattatgttcttgttaacaacgaaatattgcatcagattcggattagaagaagaaagattgaggtggatttggtgtggaatcgagttgatctccaagttaggctacgcatcggctaagtatcgtatcggctgaagaccggacaaaatcttgacttggttgatatagcaagcagacgatacggtacaacttgggcttggtttgggcctagatttagataaccgtcatttccaataatagatagagcccaattaaggcaattgtatctatttattagattagtttaagtcgtttgtgactaattttgataagagaccactgtatatggtcttgtttatattttatctttagaaaagtttgagtcatatccataatggactaagtttgtactcagggtataaatatagacctcagagctctatagtacggaagacaatccaatacaacttcgatgcatcgccaccctttttattcttattttcggcgagttctctcgacaagaggtaacccgtctcgatgtcttgtgctatcagcgctattatgtcgttttagatgtttagtccttttatcatgaccatctgttatcatatgtcttagttaatatagtcttagtatctcaatttagccttattggttggttttcgctttaggattcctaccggtatcggctaaattgccttactagattagattagctaaggtatttaccatcttgaaaaatggttaattcctagattgtttagactttaggtttctttacttactttgacatgcatcatctctagtcttatctagaaacctaaaaactaacctggaattaatcaaaattagatatagcatcagagtttcagccaatattatctaatatacatgcttctttattggttttatgtatatttgccacttatatagacagatcatcccataaaatcatatcaagttagatcagtatcggttgggctatttgaattactagctgatcatgatttgatatgtccaaatagattgatttggttatataagtttgcactaaagtattagctagtactttatcattatttatatattcttctctacatattgttccattggctattttaaaaatattgtcttaaacttctttatcaaacctagtaggcattattatagccgattaggcatgtttagggtcttttgttcattgatctatccagtcaatagccgatttggtctaactacatggattgagaccgatacgttat

SEQ ID NO: 47064 - DNA, 2015 bp, Oryza sativa
  unsure (1)..(2015): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgcggcggcggcggcggccgcggcgaggagctggccgatgctgcggcggctctggaggaaggcggtggtggcgcccgtgctctggctctaccacctcggggaggacatcatcttctacggcttcctggcggcgatgatggcggcgaacctcggcggcatcgtgcccgagatcctcggccgctgggcctgcggcgagggctccgccgtgtcggccgctggcgaggaggtcctcgcgagctccaagttcatcatagtgcgcttcctcccggctttcgtcgtccagctcttcgtgcgcatcctcgcccgcgcccggttcgaagccagggaggcgaagaaggagaaggagaagagggagaacaacgagaaggtagttgattcttatcactcctaaaattttcttcacttgttgtattgagtggctagctagatctgtgaataccattgtacaattggtggaatttttgctcggtcatgtttgggaattgggacgacgccataatctagtcgtcaattttcgctttttatttcactcgttgaacctgatatgacaatattttctcagttgtgtgcaatttgtattttgtatttatatggctacatagcagttcattgttcatgacttcatgtgcagtaatagcccctttttcctgttcgtaatagaaatctagtctctcataccaatctgtgccccacttaacgatttgtttgttcttgtgattgcgaatcctgatagcagacaagctcgaccgccatcagggttgaatcatctaaggaacaacgtccagaaagtcgaggagcacggcgctgggggcccaaaggcttcatgccatatgcaatctacctagcccctcctttgattcaactttcttgtcttggcattaagatgaaagcccatcatgaggaaggatctcttgaatggagggtgggctatgtgcttgatgactttgcgaggttcacttctgctattttgatttcgtttgttggtgtcccaagcatgctgctcacagcgatgattcccaaggtgaaggatgatgacacttcgtcgcagtgaactgttgaaggtacccactctttcattttttaccataatgtatgctttccttgtgatcaaagtgtatctatgcttgaatgttcacagtggtaattataattaagaattcaaaattgttgttcacacattcaattagtctttgttgtttgtccggtggttctatgtctaccatagtttagttaatcaatgtgaaattgaatttgaccccccctcccccccccccccaaaaaaaaaaccaaaaaaaaaaaggtttcctcttgtgaagcaccattttggacttattttgctttatgtcacttattttgaattgatgccggagctctttgttgtaactcaattacttgaaaacatgtggtcttagaaaatgtacttgatttgttcacaatattaataagtttgctaatgtttgaccttgcaatattattctcaaaaggcagattaaattcattaaaattcggtgggcaattaagtagaagatccatataaagtgttgttgaactagtcattatatagaagcatgggtctgaccaatatatcataatttattcacttctactcgtgtatggaatattcaaaattttcaaattgtgcaagtgcaacaatgaaaaaggagttaaggttccagtcttaagtatcaggggggtgcaggaat

SEQ ID NO: 47065 - DNA, 6746 bp, Oryza sativa
  unsure (1)..(6746): unsure at all n locations
ttcctgcaccccggcaattgctatttgtctacctgcacctcaatgggaaaaaaaaatgcagttttaccccttgctcgattgctcctgcttttttagtgatttcacttcagtgcctgttcgattgataagttcatactaatctgtgcagataattagatatatccaagttctgtttctacttggatggttctatcatgtaggatatgctcagctgaatttgtgagatgagcacagagacttttgagttagcattttgtttgtgtgcttgtacatggtttgcccattgatgtctcaggtctaacagaatttactcactgggttgctgcattctgtctaagaatggacatgatataacaattaagagatgtctctatttttagaagacaaaattgacatgactacattcgattttgatctgcttttaacattttacgatagatgtgtttctgttgtttccaactgtttgtttgttttcttattcttttatggaaaaattctgatatattcttcattggcagtttcaggggttgctggtggtacctgactgctgagtaacaggatggttttttggccgagtaattaacaagatcgtgatgcaactactgttaattggactagtggagtccagtttcgtttgccctttctgtgttctgaaccactctggcatgtcatacaattctgaaccgctcttggcatgtcatataattctgaaccgctcttggcatgtcacataattctgaaccgctcttggcatgtcatgtaactcacctagcaatcgactagcgtactggtaggctttcttgttcatgtcacttgaatttctggaaatattgttaatctggcatgaacacgtgatcgatgtcgtggatgcctgctctcatattgcacggctgcagagtttatcctcagagcactgcatttgtgatagtggccgataagatttgaacatctctttctgcattgagcttagagtattttcagatattctacttcctgctgtgcttgattctgactgctaagcaaagcagcttgcagttaaacaattcagacatgtatctgaacttgcattggtacattacattacatggcattggctcattgctttcatcaatgcctggcaatagtggtttcatggcagcatgagctgcatcgcgcgccgggaggcacatgcttttagcttcataggatgttctggtttaccagctgcacggtggttgtagtagtagagtacttccgccagtattatcggctatagaaacaatctaagccaagccactgatttatcagttctattatgtagggaaaaaaattattctatagtctatggttgaaatggtaatataattactgtagtttattagatgataaaagattaaaaggtctgtatttactgtgctaccagttgaatctaccgtaaaaattgtccttccaagttaggccaagctaggtcctcttttagatatacgagttctttgtgttttcttaaaaaaaaaaaactgaggtcccatgtcaacatgtagaacaaattaacgagaaacaatttgctttccacgagaatcagggaaatattttgtaaatcaggattaaactattattatcaaatcctaaatcctaaatatccaacagattttgtatgttccaatggagaaggttaaaattggactgaaccatatagaacacttttcacacttctgaaggaaaaaaaatgggacaaaattggttgtatatgatgtcaaaatgatgagtaaattattgtgttcaaaattccccctctatgagtatagatcacaaacttaatgttccaattaaacgttgaaagtttcatagatttgacctttggaatatacaagttttgctgtattatgacaagaatcaattcaatatatcatgtagggtgataggtataatttcattgaagacaacacaaaattctttcattttagcacgatacaaatactcttttgtcatacaaatgtttgaaatagtttctcaaatgcgtagtataaaggaacaaatgacgtacatagatnttccttgaataataatatcataatgtcacaaacttatatgtttttaataaacttactttggtaaaaaaaatgatagtaaaagtaccaaaaagaaaagaccaactctttttttttttttgcggggaagaccaactcttattgttacattgctgggtacaaactgttttggtttaggttctacacttaacaagggtactcatatttaccgctaattatttttttaagtgcttgtaccaatctacatcaagatattcatggtaattttatcaatatcaaaatatgtcggcccggtatttcaaatgtgctcataaggataagatatgtgtgtatatgttcatagtgtgtgagtgcgcgcccattgtgagtgctacgtttgtatagtactcccttcgtcccaaaataaatataattttgtactgtttatgtccaacgtttaacctttcatcttatttgaaatttttttatgattactatttttatttttattagatgataaaacatgaatagtatttttatatgtgattcattttttaaaaaattttcataattttttcaactaagacgaacggtcaaacgctggatatgatatccatgactgcatttatcttgggacggaggtaatttcttcgtttcatattataagacattctagtatatgttaatgatatatgtgtgtctagatttattaacatctatatctatataaatgtatatgtctagattcattaacatatatatgaatgtggataatgttagaaagtcttgtaactgaatcggaggcagtaatatttaaaaaagttgatccccatttggatccgggctttaccggcacggacccgacccgacaaggcgcgacaacccgaccacatccgcattcaaagctgaagttaattcggtctctcgcgtccgccgccacacactctcactcactcactcccaactccgccatagctgcgagcgagcgagctagggtttggtctctctccatggaggcggccgggggagcagcgcgaggtttccggcgccgggtgccggagccggggtggtgggtcctgagggcggtggagaggtccctgcgccgccgcctctcccgcgccgtggccgcctggcttcccgccaccgtcgtcgtgggctgggtgaccgccgtcgccgggatcgcccccatcgtcgggcgctgggtcggcggcgaggtggggcgcgccatggaggtcgcgggcgtccacgtcgtcggcgccgggcagcacgtgttcatgctcctcgtggtccccatcgccgtgctgctaatggtgatgcagctgcgtctgcttgctgggccttctgatgggaggcagggggatggtatgccgcaaaaactaaaaaaaatttcttctcctatttttatgtattttgtttctctatttttgttgtttgactccctcagagctgagtaatatatataggaggcatcgtgtttaattatcctgatctttcaattccatttcagatgatgctttgattcctaccgttgttcatatgtgttagaatcaagaatgcatatatgtcgaccatagtccatagcagtgtttgaaatatcggttcgacatttcggagcacccccaaacccaaccccacccaccaacccaccaattaatggaactatttcgtccgaaaatttattttatttttaatttagtcaaaatttgttcaaatttcgttcgaaattttctcggaaatttctgtgcgccccagtgtaaatagcagatagtaattcttttctactcaatagtcagtcacgacatgtccccaaactttgttgctgtgttcatcctagatttagaggctggggatgtgatcatcttccttgtcattaaacaagaaagtcaccacgtcttctcagagccaattgcagcaaattctgaagttccatacataatctaaattttacttgcacatgatatagcagctttacgcttttacaaatcatgtgcttctggtttttgctgtattttttgaggtaccatggaacagcacttggcatcttttacatttgtaatcttagtggtgtttactgtgtggtggtcagagttcaagatcccagcagtgactggctggtcactggtcctaagccagtcggctggttaccattataccagccagaataatttggattcaaattttaaatttaattttgacattatgtcaagttgattttttccatacaaggttatttgttgttacattccaatatatagggaagaaagatgaaaatatatattgtaaaattgtatctattattaaagtagtttgtgaaggactatataacagattacagacttacagttatgatgcatatccctttatgcgattcccttatgatcattttgacataatgtgatccattaatatattatgtatattggatatacaaaaaattgcattctgtcacgccaaaattctctggccattaattaccggtaactagtttttgaatagtatttttgggggtagtggtatttttagtgaaaccaaattcaaaattttggttgcggttcggacagcagtaataaccatcagctatttggatcgaccaaaaacctttcctgcatcgttacataaatgaagtttgcaatatttgtttcttattaattatgtgttagaatgttctagagcctatgtattgtaaactaattctcttccatgcctactcaattatttgcatgtcatggtggttacaatagctggtaagaacaattgctacaatggaattatccatcctggagcaccatcgtgaacgcagaggaaaatggaatcagctggctcaagaaatcgtgttcccactcagcattagcttcgtcctcctaggagttgcgatgattggcttgatgatcactggattttcaccagaaaaagaatttagcagaaagaatattggctggatacttgctgatgttggatttttgggttggcatgctctagtaggattttttctacttccaaaagtgatcctcacacttcgggtacgttcctagagtgcaggtgtggccgctggggtagcatgccggtacaaggtacatccctcttcactgtacatcttaactggtaatagtgtttctgtgatgccctatgttatccttcgttatatggctgtacctgatttatatcgtgcttgtactctttgtggaaagaaaagaaactttgatttgcaagacctacatcctaggtctccgtgttccatcatctggtttatgttcttcatgtagcattcagatcaaatgaccctatgaaattatgttgatactaaaacatattatgggtaatgtaggcgacatccctattttcctccggatctcttaattaccattgcttagctttcagttcgcctctgaccatcaaattaaatgtgaataactaacttgatcctacctttgcttgtttgtcttccaacacaaatattgtagttattagtaggcacatttttcttgaagtgggctatgagttatgtttgttcattagtcatacattctcgctctcctgctttttattctccttgcttaatactatattgttgcattttatgtctggtacaaaatacaggctccaaccttagacttgtaatatgtctttaatgtggaattttagatgcctctataataaatgaacatgcatttggctataccctgtttgtaggcatgttatcatttcatttggtcagaattagacgtgtgtacctgaaaatcaaatcagatcactatttgttattattaagttgcatgcaccgaccagctcaacccaaaagcctaagctgataggaaaaggcgggcaattcactttatacactccaacactccccctcacgcgagaccccctcaagtctcaagcgtggaatattggagtgggctgcaattattttatttnnnnnnnnnnnnnnnnnnnnnnnnnnnnnnnnnnnnnnnnnntgataccatattaagttgtatgcaccgaccagttcaacccaaaagcctaagctgatagggaaggcggacaattcactttatacacttcaacagttattttgtttggtagatgttcagagtatttgttacccatctggtacaaattaaatattacatcttttatctgttattagtctggtatatatctgagtaataactatctagcagaagcaaatttgatggagttttgatggcacatgcctagaacatgaacaaacgtaatggatattctgcctcctaactttctaatactatgtcatcgatcaagcaagtatctagactcttaagacttcaaataagatgattgtatattactctgtttctgttctattgatgtctctggcactccttgaactttcttttcaacaattcacgcaaggaaaagctactgacatatgtcacaatgattattgcagttttgggaacctggaaattattggagaatactgtgacaaattcacttccggaatctgcaagctatcgtattaagtgcatgatatcttgcctgttttcttcacgatgactatgatactatgaacaatatttggaattaattaccaggcgtgatgcttatttattttaggtgttgctttgagttagcgtgtctccactctccagcagtcaaacaaaaaagcattgaatgaatgacgttcgtattttcaatcaggcatgttttgtgattgaactaatagttcatatgctgatatggttgatttttgatggacctttgggaaagtgattt

SEQ ID NO: 47066 - DNA, 6855 bp, Oryza sativa
catatgaatttggactatggacacatatgaagcacatgtatgaatctattcaaaatccaaaatgtcttgtagtgtgaaacataggtagtagttggtgcttaaaaactgcttaattacgtgttcccattgtggataatcagttgctaaaaattccatgtttgcatttgttgaaaacggatggattctaggatttatggatgcaatacctctttaattagaccttttttagcaccatgcatggttcatgtagcatggatttggtttatttgcattacttggtatagttatgcttcaaactttgtggacaaaacatgaggtaggctacacttgcacaacgttgggccaatttgttccagcttcggcttgtaaaccatcctaaatatacttatattttaggaacctacgtagggagtataatatttttcacgcttctaaagaaaaaggacaagattggttgcatattatggtgttcaaaatcaaatcctactatccgctttttggccctatatatgcgtaggtcagacaaacctaattaaggtcacaattaaatgttcaaagttttatccatttggccctcctggtatattttgccgtattttgacaagagtaaatttaatttccgtaggttttgcaaaaaaaaaaaggggggtagggtggtatagaaatcattgcttccaaaattattcaaaatttgttcattctggtagaatacaaattggtactgctatgtccatctttaaaaaaaatgatttgtacaaacagaagactaattaagttggaggaaacaacaccaatatacccctcattaacaggtaagcggtgttgaagtgatcatcttattttactacaacctccgttgaaaaagacaagatagatgctttagatcaaataagataccaaaaggctatcataccctcccttagtatagagagagagcgagcagaagggactactaatgttgaagtagtgattagaaggctaaaatgagaagaataagataaagtgatattaagagttcgagtgtacctacagctaaagagacattctttttttatggagactggagagagtactaccttaccacctactaccattgtggagggagggtagataaggggcttcaaatcaactctttgtgataaatttccaacaccaaaaataattcattttggagtacatcaagctcgtgcatctagcctaaactctcaaagtattgagatcctctaacttacaacatctataaaagaatggtcaaatggctctccaacgatctctccatctagctggccaaaccccacgactcactggttaaacttggagagccattttgccttgccaaccatgggtcgcaccacccctccaccccgccccgcctcgctcacccccccccccccaaaaaaaaatcactcgagaccatggtggcagcagtattgcggtatatttctgactcttcctgcgctggtattattcgctgttgcccgtcatttagagctttagccatcaacagtgacggacacaggattaaaataaagatggggcgaagatgctcgtctcaataagaacaactaaatgaaaaaataccatatttatgttgtaatcatataaacatatagtataatcaataaattaaggcaaacaaaaaacaaaaatgatattaaaataaagtaataatttttgctccatacataattcatcatacataaaaagatactagtaaacatatcaatttgcaaatatgagtcaattcataaagcatggttaatagatatcttttaaaaaataaatatatgagaagatatcgcatacctagaataagatgattattattttgcttagaaaggagagagagagaaaaacattaggcacctaactatagtaggggacgggggtgagcagtgtcgaggaattgactgaggaaagcatcacatatgcaggattaaaattggacacttgagctgtttatttatgggccaattgtgaattggatgtggtggtaagcggcccaaaaaggatatggaggtttggggcggcccgggccgtatctgggccggccgcccaacctcgcctaatgggtggtaccgcccctggccaccaaccctctttatggtattataaagggtttatttacaagcgtttgttaaattataaagggtctactctcgtggcatcgcaatgtctctaagctttttttttccgctgggcaccaagctctggtttcctcttgattttagctatcaaaacggtaggtgtcgaagcgaatcagtgaaaatcatagttaaagctaaatatggaaattaggttgctgttaaatccagtttaacctaaacggcaactaattgaacatatctggaacaaagcgatacaaaattgattttgtaataggttgaaaaaaatgactaacagatgattataagcggtaacgtttattagcaataaagaatagtttatgcataaaaagattttatataatgttgaaaaaaaaaccacaataaaaaagcatcaaaatcatctaaaattaagatttaaaatttaaattccgactaaggctaataagctaaagaacaaacgatgaagctggaggtgaatgttgtttggtgtggagttgttgctcgtgctgaatctccattctggatccaacggccgaaaatctcacaaaggtgataatctttttgctaatgagatgataatccttttttagagagaagttgataatctttttggcttcccaaaacagtacagttgcgttgaactatactctctccgtactcgtaaaaaaagtcgtttaggacaaagtttaagtcaaatctttagaatataaataataaataactaatacaaaaattatattaatagatttgtcttgaaaaatactttcataaaagtatacatatatcacttttcaataaatatttttatagaaacaaaaaatcaaagttatattttgaagaccgtgtggctgttctaaacgatttcctttacgagtgggggagtatgtgcagctaatgtttgaacgcccatttggatcggagctcacagggcagcccgcaccggcaccgtcttgctccggtacgaacccgacccgatagcccgacactctccccgcgtccaaagctgaaattaataaactcgttctcgcgtccgcctccagccaccccactctctcccactccacgagcgctgcaagcgagagcgagagctcgagctccgcggaagctagggtttcccattccatggagttcaccggatcatcagcggcggcggcgcgggggtggcgccgtcaggtgatgtcggggaaggtggcgtgggcacggagggcgctggcggcggcggcggcggcggggagggccctgcccgccgtcaccctcggcgtgggctgggtgaccgccgccgcgggagtcctccccgccatcgccgggcgctgggtcggcggcgaggcggggctcgccatggagcgcggcggcttcgccgtcctcgaggccggccagttcgcgttcgcgctcctcgtgttccccaccgtcgtgccgcagctgttggccatggcgatggagaggctgcgcgatgctgggcctccgaccctgatggaagacagggagatggtatgccgcgaggatcgtttatgcgttctctttcaagtttttcgtgcttttgcgtgtatcctaaaatattctgtttgaactccctccaaatttagtttgcccagagctgatcagtgtttgcgattttggttcgaaattcccaaaattttggacccccggaacaaaactatttcgcccaaaagttacaacaaaaagaacaattttctgttaatttggtcaagttttatccaaattcagccaaaatttgttcaaatttgaaagaaattcgttggcatatctgaaatctcggaaatttgactacccctggcacaaatgttcaaaaggaaattgcaaagcatggagctgaggaatgcatgtgtcgtgtttaatcatccagatatgtcaattgcatttcagaagatgccttgcttgagaatactactgtttcatactttcatagtccatggcagataattcctttgggctgatgtctccaaacttatttgtggctggttcattatagatgtagaggctggggatgtgatcatcttccttattataaaaaaaaaatcaccacgtctttacagagccaattgcagcaagttctggaatttcatacataattgagttttacttgcacatgacatagcagctttacgccttaatgatgtggaatgacgtgcccctgttttttgctgtttactgctgttctcttggaacgatacttggcatcctttgacgtccttcaacgtttgtagtctcaatgatgttttaatgtgtggtggtctgagttcaagatcctagcagtgactggccggtcactgcttctaagccggttggctggttaccattatacaagccgggataattcaaatttaaaatttagttttgacattatgtcaagtcaatcttctcagatgagtttatttgttgttacacacttacattccaataggaaaagaatgaaaaaaagggacatgttccattttgaaactgtatttattcttacagtaatttgtgctggactatatcagattatatttatgatgtgtatcccttcatgtgattgccttatgatcattttgatctattttttttatcttctaatgtattatgtatgtcggatattttgaaaatttgtgctttagtcatgccaaaaaattccggttggtgttgtctggtaacttagcttttttgaataacttttttttgggaatagtggtatttttggtgaaaccaatgttcaaagtcttggttgtgtataaacattagctgattggatgggccaaaacctttccctgtaccgatatataaatgaagtttgaaataattgtttcttattatgtgttacatatgttccagtcttccagagccatatatatatgttaactaattatcgtccattttccctactcgaattatttgcatgtgatggtgatcgtagctggtaagcacaaatgcagcaatggaattgccaccggagcagcatcctgaatgcagagtaaaatggaaccagatcattaaagaaatcgagttcccatgcaaaattggtttcgttcttctagggtttgggatgattggcagtctgatcattggattttcaccagaaaacgaatttagcagacagagtattggctggatacttgctgatgttggattatttggttggcatgctttatcagtattctttctacttccaaaagtgatccgcgcagtttggatacattcctagattggaagtgtggctgctgaggtagcattatattctggtacaaggtacgtttctcttcactgcacatcttaactagtactggtaacgttgttattgtcatgccctatatatgttatcctctgttatgtgactgtacctttttttaatgatatatcgtgcttatactctttgtgcaaagaaaaaaaaactttgatctgcaaaaactttacattgtactaacttgatccttcctttgcctgattgtctgttagcgcaaaatttgtagttcgtaggtgcattttttgcttggagtgggctacaagttatttttgttcatcagtcataattaaagtatcaactttcctgctatttatctacccttgctcaatattatattgttgtacttactttatatctggtacaaaacacagggtccaacattagacttgtgatattagtctttaacgtggaatcttagatcctcagtaataaatgaacatgcatgtttggaaagcttgttatatcactttatttagtcagattacactggatgtgtatttgaaaatcggagtatttgtttggtagatatttagagtagttatggacttatggtccatggtataaatattacctcatttaatttatctgttatcaattgaataaatactgccttctctacttaatattcttttgtcgctgggtcataattggcattggcagaatcaaatttttgacggaattctgatggcacatgcctagaagattacaaatgtaatgaatattcatctgcctcctaatttcctagtagttcttagttatggcccatcgatcaatttaagcaagtatctagatttgaataggatgattgtaatataattttgccttctgatctgactattggaaatttggatgtttggcacacacacttaacttttttttttgacaataccttcaaggaaatgctactgacattacttcgatgattgcagttttggggacctaggagttattggagcatactgtgacaaatccacttcccgggatctgcgagctattggattacatgcatgatatctcgccctttttctttatgattcctatgatactatgaacaatgtttggaattaattaccagatgcgatgcttatttattttaggtgttgctttgagttagcgtttctcctgcggttaaaaacgaaaacattgaatgaatgagtcgcgttcgtattttaaattcaggcatgttttgtattgaactaggtgatctgtttatgtactggcatggttgatacttgatggaccttcggggaagtgatttgtgtctgggtttcttctgctacaatatttctgtgataactgcagtttgtagtatatctgggttttggtccctgttggtaactagaggtgactctagttaatgtatcatactacaaccgcgagttttcagagttaacagacaggtcccatgcatgtgtattaggccacaaccgtcacacaaactttggacttgatactgtagctgcaacaagtgatttgctcctgatattttttttcacctcatgcatggtt

SEQ ID NO: 47067 - DNA, 1959 bp, Oryza sativa
tttgttgatgcaacacctcttcagtctttaggcatgtgtttagtcaatttagacatgtgtttagtttttatggtttatcacacttggcaccatggttcatgtatcataaaggggatgtttagatcagggtgtaaagttttggtgtgtcatattggatatacggacacacatttgaaatattatacgtagactaataataaaacaaattacacattccgcctgtaaactgcgagacgaatttattaagcctaactaatctgtcattagcaaatatttactgtagcactatattgtcaaatcatgaactaattaggtttaaaaaatttgtctcgcaatttatacacaaattgtgtaattagttttttttttctatgtttaatacttcatatatgtgtctaaacattcgatgtgacatggtgtaaaatttttgcctgaaaactaaacagggcaagcttgggtatttgcattacttggtatagttgtgtttcattctaacattttttccacaaaacctgcggtagcttagtagttagactacgcttgcctagcgttgggcctatttgtttccgcttcgcttcggcttgtagaccgcagccaaatttcaattttagaattaattcatttgttgtataattcttggcttttgaccgcaaacaataaaatctgttctaaaattgtttttcttctttggtcacttgtcctgtaaattgtagccaattttttttttcgcagggtctctttatttgaagaaaaaaatatactacagaataaaaattttgtaagatttttatcatgtaggatttttctcttatataaccatttgaaagtttcctttcaccctttttagttccattttcgcttatgcttatgcttctctatatcgcttattagcaactaattcgtgagtaaaacttttatttatgtgtcataagtagtataaaataaaatattataaattaaactacaataagaaaacacaaaattaactttacaattaaatcttaacaaaacgatagggtttttttctctctctttttttcttacagtccagtcaacgatcattattgtattttttctgtactctgtaactgtattctagtgaaaatcttatattgattttcatattcctccgttttgaaaatcctatatttcaaacgtaccataagtccataacttccatagtagccgtttccgggtacattctactgggtgcgcctaacaagatttctccgcttcgggcatcatcacccggcatttctcctcccctttgcttctgttttcgtcgtcttcccacgccgcaaaccccacacgccctccacactccaaccacttcgcctccaccacagcgcgagagagaagcttctggaagctagggtttccccgtccccatggccgccgcccccgacgccgctgtggtggtgcccgtcctgctgccaccgccggtgccccaggtgcagccgacgctgaaagacatcgtcgtggagttcccggtggacggcggccgcggccgcctcgtcgcggttctcccgctgccgccggaccacgagctgaggaggtcgctggattccgtcgcggaggccctggcgagcggccgcctcgccgcggtgctcccgccggcgcggaggaacaccgtcgcggcggtcctggcgcgcagccgtctcgccgcggccgccgccgatgcgctcatgtacctggcgctcgcgggcatgtggatcttctaggcgggcatggccgcgcaggacgtcgcggcccgcgccctcggcgagggctcccgcgcgtacgccttggcgttcgaggtctcccgcgtcgccgtcctcctcgtcttcctgccggtcttccccttcgccacgttgctgcacgccgtccgcctcgccgtctccgacaccgatgagccagacgaggtacaccttcatgtccaaattcttactactgtatccgaatcaattccgcatatgaact

SEQ ID NO: 47068 - DNA, 3437 bp, Oryza sativa
agggtgtggagggtgaagctacctggccatggccaccgtgttgttccggtgtagccaagctgacaagccgtcaaggtatagtaattaatctccctttttattgtgtaattctgcgagcaattccctttttaaccgtgtttattagggagaaaataaagtgttctgtgtgttcttagtccactgtgcccactgacattgatcgcattgaattgattcatatattttcgcgaaccacgggcattctttagtttttaactgcagagtgactggatgagactaatagcattgttaacatgaacaaattttgaattaggcagtcccttatcttaatcctacttgcttaattaggcagctttcttaattaggcaacaccttatggccttaatcatcaaatgctctagtttcactctagaggcacagctgtagtcctgtatttgtgacttgtgaatttgaagaattacggtgttctctcaaatatgtatgtctagctgcctggtatgctccatcaggtctgaggttgcaggaaataccttctcctgtcagtccagttaggtgaaaactacacagtaggatagttactgttgtccaaatgtttctttgataagctgcacattcaagtgtgtaattggtctacttacggaaaacttactgaaattcctacaagtctaacattgtctgctcttttggtttacaaacatttacacaccgatcttatttaatttgggttattctgttaacagacaaagacttgaagagaagtacggctgtgaagatggtcagacagggacctacaggatgactcttgctgatggttaattatgggcttatggctgatgccatcagatcaaagttttgaaaactatatttggcttttacgtatactggtttctagtactttttttgacatgatggtttctagtactttgcatctacgaacttctattttgtaacttagttcaatgctagtagtacagtaggacatgttccatgagctgatctgcgcatttggcaatttggaattaaggtgtttattctgttggaatgacttatgagcatacttgtcatggtaagaccttatttggcagaaaacacagtcaatgcttctctggacataatatcgtaattgaaatgttctgtgattgaactagttgatatgctgtttcgttgatgttttatggacctttcagtaacaagtgattttgtgtctggagctgctactgcaataatttctgtgataactgcagtttgtaggatttctgggttttgatagctacaaggtgaatagttaaatctttctcactacaaccgcgagatttaaaagttgacagacagatcaatgcggcgcgtgtgtgttttattaaccttttggaccgcaatggtcaataacttaacaggtgatttgctcttgacattttgttcagctcatcgatcgttgatgctgttgcctgttggtctgctcttaactagagcttgaaacttgttgggggttacatgcttaggcgttataatttctgataaatcattcgctaaatttcacgtgcattcgtggaaaagggatggagcatatatatgttagggtgttggacgtttattgtcgtacctaagggatgcgacatctttttagcagcacggcttgacgattttttagcagcacggttcatatgtttgtaaagttaattatttgtcttgactttgctatagttaaaagtacaaaacatgtggtaagcaatacttcgcatatttgtttcagattagctggtctatttgtttcagatttagcttataagctgcaatcatttttgaattataacttaattttaagattaaattaggagtattgtgctaaaattgttttaactccggattattcttttctttaacttcgaactacaactttctgtttccgttagtatgtttttcaaagtattaaacgatacgttcttttatttatatatatatatatataagttcttcgataaataaataaattcatttttaagtttatatttaatatttaattaattaatcatgtgttaatgagtttttttttttttgcttggggctgaaaatctcctccaaactgaacaaagaatgcaatagtcttgtgacttcaatcatagaacaattaactatcctttggttcttcccgttggttcatttaaataacaggattgaaaaaaccatttgaattgtcgcattgaaaaaaacgaaggaatatgaaaaacacaagattctggcatgaatgtaagtgcaaaataaaaaattacaaaacacacgaaaaatataggaataatcatttgattagatcatagaaatcaaatgagagagataaacttaagggaaatttcccaaaaggttaagatcgacccctttggttcgcaggaatgaaaaacgaaggaataggaaaacacatgattctaacataaatgaaagtgtaaaacagaggattgcaaaatataggaatgacagtaggaaaaacacagagatcggataagagagatagactcaaaggaaattttccaagagctttgagctcttgctaagtttcctccaaaatctctataggattgtccattccataggaatttcaaaggattggatatgatacaatcctttgatttaaaggtattcataggaatttttcctatagggttgaaatcctccaaaatttgtattgttttcctccaaatcaaaggagccctaaagctctagccaagtttccttcaaaatatctgtggtattactttccataggaatcttaaatgattagataagattgaattctttgtttcaaaggtcttcacatgaaatttttttgtaggattaaaatcctccaaaattactactccctctgtcccaaaatgtaagtatttttggaccctgacacgatctccgagatgctattttgaccaataatatctataaaagtgaggtatttcaaataaaaagtgttgcatattatgatagtttgtttaatgataaatctaggaacaccaattttacatgattgatcttttttttattttttttattaatagtcaaagttaaaaatatttaacttatcactatgctaaaaagcttatatttgggacggagggagtatattcttcctacaggtcaaagggcctaacaaccccatcttttcgcttatgcttatacttatcagccaaaatttaaatttttaatttaaatttggagttgattttgaggtttttcatcgaattttatttttcagtctttgcttttagatcgctaagaatacgtatataaaagttttattcacaaattattttttgtttataaatatgccgtttaataagccaaacgactctagtcatcatagctgcttccggggtatagggcctgttcactttgacgcaaaaaacaaaagccaaaattttggcaggatttcttatatagctacaaaatttttttat

SEQ ID NO: 47069 - DNA, 9384 bp, Oryza sativa
ccccgtccccatggccgccgccgtcatcgtggaggtccttgcgggcgggcgcctcgtcgcggctctcccgccgccgccgccggaatctgagttgctgccgacgcgagacgtcatcgcttcgtttcccccaccgccgccgctgcagtctcccgtgcggaaggccgtcgcggccgtcctggcgcgcagccgtctcgccgcggcggccgccgacgcgctcatgtacctgtggatcgcgggcctgtggcctgtgggtcgccagtgcggccatggccgcctcgcacgtcgcggtccgcgtccaaggcgagggctcccgcgcgaacgccgtggcgttgcaggtctccctcgccgccagtctcgtcgtcctgccggtcgtccccgtcgcgttgtcgctgcacgccatccgcatcgccgtctccggcaccggcgaagacaccgagccagacaaggtactacgactttcctcaaaaagaaaaaaaaatgcttctacctttgggtccattttcgtgtgtgcactggtgcggattaattactgcatttgcatcaattacctctactcctgtgaacgaggttctatatctagggtaccaatagaagcgaaattgctggaaatttcttgccaaaaaaagttcagattcaaacaaaatttggttaaatttaaaatctgaataaaatttgttttgttcaagacaaagaacgaaaaatttcggtaatttgattccgaattatggaaccctgcatataagctgcacctgttatcatgcacttcttgccgcgctgttctaaattttgatttttgttgtgtatgtcgtgggtgcccacgttgccaatttcaagcctgctccggagagctttgcagcatcagtgagggcatcgttcagtcaccccatcctagctgcatccgccgctataacgcctttcgccgtgctggtgcctgttggcaatctggtgaaggggatctcagctgccagtggatcacgcggggagagaatcggttctgcgatcgaggttgtggggctcgtcggcttttacccgatgttcctcttcttctttcttcccactgctgcgtggatggtgtggaggagggtcaagctacctgcaggccatggccagcgtgttgctccggtgtagccaagctgccgaggttatataattaacctcccttctcgtttgattcatcgcgtgtgtctctaatttctgtgaataattttcctttttactcatgtttattaagtgttctctgtattcatagtccactgctgacagcaatagcatttaattgactcctcaagtttcatggtcattctttaattttttttaactctaggatgacttgatgagcatattggcatggttaacatgaacagatttttgaactaggaaatccagtgtcgatcctacctgctgaattaggcaaaacccattatcatcataaaaagatatatatagctagtttcaatgtatttgtgactgtgagtttgaagaattatgctgtttactctcaaatctgaatgtctagctgtctggtatgctccatcatgtcttgaggttcattgaaatacatcctcttgtcaagtcaggtgaaattgatactgtaggttagttactgttgtctatatagaaggatgtttcattgataatctgcacccgtatatctgtaactgggcaggttattggtctacttgctgaaattccttcaagtttacaaattttctactttggttgccaaacatttattatccatcaatcttattaaatttgagctattctattaacaaacaggcttcaagagaagtgctgtgaagatggacaaggacctagaagatgactcttgctgatggttaattacgagcttacggctgattccaacagataaaagttttgagaactatggctcatatttgctgatttctagtacactgcacctacgaactttattttgtcactatatatgagtttaattctagtaatacagtaggatatgtgccacgagctctgcctctgacaatttcgtagtggtagtacagattaattggaatcagattttacatttgtgctgttcaatataatctggtcttgctttctcgattaaaagtcaagctgtgtgtgttgttctctcatgatagagtgagattttgctatctatgagcacgcatgcatccttctagttccaaaaagtatgattcatgttttagggattacctagtgaattcgatatatagtcacttcgtggatttcacattgttgtagtacgttttcttagttacataatcccccccctttttattttttgaatcgctacatgtagtggctaatggcaggaatgtctgttccattatttagaaaatgtttcctcctgttgatcagaacattgctatgaaattatttgcattttattggtgaatcatcatcttttatcagtgcatcgatcaagacgcctacgctagagatacctcaccagagcaccattagagtgatgatgttgccctttttttacatgacaaagtaatgcttggatggctcttctgcatgcctttcatttttctcatgcttgtgggggttctgatggagggatctcggagtgaaaggattggctctatatttccggatgttggatccttgggcaactctgtgctgtattgcttcctcatctcacctgctttaatcctgcagacctggaggatgaaataggtagtggtggcatagttgaggtatctgtcctttactttggctttctcattgtttatcttccatataatctctttattttacgagcattatatatatattgttatcctactgattatggttactagctctgttgagtaacaatgtgcagagaattcctccacttttgcaatcctttgtccttctactggtaatcaggaaataagaactcatcgcggttccttaaaattgcaaataatggttctacttggtaaaatgtgctcagttgtagtcttgagctatttatatgctggccctattatgaatatacaaaaatttgggcagtgctattccattgcattgaagcccaaccaaacaaggccgaaaggacatttcgttcatagatatcctgatatccactagtgctcactcaagtgatatgttatacaggttatctaacaagttggctattttactaacgaagaggagagaagtgctacaagaagctatgtgtagtccattcacatttctgaaggttaatcactcatccggccatcccaacacatatcgaacttgcgacagaagatgtttctttttacagagtcgctgcttcttcgatgcctagtaatacatcttaattctcttaagggccctattctgtgaactgttactatatatatatgccccatcactaattgttctagtgattatacttagtactcacgaatcacgatgcatattatcttttgatattctgctgtatggtgtacatactgtgcttggaggggggctaatgactcataattacatgactgtatatatgtcaatatgcttattattatccttttctaggaaggcatatctcttgagctgaaatggatttggcattatgatttatgaacatgtagcagtccatctcacatctatttatcttcagtgaagctttggtgtgatctctaaggttatttattatgtctgctgaatgcttgcttctctttcttttcccgttggttgggctgctgctacatacttgatcaacattgcttgctattcgactagtactgggccagactgcattgggcctccacatggtgatagtagaaaggaggaagatagaagaaagaagagtggtgatgtagaagaggacggagtaagtcactgacaggtgggacccacatatgactcagcaagtcaatgagggtcaaaaccgacatgtcagccgaaaccgcctcccaaaccattatactcaggttttaaagatgggggaaggcattatacccggttttgccgttgagggatgcgattcaactagacgtaagagttgagggatgcaaaatagacctattcctttctgtggaccgctcatagtttacaggctagcccggtccaggtgattttgccacccatctagtctagattgattcatcaaagtagggtagttatcttccactagtagctaataagctaattacgcgagctccacccaacataagtacggattcggattcagtgacattgctatggcatggcacggtgtgacattggagtgatctggagcgttcaaaacaaatccaacggtccgctacgtcggcccacctgcagcctccgttttcacccaaatctctgtttcctctgccgcccgacgcccaaatctcgcggctcgccccaatcctgcgcgcacgcccggtaccgcggaggtcccaatcccgcaccggagtagagctgctggcggagttccaatcccgcggaggtcccaatcccgcttggagtagggctgccggcgccgggaagtgcagcacgccaaccgccgaggccggggccggggcgcctgccctgccgtcgccaccagataggcgggaggtaggggggcccctcgccgtgattggggaggcaggccggccgccgcgaggccgggggccgaggcccctgccctgccaccggagcaccaagattttggggaggagggctgccagagcgagccgagcatctgcagaggtggattgcaagtgagtgtttctaagttttattctttaggataacttggagagcaactgaattgcacaatttggtttaatggatcttagtcttaaatggagcaaatattgaatgctaaattccagttattggatgtttgtgtttaggcaaatgttactatctgtatgtgttgaaaaatgttgagcagacctactatcagataattgtcccccctaagtgtgaatcatttttatatcagaatgttgtggttgagataatgaaagagcataatagtgccgccataatgaaatatatgttccgattattatagtttggaatttttttttcagaaatttgagtacagggctattcattgttgtggaaggcaatggcagaagttgatacaaagttacttgaagttggtttgaggttcaaaaatccatataagggttggttattttgggtggcatatggcggccgtactggctttgatgtgaggaaaagatgcacaaatgtaagcaaaatggatggtaagggacttcatgcagatatgtttgtttcaatgagggtcatcgaacaaaaaggcaaacggaacatgtgacaaggtgttttagagctgatacaagaactgattgcaaagctcagatggttatttcattggatcgaggtgcaggaaattatgaagtcattgatgtgcttgaacacaaccacccactccacttgccagagaccttccacttgatgaaatcacaacgcaaaatttcaaaactccaagcttttgaaatagaaacagctgatgattctagtattaggccaaaagctgcccatgagttggccactcgtcaagttggtggaccacttaaccttagctacagttgccgtgaccgccaaaattatttgcaaagcagacgtcaaagggaattggcttttggacaggtaggaagtatgttgaagtattttcatgataaaattgttgagaacccatctttccaatatgctttgcagctggattgtgaggagcacattaccaacatattctgggctaacgcaaagatgatccttgactatgcacactttggtgatgttgtcacatttgacacaacttttgggacaaacaaagaatataggccatttggtgtttttcttgggctcaatcagtttagagaaaccactatttttggtgctgcacttctatttgatgaaacagaagcatcatttacatggttgtttgagacttttctagctgcacataatgggaagcaacctaaaactatttgcatagattaagatgcagctatgggaaaagccataaagatagtattcacagaatcatatcatggtctctgcacctttcacataatgcagaatgctgtgaagcatttatctccagtgaaaggtaaagaggatgatgaaggtgaagaggaagacgaaggtgaagaggaatcgcatgttcgcttgtatgtttggccacgaagatgaggcatcatttgaagaggcatttgagattatgagatccaaagttcataagcaaacatagttagatagcatttacaaggtgaaagagaaatgggctgaatgttatatgagagatgtcttcagtttaggagtgcgaagtacacagctaagtgagagcttcaacaatgcattgaagaaccatttgaaatcagattttgatatcattcgatttcttaagcattttgagaggtcagttcaagacaaaagagataaggaactacaatctgaatttgaggcaaggaagaagctacctagaagactaatgtgcacaccgatgttggttcgagctaaccaagtgtacactccagtgatttttgaagctttccaaagcgaatatgaaagatccatggctgcgtgcgctagagttttggatggagaacacagatatgctgttgtagttgggaatttgcttggtgaggtaagttcagaggtggaggagtacacagtgatcggtgatcctctaaaccaaaaaacttcatgtagttgtagaatgtttgaaaggataggaattttatgtgcacatggtctgaaagttcttgatctaatgaatataaaaaaattgccaccacattacatcataaagagatggactagagaggcatgtaatgaaaatatacaagataggcaaggaaggaatgtggtagcaaatccaaaattggaagctcaactacggtacaagattatgtctcataagtttcacactttggcacataaagtagctcactctccagaatgttgtgtagtgttagaaaatgcacttgattgcctttgtacacagctagaggagaaactcaatttactatctgctggtggtacacatgagccctacgaggacaaagaaaatattgacccaaacgcgcaacatggagatgatttgcttagtgctacacaactaaacaagaaggaggttcagtcaaacaagtcaaggagaattagaacttggattgataagctacgcaaggggaagcgcaacaatcctaaatctgcaaaaccaacaaaaaagggagtaaaggtatatcatatgcaagctgctcatctttgtatgttgatgtaaaaaattgcttaactaattaattgacttttcattggcaaaaacaaaagaaaaatgatgctttacagccacaggtacaagttaaggatgatggcagccacaaagaaagagacgtggagcttcaacaatacaatatcattagcgattttacccaccttgtgacagcaccaagttgtgatgatgatattctctgtgatcaagatctgttctaatctttgcaagatggttagatggcttgtggacagcatggttatatggcttttgtacaggatagtttgatgtttttggacaggaatggttagatgccttctcgacaggactaactatagtattttgtggtctctgtttagtattttggacagggccaacgatagtattttgtggccaaattgtacaagtgaatatggcctacccttggaatagttttctatatgctccacatactagtttgaatgacatgtacgatccaaaaacttatctcacaacattatcaacttctatatggctgtttccaactatctgtgatgtctgaatgctccaagtttcaagtttatcaacttctatatggttgtttatgtctttctgtgttgtctcaatccatccaccaattatggggacatgctgtcaattttttcagagaaacatcacagaacagcatacatgaagttactgatttattcattcattcattcaaattacagcatacatgagtcaaatcaattgtttcaggacagtgcacagctaagcctaaggcaattttggagatagagaacaaacagctaaacttcaaaacagcaattttggagaacaaacagctaaacaactgtaaaagaatctttgcatttctctaatggaaatggagggctttgccctttgctaaaaaaaaccagctaaacagctgcgaagaccattgcctccattggcaccccgacggccggccgcctccatcgccaagggtcacggtgttcgcttcgatgccactgacattagcctgattgtaagcagctagaaactggcaactcctgtcctggatttcccttcagttcaagctaaacctgaaaatgattttgtctcacaaagttcagttcagtcacttgaagcaattgcatagcccaattttcacatggtttaatctgtttgaaatgccatggatacaagataagcaagatatatttctcatttcacaaaatcaagacacaatgtacaaaaaagagatgaattatttggaatacaaattcagagatgaattatttggtactgtgttcatcagtattttcaacatatttcagacaagggcaccgtcgccccatgggcaccccgtcggccggccgcctccattgccaagggccacggtggcagggcaggcccccagcctgtcagccccggcatcgcgcggccgccgcccggtcccctccccacttgcggtggtggcggctcctagctagctccggcctggcgcggcggcggcggcctggcgcgggcgagggaggcgaagctgcgaggcagccgcccagtcccctccccactcacggcggcctagcgcctctctggcctggcgtggcggcggcggcggcctggcatgggcgagggaggcgcaactgcgaggcggccgctcggtcccctctccactcgcggcggcctggcgcctctccggcctggcgtggcggcggcctggcgcgggcgaggaaggcaggcgaagcggcgaggcggcgatgcgaccacgggggattggggcgagggaaacggagcgcttgggggggaaaacgaaccctgcaggtgggccggcgcagcggaccgttcgattagatttcaacgttccagatcgctccaatgtcacaccgtgctatgctataacgatgtcaccgaatccgaatcccagaagtactacatgtttatcgcttcattcttctccccttgtttgaggtcaaaccaaagacatccatgtcagcctctagtagttgtatcaaccatgaggcgtccaagtccaccctatggacatgcgcctaacagttcaaccgcatcaacaatgattctaatggtacaataagtggcattaaggcacattcggacccatgcataccacactggctcagattgtttgatgtacggttgataggccgacaaaaaattaaaggaagcaaccaaaactaatttatcggaaaaagtttaatatattacta

SEQ ID NO: 47070 - DNA, 2022 bp, Oryza sativa
acattcggacccatgcataccacactggctcagattgtttgatgtacggttgataggccgacaaaaaattaaaggaagcaaccaaaactaatttatcggaaaaagtttaatatattactaggaaaaatacccgtgcgttgcaacaggtgaaatctattttaaccttattattgttatatgatttaggccctgtttgtttcagcttaagattattgtaatttagattattaaatcggattactctaagctggattataataagctaatctaaaataagctgcgagttatttgtttctctggattattgaagacatctaagggtagtgggtctttagccacccaataatctggaaaaagctcctccagagaagattattagattataataatctggcttacagattataataatctatttgtttgtttcagcttactcttaataatccagattataataatcctaagttgaatcaaacagggccttatttaagataaaattcactgtggaagttcgtttggatatatattttttcagaaaattatgagatgtagttaagagtccgatcatctcaagttagcatgcgagtttttttaaacagatttcttatatgattccttctgtattaccaaaagtgaacgatcgtaaaaaccgactcaaatacggatatatatttccaaaagcaaacgaacttaaaaaccgactcatacatggatggcataccaaaataccggcaaaaacatctttaatttttataatagtagacatatgttttaagttcattaaaagcaaatgcagaaaaagaaagaatgataaaaagaccttaacattaagttttaaaattcagattttgtctgggactaaatggacaaaagtaaacgatgagaaggttaccactaattagaattttctttttaacatttttcatttccttatctagtttgcctttgctaaataaatattatcccttatgccattcataatctaagccacacctagaattatctctagagagggaatgccccatgtagactgagaccacacctcctatcccacagtgcaaagttgtttcaggagcgttttcaatttttcatgtcaagccttaccatcttctattttagtcatcatgtgttttcattttacataacgtctaaaatttagcactacacaccctaaaatctctcccctcccctcaatctctccgttcctcaaccaaccagagaccgacgacggccggcggcacaacgagcttcaacctacggaggccgacagctccccaacctccgcccaaccacaagtcgcaggaggccaatgacaattccactgataacggccggcagctcaagctaccccgtcatcgtgtcattgcttcaccatggcctcctctcccctctccccgtgccatggcggcaatcaaggaggctggggacgcagcggtgatcgaggaggccgaggtggtggcgaggcgacgacaagctcaacagcgcgtgactggtgccactcactcgtggcgacgcaatagctcattgggccccctcctatcccggccgatggcgagtagacagcacattgaggactcggagggcgatgacctcgacaatagtggcgtggatccggagtgacacgagagctcggccgccaccatcatcgcctctctcctcttaggtgtcagatctgacttggagctcagtaatatcgcctagatctagcccgcgggacagtgagctcggggcggatttggcagcgtcagtaccctaccctccccccgggcttatgagctttttcagtagagacggtttcggcagtagatcgggtcatctttgagcaggagaacggacataggatgatgttatcgggcgacgagcagatcaggtcgatgatctccaagtcggccagtgttcttccccatgtctctctcctgttttctagactcacttcccctttttctaacatcttctgtgaggccctgaggccctcgttaccgacagagggcatgcgaactcgacaagaacatggtccctggg

SEQ ID NO: 47071 - DNA, 2027 bp, Oryza sativa
ctggcagatgcatcctccttttacagttttgttttgctgcgagaaacgcaaaattggctccgacatacgtgttgaatggtccgcaaaattggctcctcacccttgcgcagatgcatcctccttttgcagttttgttttgctgcgagaaacgcaaaattggctcctcacccttgcgcagatgcagcctccttttgcagttttgttttgctgtgggaaattcggatttgttttgttttggaaacaatccgaaaaatccgaatacggtgcgtaaaaacggcgtggagtccggataagttacgcgctacttatccggttcggttacgcggagtagagatcgtgcgggcgccctgatcaagcgacctatctctatataaaccgtgccaccgccttcacacaacgcacgcgaaatcaatctaggatttgcctcctactctgtgctgcgccgtcgctcgtatactactccatcccgctcgccgacgtgcaccggcgatcgggagagcaggtctccggaacctctgccttcgacgttctgcaccgggagaaggcggcaataaggtttttgggaagcgcttcgcacgactgctccctgttcgtccgcgaaggcttgccttcctctccgctcgcgtgctgcgcgccttcgtcgtcgcctgcaaccacgagtagttcctgccgagcaaccggtctttttgccacctcggtacgtgttcgacatgttgcgcatatttgatctatttatgttttactgcttagtttacatgtgtagatctaatgatgcgttcatgctagtttacatctgcaatgtcatgatttatttatagaataaattaaattattatgtgcttataatttcaacctcaaataagggagaatggcgctaaaagaaatcaacaaaaaagtagtactcctagtacaatgctagtactcgcacaagacctcggaatggcgctacagtgcctattccttggcatttgcatcgcatggtgagattgtcagcttgtgagacccatcacagggtcacagaatttgacgaggcagcaacaaatactgctctctatcgatgcctttttggctgcggtttgcgctgtgatatccctgacggattcgttcgttttttttttttggggggggggggggggggggcgccggtgaaacggacagcagcaaagaccgaaagttgtcaggcaactccctgtattcattcaacaaagaaaaaaaaaaggcgccgaccggttgctggggtggggagttgagcccaatcatttcacctgccgattcacggtcgtcgtcgtcgtcgccaccgccaccgccaccgccgctgcaaattttggcgtcactcctcacgaaatgcaggagcagcatatcgccgtgtgaggccgagcgccattttgatgtaagaaacaattgcaaggaaatgaaactgcagtaggaggaaagaccttttcgcttcagataactctcacaggacgcggcagctgatcatgtacagtacagccttaccgtgctgcaattagcattttatccttttaaacaactaaattttacgaatagatccctataaatcttactccatctattttaaaatagaaaaaaaaaactatcgcggttgtccgaattacccctaaaccacaaaaccggacattcttcacccccaactatacaaaccggatgaattacccccctcgacccaatccgcggtggttttggtctacgtggcgtacgcgtggcagtccagtcagcattctatatttttaaaaatatgggacccacctgtcatacgctctctctctctctcactcttcatctctctcttctctctctcactcccctcactcttcctctctctctctcacggtcagcggcaggcgggggcagcggctaagggcggcagcctcggggcggcggctgaaggcggcagaggcgctgccggtggtggtgctgccgtcgcgtcgccgctcggcctagacgacaccatcgccaccgatatgaccaacgttggccggaagcggaagcgaggaggaggggatggg

SEQ ID NO: 47072 - DNA, 4634 bp, Oryza sativa
cgaggccgccgcccccgccgccgcagctccgcgccgaggccgctacctccaccgccctcagccgctgcctcctcatcaccgtctgacgccgtcgcaactccgcgccgaggctgccgtcgtctaggctgagcggcgacgaggcggcagcaccaccaccggtggcaccttcaccgccctcagtcgccacccccgccgccctcagccgccagttccgcgtcaccgtccgacgctgacacagctccgcgccgaggccgccgtcctcagccgccgtctaggccgagcagcgacgcggcggcagcaccaccaccggtggcgcctccactgccctcagccgccgccgaggccgccgccctcagccgctgccccatcctaccgctgaccatgagagagagaggaagaatgaggagagtgagagagatagaagagagagaggaagagtgaaagagagagcgcgtatgacaggtgggtcccatattttttaaatatagaatgctgactggattgccacgtgtacgccacgtagaccaaaaccaccgcggattgggtcgaggaggataattcgtccggtttgtatagtccggtttgtatagtccggttttgtggttcagggggtaattcggacgaccgcgatagttcgggggtaattcgtactttttactttcaaatataagtatttctaagcttcaaaatatgtaccaccatataagtatttttgcactaatttcaatgcatgaaaaaattatatattttttagttaatgagatagttggaaaaatataagtaattcaaaacttgaccactgaagtaactaaaagagatttgttttctttatctttttaaatacctaccagtacttaaattttagaacaaatgaagtatttggcaaagaaaaagaccctcaaaactcgacaccaactacatttgacgtctcagtgagtgtttattgaaacaaatatcatctaataaaattgaaacaaataagagggaatggaggtgcattgctttgtcaattttactgctaataactggcaacttaaccagattttaggagaggagagtctttgaaggtgggtttcaatcaaggttgtcagtatccggatctgtattctattatcttacaatattatgatcctaccaagccgaaacgataccgatcccactattcattatcacatgatcctttaaaatcttagatagcatcccgattctacgatcctaaaaaatattagttaaaataagatggtttaaaaataatgtaaataaatatactcaagtttatacttaaatatatcaaaactaatgtggtttctcttgataaatgtctctttgcatgtcatatattattactatattttttttatatagaatggctatatgtaactaatacaaatattaaacttgaaaaaagaaaaatctcaaatctcatagtatcccatgctacgatacaatactactttaagaaaaacggtactacctagtatcctgatactgataaccttggtttcaacccaatgttaaataaggttggaaacaaacagaaaggaatgaagcagtgtatattattgccaagttcaccactaaataaaatgaatttgaagtaagggatggaggtagggatggcaatttcacccgcggggccgggtgatatttctgccccgcggggatgcggggccggggccccgcatttggctgggtacaggggcgggggaaacattccacccgcgggtgacccatggggccccgggggtatattaaacctctcaaaatataatccattgcaggcccaaaaagcccatcctaatgaaatactctggaatccggggtatataagaaaaaaatcctaaccctaccttatcctccccccaccccgcactgcttcccgactctagatctcacggagtcgcggtttctctcgacgctctccctcctcagtcacagccgccgccactcgccagtctcacctctcccctccggtcgacctctccccggtgccctcccctcctctgctctccccttcggtcgacctctccccggtgccctcccctcctctgctctccccttcggtcgacctctcctctcctctcccctccggtcaacctctccccagtgccctcccctcctcttccctccggtatccacccggcacaggtgcggcggcgatggtgcaaaggaggcggtggggtggcgcagaggccgcgatgtagaggaggcgatggcgcagaggagcgagcagcgcgcaggcttgggttcacggtgatcggagctgtgtaggcgccgggcgagcagaggattcacatagagaaatatttgtgttcttgctgtgttcttactgaattttgatggtcctatccaagtattcgtgcttttttgatgatgtgtgaagtatgtacaatatttgttctcgctgaatagcgattatcttgtatctttttttttgctgattggatggagtggctacacattgcggggccccggtcgggttgtaggtccccgcagcgggcgggggatggtttggccccgcatcttcactcgggggcgggggcggccccgttgccatccctagatggaggagatagaggggagttggtcccctcttggaggtcaatgccaatgctgaccctaggcaccaaggaacctagcagcgtcctatgccgcatcggtgtccactgtaatttcactgctgtatcctttctgataaagttaccccccactaactccttaagcttaacatgcaaagatgccacatcatcatccactaacaagatgccacatcatcatccactaacaatcatcacatttaaacatcatgcaaacatgctatattttatagtttttataattaaagagcttttcaaatacaaacatgttaaattatcatccaacagaattcacataatatttcaatgtatatctttattatgttttatgatatcctatatataatagttatataattcatcctcacttagttagagtgcttaaatgattaatttatggtccaaattatctttctcattttttcctctaattaagtcataccacatcaattgtttttagcctttagataattaatctacggtccaaactatcttcctacttttcttcttccataaagtcataccaccttactttttacgtttgaatcaccattctacatactatttaaatttaaattatcataaaccacattaatttacttaaactgatattatctagctatcttacacgttatttttttacacgttatttttttattgttatcatactaaattcccgcagcaatgcgcggggtttcacatagtgttttagggttctagtgccaaagatctttggtatcgagatgttaaactttaaggctagtgttattgttgcacatttttacaataagttttataggggtgttgtttatatatttttttaaaaaagaatcggatcacaaaagtaagctaattacttagtgcacttgggagtgaatttctttctccatctcaaaattatgttacgttaatacttacttcttccgtttcataatgtaagactttttagcattgtccatattcatctagatgttaataaatccagatcactatatatgtctagattcattaacatatttgtgaatgcgggcaatgctagaaagtcctatattatgaaacggagagagtaggtcttaagagcttaagagtcgaggaatcgtcgcgctgtctggtgctaattgttcgggaaaaaaaaagagagccgaggaatgctggaagctaaatgactttaggctcatttggtacatctcctatttgagggtttggtataggtgtagctccacgtggacaagaatctcgtagtaggacgacttgtatcaaacgggtcagtttttccttgagaataacgaaatgagcatatcttagctagttcgttttttttaatctggctagttagttttttttttaatctgtttatctaggttcaaattctaaacgtaatatgagtgttcgtatttacggctaactatactttcaatgtcaggtactatatgtgtcaacaatgataagcttatgataactttatcaatctcaagttatactgacttggtcttcgaatgtgctcatagggatagtatgtgtgtgctcacgtttatagggtgttcaccaatcttaagctatgccgaccagtctttgaaagtgtttatagaaatagagtccacctgtgtgtgagcacgtagtgcgtttttagggcaagagcaatacagctattgcacttgagaagccaaagccgctagctataccaagaacggtgtagatagggtcctccatagtacatagtattacatattatagtgggtcgtctcaccagtttttctcttctcacttcgcccctctctattctcttgtgtttccccaccgacaaacggagcgaggcgtcaggcactggtggagaaggggtttttactcccggttcgtaaccccctatgtagtcccggttttccaaccaggactacgaatccgggactaaagatcgctatctttagtcccgggtgaaaaatccgggagtaaaaatctatttttagttccagttaatgttaccaactaggactaaagaacaccaaccgggactaaaaagactagatccggtagcacttt

SEQ ID NO: 47073 - DNA, 4799 bp, Oryza sativa
caggcctccgcgcccgaccgccctcggcctgttagagaggagaaggagaggaggagaggaagataaggttgaggagagaagttaaaaggagaggaggagataaggttgaggagaggagagaggagttaaaggagagaaggagatacctcgatccgatcacgcatgcctctccgatctccacgtcgatctttttatggcgatcttttttcccggttggtgttaccaaccggaactataaatagatctttagtcccggttggtaacggttaccaaccagtactaaagattgaaaagtactctggagctttcaaaacacaaccgagactattgtgaaatctggtcgaccgactaaagatggtttctccaccattgaggcggcaccacatctccagacgacggctgccgagcacacgccgcctagctcatcagatatgaagtcgggtggcgacggcggtttgtcgtatgatcgagcgcatatgtcgtatgatcgagcgcatactccgtactagaaaaaaaatatcatcaatggtgaattcgttcgggaacaaaacgttgacgacgcagtctatttaagtctatacagataagatcatctggattaccttaccctggggcacgcgtgtcagcaccggtatgctgaaagacacggcagtagatagcacacaaagcagcggcctttgagacaaatacatacggacacaggaaatttaaggaagcatcagttttctggaccaaaggcaggaacagcagaatgttggagtcctctgtacatggatgaggatgcactgcagcaacgtcgacctacgtgagaatcaacgagacagatgccctgctcgatctgctgcccttcgatcacgagagcaacgaccctcttgacgtcaacggcgccaatgtgcaggtttcaacgggggaccatgggagcatgcaaaaccatatcttggcttcaccttgtttggatatcaccaaatcgcagggcagggtgttcttgctattaatttatggcttgcactcatttgcaacattgggattaattccacaattaatcatctttcattctaaatgacagtttatttaatactatggacacattcttagtcattgggttgggaatagccttatccataattttttaaagaattcctatgcatggggtttgagcaaatactctctccgtactcgtaaaggaagtcgttttggacagcgatacaatctccaaaacacaactttgacttcttatttctataattattgaaaagtgatatatgtatacttttatgaaagtatttttcaagacaaatatattcatataatttttacattttcaaactcaacaacttaatagttactccctctggttccattttaattgatgttttggacaataacacggtcaacaagatacatctttgatcttatttttctattataatatatattataaataaatgcatgtttatttttattataatacttcaaaaagacaaatctatatatgttgttctagttccttttaactaaatatttttaaagttattgatggtcaaagttataaaagtttaacttgagagagtattcatcatttatattcccaaggtttgacttcaaaattgtcctaaatgattttctttacgagtacagagggagtattgaccagactattagatcatttagtgtgatcgaggaatatagtacataattatcggcaaatccccggatccctccgtgacctcccagcctttcgcaaattttaacaacattagctccaccgtctctccgactcatcttgccccttttctcctgtggctcgtcatcaaagaggggtaggagagggcttgggtctctctactcccctagcagtggccgttgttgttctcaaagccagtttctcctacgagctaggttcttcatgttctttgttctcttttggttctcgaggtggtcatcgatgttggctaccctcgtcccaataatgtggactagggttcccgatcttccgaaaggttctgataaacagttgatttgggcggagtcgcgacacaaatagatctggcttctgaacgaacacgctcttgagccctgcaatcgcagcaccacgtctcctctggttatcaactgtgtcgaaacgcggttgacctcgccgatcctaatccctgtttgtgaatcgaagaacacaaacaagaacaaggaagaatacaaccaaatttgcatatgagtgattaagctcacaagttggggtcttacaaaccgaactagcggcgaaactgttcttgaaagaataatctaagcaaaacccaaaccctaaaggtgatagcgggtacttatatatagagtcttgggtcgtacaaacaccccttgatgcaaccctaatgggttccaacacgatacacggcccaaaggcccacatacggtgatgcagcaccgggacagattctggacattaacttgttcggttgattcccaatgactcggaaagaattcggacatggaaccagaaccattgaaaatgttatcttcttagatttctatccatataaagaacaccccaatccgagcacgtatgtgacccgggcgcccgttttagtgcagactggtcctggactccgaaatatactcgaagtcgacttgatttgggcctccatcttgacttggacacccttgctgattctctatggctctaagtccctccctaagtgtctccttgtcctctccattgtttctaatcattaggtagcaatctattcttaaaatcatataaacaagaacataggagcgagctcacctctaaattcaattggcgcgcgcgagctcttgtaattggtccttgaataactggtggaggattgttgtgtgtatccgaaggagtgatgtcctcatcgcccaacctctcggtgagtgttgtcaaactcttttcaagtgacaatccattgcgtctttaggctactgcttctagccatcagctagctagggcacctttagctatgtaaagaaaggttgcaccagcctacaacaatttctccgacgagtacttttgtcatgggcattgggccagaaggcagaggcccataggcaatccatattaattatattagagataagattagattatgtccttacttaggggtcaagttggtaccacgtatataaggatgggattgtgtttattatgaataaaggaatgaatatcaattagtctaatctctcccttccaacaatgttcttctccctagcctggctatcttggtatttatcccgtcatggcctcgggtcatggcaacttggtatcagagccactcaccatggctttcgatgccgagcgagttcttcatgtcaccatgatcaatctgctctatccagtgatggaggatctactccatcaggtgttctatgtgtacgggagcgaagaagatctacatgctccagatgggaacacatgtggaggcttcaattaaattccaatcccatgcggatgcagagaatgcacgaaaagccttccatggctgttgtaggatggatctccagttcgagcagacccccacaaccagcaacaactcgtcgtcacctgtctccctagtcatgaaggacttgaaagcagacattgaggagttaaggattgttctaaaggaattggcaaccataattcaggagaaattggcgaatgaagaggagtggcatagcaagcaagaggtggcagaggagatgcatgcggagatggacgtggcagtgggcatggtgatgccgtcgccaatcactgtgcctccaactcagccagtgggtctggagatatgcgtaaaacgtccgtttttttgacaaattgacccttttggaaaacttatttcgaaactaacccctgccaaaaacttcaaccaaaactaggccgtcggctcagcgccaagcgcattggcgctgaggttggccgtgtcagcgccaatgggactggcgctgacattgtgccaccgtggcggccgggccgatcccctagctgacgtggcagctacctcagcgccaaccgcttcggcgctgaggtgcccaacctcagcgccaagtaagttggcactgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccctaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaaggggtgcagga

SEQ ID NO: 47074 - DNA, 2522 bp, Oryza sativa
  unsure (1)..(2522): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctttttttttttgtttcttaatcctggatagttctctatagaaataaagttccttgtctctaattttaggccactcactatttatagagttattatattcatctgctatatctcttaatttatcttcataatattttatttcactttcatgatctaatttttccatcaattcagaaatactatgtcttctgttatctataatatttctgtcagatgattctgcatccaaatcatccgaagctctggttttataatttgtaaatctaatactaacattccctttgctatcttggtaacttatgaagttttcaggctgactcaaggttttattttttataaattcactaattggccatttttctcctgctctttcttcagagtctattgttaaagggctcatgaattttattcctttagaatgcattttttctatcaaatcatttacattgattttgtatttggaggcacttctattagtcaatcttcctataaattctatacttattaataaatttgttcctttaaactcttcgtatccttttgtttgaaaaccaaaactcattttatctatgaattcatttacaggcatcattaaatcaggcactatataggttatcaacatattttcattcatatctccttctagatagcctaaagatgctttgtttattgtgtcccatcttttatctaataaggttattaacactttagctcctaatttctttcttgtcattcctttgattcctattatgtacataccttggtgaatatatttatatcctgaatattttaaactattttcaaattctttagctactatttttaattctactggttttgttagaacacttaattctacatctctagatattctatatagcccattcttattctcaaaaaatcccatgcagtatacttgttgaggtcttattgcccttaaagtatctcgttgatatctttcgagctgcttatctacttgtgcaacatctttcagctcatctatgtcatcatatttgcctttttgtttatcaaaacagttatcgtctctgcttgctattcttctaaagagactcctagatatgtccatttttcagaattaatggcttgtgaagatgagactatgccggatgaagccaaaactatttccttacctttactagagttgattttgtctggtaattctttaatataatcactattctatgaaattttattttgccttatcttataatcttctaataattctaatgtagtatttagcttattattaagaaaagaatattgttctacaaattgcttttgttctttatatatatcttctaacttttgctctaaatcttcctgtctcttaccccaatttatatagaaattatatattaaatctacaattaaatttagttggctattattagagtgccaactatgttcttcagtatggcttaatctacaccttatattgatattatctttgatatttattaactttccaatattagcttctaaatttagcttctctatgattactaggctctgataccactttactaggactaacactattcactactattcttagtgctgaattcactattatgagtagcagaattactgttcacagtcgttactgttcacttgaaaattttctttaaatttttaggatctttgcagggtggcggatccaaaaacagccggcgcttgatttagaaattttaaagtcctactcggtactagccgtatgcctcacttatctgcctatttaagcaaccatcttcaagtatccctagtcatatttgaactagctaagtgtttaccgtctccccaggcagttttacccgaggggaacacttctctacggatactggttctccagacgcctatacaagatgcaggttaaaaacgagaacaaccgagaggtttctcctatagggtccctagcataaacgcttgtctagagtattttagattttatatatatatatacacacacacacacacacacatacatatatatatacatacatacatacacatatatatatatatatatatatatatgtacatctagtacatatatatgtatatgtatgtatgttgtcgcgtgaataatccaattattttaggtaaagcaagcatcggtaaggttgtcatcgttgaggttggggctgcaggaat

SEQ ID NO: 47075 - DNA, 1885 bp, Oryza sativa
catatatatatacatacatacatacacatatatatatatatatatatatatatatatatatatatatatatatatatatatatatatatatatatatatatatatatatatatatatgtacatctagtacatatatatgtatatgtatgtatgttgtcgcgtgaataatccaattattttaggtaaagcaagcatcggtaaggttgtcatcgttgaggttgggccattacattaaagatgttccaattttcacccgttgcaacgcacgggtattttgctagtataattaaaagattgtaccagttaggctattactacctctatccatattgataatactattatactattgagagacgtctatgagatgggataggaactcagactacaactctaaacgataattttcttattttccataaacacgtttcccgatccgttaaatatcactccatttattccaaaatgtaacgattttaaccttttaaaggttgtctcaaaatataacaattttcccatcaacactctttccaaccaattacaacatttcaccatttaattttcacacaatactttcaattcttatccaatcacaatctttctctattaattctagccaattttagtaaccgttatattccgtagcagaggtagtatgttttttctaaaaaatatcgaaaagtctcttttaaaaaattaaataaatcaatttttaaaatttataatagttaatattaataaatcatgcatcaacgaatcattatgttgtcgtgttgctaaactagcaatagacacgcgctacgctgcgtgtagacatggatagaatcgaaatgagctcatgacatgcaacacataaattatgttcaatatatattagtagttttaatgtacaatatatacgctgtaaaaaattgttacaatccaaaatacgcatgacaagcatttagattataaacgaacgcccaaacgtctgcttgtttttgtttgtttactaatacattgacaattttgaaagagaataataagatcttgatggggcacacaacccagtttttttttttttatcaaatgcacaaacagggcctatttacatgctttacctgcaaacacaaaatagcaatcaatacatagcatatattattttgtctgtattattcttaaagttaaatattatcttgactccatcacacatatatataacactgaatgataccccgcgcgttgctgcgggatatttgtattgaaatagaatttaaaaatctaggtacactttgtgagataaaaacaatagtatgtaaagaagggaaattgccgcaatacaaactgcggtctgaaattctggatgatagtggggcaactttttgcacaatgcttcactttcagtgcattgagagttgagacctcatgtaaaacagcacgatagtacctgacagaaaataggagtatatttatttacgatgaaccaataggataaggttaatggtaaagtcagtggcaagagctgaatggttgtatatgttttttttctcatctgctgtaggctagctattcccgaactcagtttattatttatcaaacgctagcttccaaacctatgggggcaagaagaacaatactgaaaatactcgatatatatatgtagtacagatggaagtttgaagatgataatcatatctaaaaaaacaaacaggattcacctaagatacaaagacatgatggtacctcatatgaggaaatgggattcatgaaaagttgataaattatgcagtttctcagtacatgaggaagataaacttgatatatgaatcaatgtaagtttgagataaaatagacagtaacttatttttaagttaattagagaattttgagatcatactattatgac

SEQ ID NO: 47076 - DNA, 10534 bp, Oryza sativa
ttgaatcactaaatagcattcagtgataggaattatctgtagtgattcagtgaagcaaatgtactactaaactttccatgttacattatagaatactaaaaccttaaaatacaaaggtgcttgacagatgcaaggtaacctgaataatcacaaaataaaaaataaaaatggaaaacaaaggagcataataatagaaattgtatagttaggggaaaaatgattaaattgttacgtattactgtcgaagaaatttccccacaatagtccaacaacatcgataaaatggttgtggattatttaatcctgtaataaacccaagacgaaatcaaagtagttaatcctatgaagaaattgaagggaataattaaactgttagtgcaaatactgttatacagggaaaaaaagaagggatcaatttgggatactgaaatcggttggaaattcataattgaatcacgaagaaattagtgtgattactcaattagcatcaatcaatgtattataaaaagttttagctgaatgggaaaagaacctacgcaagcagtggaacaacccctttgttggaagagccgatcaatctacagatgtggttatatggaggagaagctacttgctggcggagcagagatccagggacgactgttcttgtatggagaggctgcttgttggccgagcagatcgatccagctgttgtgtaccacttttcttcaactgttgtgtatatcatcatacataaataggattagaaaaaaggccagaataatgcaagtaacgtattgtttcagaaaatgaagatgaatagatgggactgttccaaacaactaaaggatagttaaacattagattcagggtgggcaacagccaacagaacagactgccaccaagtctaattgctgcaaagctctaaatgactaaataacaaaactactactcaatcaagctgcaaatcaccacacgaatactaacttccattctaaatatcttcaagattgaatctttacaaagaacagcatccaaaagctcatacagacaccacatgtacactaaattctacccaaggcatcgtcaagattgaatctttagagttcagtatccaaaagccccagatttaacttccaaccctgcaatacccataccataaagaactcctaattacacactatagttttttttcccatgtacttgtgaggaccgcgaaagcagcttcacccaaggcatcgcctgctgctgctgctgttgttgctgctccttcttcctgcgcgagctcttcgctgcagcgatggccgtcttatccccttcttgatgtgcaacgaagcatcaaaaccctaacagctctatccaacaaacccatgtgcgtcccaaaaagaaggaaatccctcctcacctctcttggccgccacatcctcgcccgagctggcgctcttggcggacgcggtcgctgccgaatcctccttgattctcccaggcaccgacgtgtcggcaacgtgggcgctgcctccgcctgattcaaatcggattaaaaaccaccccgatggaaaatcaaatcaagaagaatctccgatccataggaggaggaggtgagaaaaaaaagtctctctcaccttggggcgcttcggtggagggccggaggaggaggaaggggacgggagaggagcgctaggatgcctcggttttccgtttcttgctgtgtgcgcccaccgacggttccgtttctccatacacgccgaggaggcggctgctgggagcgtgaagcacctgtggcgctagggtgcgatgtcgcggggaggagggggaggggcgactgcagcgccagggctagggggaggcgatgcggccgtggggcgggggcagggcgaccggccatcggatccgtgcgggggttggccgtcgcccgccggatcccgtgcctccatccccaccgtgtggaggaggccgccacgcgccgtcgcctatgcccaccacctccaccgctgtcgccgtgcgccgcagtgcggtcggggtcaccggatccggtagcctgggctcgtcgctggcaaatctgatggcctcgcttgcacagagcggtggcggcggcgcagagatgatggacggatgaaggtgtggggcggtggcacgcgtgaaaggaggaggaaaccaagagggagcaacagcagcgacatgacgacaatggctggaggagggcaagactgcggctgcggcgacggcgacggcgacgacgtgcgtgagtggaggactgtgaggcggcgcaggataagaggagggcaagagcaaggcgacgtagcccaggggagcgatgcggctagggttcagtccaggctagggaaatctgcaccgtccgttcctgtcacgccctgaagttcttctccctagcaaaaatccaattgataaattgttggaagaaattatttgtttaaagacaagagagaaatcctaaattaataaatacaaataataatcggaatcgacatgtggaatttttcttggattctacatgtcaaaatatgctaacaggaattttagtggaattttcagagcattggaaataattttaaccaattaaaataagcaatgtgcaatatttaaatcccgggaaaaatctttttcctttttcttctcttctttttccctttttcctttgttgggccgtcggcccactcatcccgcgcgcccgccctcctctcagctgggccggcccactccctccctcctctctccgggtcaccgacaggtggggcccacctgtcggccccttcttcctcctccagccgatggcaccgccgccgccgaaaccgccaccgatgccgccggtttccccgtttcccgcgcccactccgcccgtgccgcacgcccacgtcgccgcccacgtcccgccgtttcccgccctcgcgcgcgcccgagaatggtcggattcattttgaatccctcctctctatttctctctccacccccacgtcgccggccaaatcggccacccccccggccgttccctcccctccctcgcccataaaacgctcccccgaacctcctctcgcgtttccctcctttgttgcgccctcccgtgcttcctaccgccgccgcgccgtcgcaccgagctccgccgcctgccgccgccctccggtcgcgcgccgccgctgctagagccgccgccgcgcgaagccgtcgccaccgctagcttcgccgtcgcgggggctatcccggccgccgctcgcttgccgcgcgccaccgccgcaccgctctttccacgcgccgccgcctccaaccaccgctagccgttgctagtgccgtcgccgcgccgctccgttgccgctgttggcctcgcgagatcgaggctcgtctcgtccatcccgcgcgccccgctgtccgtcgcttgccgccgccggccgccgtcgtcttcacccacgccggccgaatccccggtgagaactccctccccttctcttcctctcgcgcgcgccgccgctcctcgcgtgcgcgtcgccgtgatgcgtcgttgctcgcgtcgccggccgccgtcgtcttctcgccggccgccgccgtcggtggccgcttgcgccgccgcatcatctaaccggccggccggtttgaagccgagccgggccgaccgggcgcctcgccgctccccccctttgtgacactgcccagtgggcccgcctgccagccgccccctctccctcccttagtgccgctgaccagtggggcccgcatgtcggcgccgccccacccttgctgacgtcagccctgggatgaattattgcgcaataaattcattaaggtttttcttttatagtaataaacacagataatcttctaaaaatcataactaattcatccgagctccgattaagtccattcaagtctcagtaaatcaagaaaaatgtgtagaatccattaaaaatggttttgttctctgttttagtagtcttatagcatgttttgcttgtgtgctttgtttgtcgcgtagatttcggccatttcgtcgatccgcggttccttgaagacgttgctgtggtctcatcagtgcgagagcaaggcaagtcatgcattacaattgatcatattgtacataatttacaaatgtcccgcatttctattaaatattgcattattttacaatatcatgtgggatgggtcctattactcagctatatgttgtttcccttgtgccattgataacttgggtatcgaaatgactagatgttggtttaggaaatgcttagccatgcctagttcaactagtacacaaaaggggaatcacattaatgcatagactctgattatcggcatagctttggtttagtgctaccgtaatggtgttggttaattaaaatacactacatggtgggctgtgggtgcatggttttgctagtcgtgcccacggcaattaaggaccagttcgcgggatgccctggaagaacttatcgtacttaccacaagccagcgtgggcaacggctaggcttgtagtgtagcttttctctagccgacgtacctaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcttgtcacggcctctttctggtatgtcgtggtggcatgtcggcgtacagaaacgtgtcgtggggctgtgtcttgtgggtacagttgtacacctctgatcagagtaaaactattcgaatagccgtgcccgcggttatgggcggtcgaccagattcaccgtgattagtctcacccctagttagctaatgaactggcgtagttcaggtggttggtcgggcctgttgcaacgtggtgtagcgttggacagtgactggttaatactgattaattactacaactgttttactgctttcaactactgcttttaatgctagctttatgcaaatgagctctttagcctaccttgggtatatcctgcatcctacctcctcttccggtatgacttgctgagtacagtgggtagtactcagtcttgctcttttttcccccacaccagagttgaagtccttctcagttgaagatgtcttgaagaggttggtttcgtcgttgccgtcaaggatgcctgtggaatggagtcgcccgctgcaggagtcaagtcttcaggcttagctcgcttttatcttttccgctgcatttgtaatcctttttatatttttgtaagacgtggatctgtatgtcaacaattgtcgtttgtgtaccctggctggtcctggacaggggtttaatgcacattcagcttagaaattctggttcatgaatttctgggcgtgacaagtttcccgacccgacgattgcacgggcgtggaagggccggcacaatgggacacgtattctaggagagatcggacggtggacggtagcgatgactgatatgtaattaactggaagtacagggacttttttgcaaaaactacactcatataatctcctaagtgcgggggtttatttgcaaaaggaaccgctgacgtggcatgcctaactctccagcgatcccacgcgctttaagtaaacaaatattacagtttggagctttttttttttttgagagctatatagtttagaactcaatctaagtgctcatttgatttagcgtttgaaatgagaagacctattacagcatgatcaattaaatattaactaccataaaattaaaaataagtaacatccaaaccatgatgaaaaatatattgtctaaattttataatataaagaatatgaaaatgatagatgatttcgggcctgttcactttgatgctattttcaaccataccattttttggcaaagttgcatacatatatatatatatatatatatatatatatatatatatatatatatatatatatatatgtgtgtgtgtgtgtgtgtgtgtgtgtttttagtttgttgccaaatttagtaaatacataaaaaatcctgtcaaaattttggtaagtttttttttgctacaatctgaacatacccttcattattgcccacggtataagatgagcttccttcctcgccataaagggcaatagcagtgcatgtatcctatttgagaagctaaagccccatctagggcctgtttagatcctccaaaatggtaaaagttttgccattttagagtactttgtgctattttggatctaaacactagtagcaaaagttagcattttgtcatttgtcatttgctagtctagggtagcaaattttgccaaaaagtgctctaggaccgcgcgctctctctagtactaaaatggcaaaattttaggatgcatctaaacactccatgctaaatcttttgccactaaaacttttaccatttgctattccaaatggatctaaacaagcccctagataagaaacggtgtaagaaataccctccacagtgcatgtggtcttaaatagaggtctttcttacttattatagtgggtcccacctttctcttctttctcacttttcatcttcccccctctctctctcttccctttgcctttccccactggccaccgacgagtgaggcgtggactacccaagtggcgacgtgccaagcggggaacaaagcagctgcgaggcagcaccacctctccggacgacggcgccgctgaggctaagccacatacgacggcaccgccgagttcgatggatctgaagtcgggtggtggcggcgatggctcatcggggcacggctacggctcgttgggaaggcatcagcaatgtgaaccactgctagagtgccctcgctaactaagggcactcctagaggaactcatctgctaatagaggccagaggtagttgggttcttcaaaatccgaagctattcggtgaggatactccaacccacaatggatgtcccggcctaaagtagtcccaggtgacaaaatccctccctagcgctctcgctagcccaccgacgtcctcgttgacataaaccaataatgatataacactataggtttgctttagtttgggtagaaaaccaaagtgaggcagtaattatatagtaccacttttgattcgtaccgaatcgagtgatgggccaacatggatttgtttttcctttttacaaacggttttgctatttcacctgtgacagattttttgggcttatgtttcgattttttttccatacgatttatatttctctagatcttttgggcttctatgtttcgaattttttgtctgcagaatttatatttctctacatctaacttttccatacgatttatatttctctagatcttttgggcttctatgtttcgaaatttttgtctgcagaatttatatttctctacatctaacttgcagttacactcacttacagtgtatcaaaattatatttttacaatcgtttttctctagatttacgatttttttatatgcttgtcctttttctgatttaatttaaacgggccatattcgttggttaaaaattctgcaagatttaaaactctaaatctgtcgagagatcatgagaagatcacgtagttccttaatgtgatcatcccatgtacattttcttccgggcatacaaaaaaccaactcttttttatagtatatcggttactaataagcactactaacactgcgtgtatttaacattaagatgacatattataactgctactcaactaaataagattttccacgttactaattaaccgcacgaaattaattaagccatcagcaagccgctcgtcgccgtcgccgtcgtcgtcgttccagcatatcatctgtgccactttcaacgcatgcagttgcagccatggtgcctcgacctgccgcacttcctgcacttgccatggagcgcctcgtcttctctgcgaacgcgctgcgcctccatgatccgggcgacgcgccacacgtcgcgcatggtggccgcgcccgagcggatggcggcggccgcgttcgccgggagcaccgtctggcacagtagctcggcgagctcggcgtcgctcaggctcagcgtcaccctcgtggcggcgttgagcgcctccgcgcgcgcgatccgctccagcagcggcgccggcgcgccgtcgagtgcgaggtcgtcgtagagcatcctctgcgcgacggcggaggcggcgtccgcgttgtcgtaggtgcgcgccacggcgtcccacgcgtccctggccgtgcggtggcggacgtagtccgggaagatgcggtcggagagcgcggcgaggatgtggccgcggcacaccgcgtcgtcgcgcgcccacatcctcctcctcgcggcggcatcgccgtcctcctcctcgaccccggccggcggcggcggcgggggatcgtcggagaggacgtgggcgacgccgacggtgtggaggcggagcagcatcgactccttccacctgaggtacccctcggcgccgttgagcggcttgacgttgacgttcgtcgccgccgctgccatcgccctagatcaaaccgagaacctggcagagacaaaccaaagcaggcgtggcgtcaggtaagcaaacaatgagactcgaagcggaggcgcttcttgctcctctcgagcatttgcacgaacaggtggtgcgcgtacgagctggactccggtaccgatcgccgtcgatgttcgtgcaggtgattgagaacccgaggggcgagggcgctgttggcgaggaggaagggataaatagggagatattttttttccaaaataaataagaagcagctcccgatttttctgccagattgatcaagtgccgacttcattgtagattagattgattcgaaacaaagtattaaaatgtgacacgttactatgagtctggacacttgttttttataggacggatggagtactctcctagtctcattttaagtgcaagtgttgatttatgtgtttatgttctcttttttaattttttttatgattagtatttttgtggttattagataataaaatatggataatattctttgcgtgacttaattttttaatctttccataaaagttttaataaagcatgggacagctgcacttaaaattgacggggagagtagcgacagtttgtttcaaatgctagtgcggagtagtagtgttcagtttggaaaacatacgaggatgttggacaattccgtgagtatctaactaaatctgatagttgagaattttgtttgtaaaggttttgtaagcaaattttaactacgcggagcagtgctcaaagatgtaacgtgccaatttgtctgtgaaagtacttttgtaatcttataaactcatgaaagttgataaacctgttgtagggaataattatagcaaagttttttttaagagaattatgagcaccccaaatttatttatgaaagaacgtatatactccatatagatccaccataattatgttttggataaaagttccctttttactggttattactcccttcgtttcagattataacatgttttaactttggtcaagcttcaaatttgatcaagtttataggaaaaaaatagtaatatttccgacccaagataaatttattataaaaatatatttaactattaatttaataaaactaatttggtaatactccctccatctacttttgatagtcatatttcatcttgacacacagacaagaatatgtaattctacttatcatccatttaaatatgctactagttattcctcgtaaagaaactattcattaatatttatatttctcgatgcccatggagccaatcttgtgtgaaagaatggagagtcacgcattaaatctaagaaattcattcagatgtaggttgttggattgaaatatgcctatcaaaataaatttttcagatttggaaatatgcctatcaaaaatagttggagggagtataaatattactatatttatctataaatataatcaaacttaaagcaatttgactttaaaaaaccaaaatatcttaaaacctggaacgaagggagttataattaacagcagcaaattaattaagccatcaggaagccacgtcgctcgtcgccggccgtcgttccagcatcgatccaaaagcaccatgatcaacccatgcagttgctggtatggtgtcccggcttgccgcacctccagcacctgccatggcgctccatgtcctccctgcaaacgcggcgcgtctccacgagccgggcgacgcgccagacgtcgcgcatggtggcgccgccgccggagcgcgcggaggccggcccgcccacgctctccgggagcatctcgcacagcgccccggccaggtcctcgtcgccgagcgggagcctcgtggcggcgttgagggcctcggcgtgcgcgatctgctccagcagcggcgcgttcgcgtagaactcgaggtcgtcgaacgccctgcgcgccacgccggccgagagcgcgcccgcgccgtcgtaggcgcgcgccacggtctcccacgccgccctggccgtgccgtggcggacgtagtccgggaagatgcggtcggagagcgccgccaggatgtgg

SEQ ID NO: 47077 - DNA, 5180 bp, Oryza sativa
agcatcgactccttccaccggaggtactcctcggcgccgttcagcggcttgacggtgactgccgccgccatcgcctcgatcaaatccgcacctgacgagacaacaagagcaaaccaagcgtcgcgtcagcgtgagcgaaccgtggaactcgaaacggaagcgtttcttgttcctcttgagcattttcacgaacaggtggtgatcatacgagctgtactccgatgcggatcgacggcgatgttgatcgggaacctgtgtgttcgtacttcgtagttgttggcgaggaaggggataaataggctgttcttctgaaaagaggtaactgccgatttttctgccagactgatcgagtgccgatttttattttagatttaaattgattcaaaacgccgccgatttcggtctttcaaaatagtgacagtttttgtttgaaatatttagtttggaaaacataaaaagatggtatgtgccgatttgtttgtaaaaagcacttttatagtctcattaagttatttatcaaaattataaacttgttgtaatgaataattatgagcaaagttgtatgattatgttggaaacagagcggctggtttcaggaaatttcaattggtctgagagagctgtgaaagttctgaaaatgtttgaagcaaaagtgtcacacaatttcataatattttggacggaaagttccaatagaattgccgggttttatgttatatacgaatgagttctaaaaaagaaaaagttacacaaatgaggaaccggcccaacgatggcgggaatgacattacgtttccgggccaaaattgaagttaaatgttttacagttttccgggccaacattttacggtggataagttcacactatgtcccacaatttgtcacccagtttgatttttgtccttgaactgaaaatccaaacacaattcgtccccaaacttataaaaccagtgcaaacgagatctctcgatagtaagttgatgggctagtcggtacaggctcaagcatcaccatctcttaataaataaacatcgatataacgtcgagagcccctactctcatatccagcttaataattttcctacttggcccctgaaactgctagctggcacacatgggatctgtttggagggaggttctggcagctgcagcttctcctaaaatcttcagctgtaagaatctctctcaaataatctaaatttttacccagattttaagaatatatagttgtagaatctaaaaaatgaactagaagtcagaagctagaaaacttagctttttcatattcttatcagctatttctcgtaatcttcaactccctaaagccttgtttggttacgccgggatttaatctgggccgggaatgaaaagtatagtaagaaatttatgatagatacaatgagagatcgatatttattccggacctggaaccaatttactcatgatagggacaataagagaccgagaatcaatccactagttaagaggtgtggaaacaatccggatattttgttgtcttgtctctattatgagtaaattggtttccgacccgaaataaatcccggtccctcattgtatctgagttgaggctccccgcattctatacatctgttcatttcactcattctagatttctgcatatatactccctttctgcacccgtgctgccaagtgccagccactactgcaaactgcacccaccaaacacgtccactacgtacgtaccactacccccgccgtcttctccttctccactgcgactaacaaccataccccagcttctctcactctctcttcccctacaccaattcaagataagagagccaccgatcgatcgacgtccggccaggcgtcgacggtggtgccggccccggcctcatgggggcgccggcgaccgccgccagcggcggcggcgacgacgacgacagagacgtcgtgttcgagtacctcctttgcacggaggaggacgccgcctcggccgggtccttcttccagcagctacagggcccggcgcccgccgtgtcgtcgtcgccatcaacgacgacggcgacggcgccggctgctgctggtagctgcgatgatggcggagaggaggaggaggaggaggtggggacggtcgacgtcgtcgcggagctcatcggcggcgaggccgagcgctcgcactcgccgcgggcggactaccccggccgcctccggtccggccgccccgccgacctcgccgcccgcgccgactccgtcgcgtggatcctgaaggtgattttaaacctgattaggagtactaataatcctaattaaattaaacctcagtaactactccctttctgcttacattcacatagatacgagtgaatatgagaaatgctagaatgacttatagtgtgaaacagagcaaataatggacaaagtgtatgaggattaattaatacaaaacacaaattattagcagtaattaataatacttgtgtgcaggtgagagagttgtacggtatgcttccggtgacggcctacctcgccgtcagctacatggaccgcttcctctccctccaccgtctcccggtacgtatcttatacgtgcgtatatacgtacattttgtacgtgtgagttaatcattatctcaacccatgcatatggttcgttttgggctgtgtatatctttctaagtagaggccgggttaatataatccattatctgctggactgtcgtatatatgtatgtatgtacgtgcgcggtgtgcgtaccctgcatatgtatcgtccatcttaaagtatactccctctatttttttaatatatgacgttgatttttgttatagcctttgatcattcgtcttatttaaaaaatttgtacaaatcttaaaaatatgaataatgcttaaagttcagttagcgataaatcaaaccacaacaaaataatagaaatttactttaaatttgttaataagacgaattgtcaaatattatataaaaagttaacgaagatatacacacacacaattttgcgtggtttattgtctacaagtaattaagttgaatataatgtcatagaagtaggatgttcggcaataaatttagtctaagtttaatggtctaagaactaataaattttactgaaaattctaagtttaattggctttagagcatgttcataggtaaagccttccatttagatactattgtagacgataaaagctctaactaaaataaatttgtattaattacctttctttcattttccctattcccatatagtaaaattttctttcacaaacgttagaagttcatattaagatgttcagcttaatatcgatttttctctctcgttttccctctcctcttcatgtcaacaatttaccttattttccccaaaaaaaaacaaattaccttattaacaactggagtataaaacctgttattatttgttgttgtacatgctcatatatgtgtacgcgccacgcatgtctttttaagtttggagatagttgcttaggtaggtcaattaaacaattctcagttaagataattttggttgagtgagcactcgaaagtcgggacattgaaattggattaattagcttgcggaccgtactttgattaggccaatcatgagttcattttcttttctagtttaggtatacatgggcacttcacgtgcgcacgcacgaatttttttatttgttgaacctttttacttttttattttaaaactaaactcttttgaaatttatttgtaaatctgaaccttttgaccacgccagctcgacaaaacaacactggcaagccacctgcagcgaatatatcagttttgtcctgccacgtcagcgagagtggcgtggctaaataacgatgccatgccgtggacaaataacgctatcacgccagcaggagcagcgtggcggtataattttgccacgccagtttggctggtgtggccaaaaagttcagattttgaaaataaattttagatgggtttatttttaaaactaaaaattcaaatggttgtgttctagcactctgaatatctgattaattagaggtttaggtttacatggcaggcatacactttgatcattgaatgcaccaacatatgtatgtgcttcttctcaggatttaatcccaaggaaaatgtggacattcatatgctgaatcagggacgagatagaacctgtgggatgggctggttccatgcacgacaaccacaaggatgaaggatcctactccctccatttcaaaataaattaatttttaaaatttaaattttatctcaaaataaattaattcctaccaatcatggttcatgaatcgagaaattttgtccctcaattatctctcacatactcactcatgaatattgcttttctattaatgaggggcattatagttttttatcctactaattttaggaccaagagagcaactagctgcactagcaacactcgatttataataataaattattttttatctttaacaaaaatataaccatacgaacatttttatgcttggataaataatattgcattattatgaagttttataaatatattacaatataaatgtcgcaaaaaatgcactttacaggctgtgtgttgatgtccaaaatacatatagtcccatgaatataacttcttagccgagaacctggagtaaccaacaaaaaccatgtagtgcaatattactaatgctagcagacataccattaatcagagatataaaacctaataaaatccttgcactccctgtggtatatgaaatattgcgaagcaacattctttctaatcatcataaaggcctggatcacataacactaatattaactgctcttataggacagaaccataatattaactgatctgcaacaaattaatgtccctcttaatttccttggatagtaccctctcaagctagctctcataacaaaccaattaatccaacaaaaaaaaaaggctctggaagctatcatgcaattctatatgtgctggtgatcatgtggaaatcaattaatatccatgaaattgaatctacatggtacactagtacaaagcccagctataaggtggtccattaattgcacatacttcatttcaagattaaaggtgctcaccaggaccatatatgcaatgattcaattgatgcatgactcatcttgttcagttatatacataggagtgtatatatcatg

SEQ ID NO: 47078 - DNA, 29520 bp, Oryza sativa
agtttcagtgattaatcatcgtgagattctcgcgtggtcatcactagatgggaatgtagtgtcctgataaccttcaaattaaccttttgcctctgtcttgtccgtgtaggaagcaatcatcaggtgctaccggctaatgcagcaattgatatctagtaacaatgttgggagagaatcgacagagataacaatggcgacgacgacgacgacggcgacaactgctgtgagctcagaggaggttgtgtcctcttctcccccatcaaagaggaggaagatgtgaccaggcacatgacagaatttgatgcaacattgttaattttcagtgattattcagcatttgtgtttgtgatatacataggggtcctagtttaattagcagagtttggttttgtgatgttatgttcctgcaatgtttttttttttttttggcccttcctttaaccttcttgtagatagccctactggtacagttgagtcatcatgccagtggctgcaggttctgaactgccagtctgtgaaggaaacaaaatgagatagatttgtgcttgtccagttgtccttgctggattgtagtactagcaatgtgtgcagcaggacatgctctgattcacagaatatttacatggattggtgaatgaggccttgtttagttacaaactttttcttcaaacttccaactttttcatcatatcaaaactttcctacacacataaacttctaacttttccatcacatcgttccaatttcaaccaaacttttaattttggcgtgatctagacacacctggaaagggcactggagtgagctgaaattgagctggtcaggcataaagtcaaggcttggggtcagatactacattgttggctactccctgccaagatctgttcatgttcatcagggaaagtctgtctgctcctgatgagtgatgtgtagtttttttattattatttttttggcttgctcctgtgtgttatcaagtgaatccaaacttgaaaggggaagcataatgcctgtactgcgaaaggcacatgcagccataaggctttgtccatctcctgctggctcattgtgtatttatgtgcaaacaaagatatcagggcatttgggggacttgccataattttttgatatctgtactttctgtattggttatcattacattcatcgataagaatcgtacatctatctatacctatgttaatatggctatttcttatgagctttcacattaacaaaacgaccactgattagaatgatcgaattatcgtgcgtagatcgtgttgggagtccatgtcaaataaatcacacaattgaaaatagcatacactataatttaatagttctgaatttgtaattaataaatacattctatattgtatccatcttggatctcaatttaatgctctattaatttaattctcaaatctgaaattaataattattaagttgtaattgaatggtcacatggactccttttttaatataagcacatataatttcaagagcaattttatagtatttgaggaggtaacatgaggtattactttttctattgtaaatttagtacatcttggtatctatgtactaggaggtacaaaactttacactaaatacctcataatacttactcaagaaccgtaaaattgctctgagtacttgagttttccactcaatgagtcccttaatagggatggcgcctagtcaaaatggtgagatgttgtaaattggtgaaaaacaaagtctcggaattttcaacaaagaaggtaaaactaaaggtcataagggagaaatgtagtatccgtatatccataaagtaacttcaagatgaaacctactcatatttcatagtaaaatataaaaacaggagtaaattgcatattgggctatctatggttaccaagttttcacttcagatcatcctctcaacaacgttttcacttcggactaggaataattacattttgttacaatttggaccaccccatcccactccaactctttcttcttctcatgctctagctagttggtgtccacaactccaaatcgagctttggcagttcactggcgagctggtggtgtccacatcgtggtgtaggcaaaggttgggcatgaacaatttgagcagccaaagtgtgggaagaagaaatggatggagagggtggtccaattctagctagtccaaagagaaaacttggttaaaggattactccaagataaaactttggtaataataggtactctagaccaatgtgcaattcacttaaaaaatgtttgatgaacagaggacaataccattcatgaagtatctttttgttcatgtcttataaaggaggtcaagattaatcttgcactttttgaaaatccttccacatttaccctagtttgacaagtagtcaagtactccaatttacaataccagtttggattgctatcagatttaacataccgattttggtcaagaccaaatcccaattgcaacccaaaccaaacagtggctaaagcatggggtttggtaattttcactaccaaacagtggctaaaccatagggtacgtagtatttgcgcacaaatgcattactgttcaaacatttgcaaatctgaggatgcaaatagtacttctcctggtgatcattggatcgaatagccgaaagcaaagaaacatgtctgcaggtccgtcatacatctctagtagtattgtgtgtcatcttgtgtgcttccaaaacaatggaggaagcatgcagcaaaccaactcacaaggggcgtgtgacatgacatgacccaacaagggccaaaggcagccagccaagcagggaggcggaatgacatgtttcttcccttcaatgacatatctgccgtgagggagatacttaatttaaaattggtttttttttaaactaaaccggtaggagagctgccaattatatttttaataagcaggagtaaaaaccctagacgggttacaagaaaagaaaaaccaaccaccggctggctgatcaacagttacacagcacacgccagaactcactaacagctgaaaccactgacggagcccaacgtaggatgtcgttaccaacgttgaccaaaacaacatagggggttccgactttacaattgtgtcatcgttgccgagcttgccgccaagcgacacaacagctccaacttcaaaccggatgcaccatcagaacctagatgctgcaaatgatcaagtggcttcgacttctcacgatgaacatcagtcaaagccgcctaagcgccacaatctattcacggccaacaacaaaacccttagaaagaaaatgcagtgtgtcattgttgcccagcttcgtcactctgacaaagcagctccgactctatctagcaaaatcaaacaaagagcgaggtcgttcaccgcaaaacaaaaggtggagctagaaagcgaaggcctagtcaaaacctagggctgaaaagcttcgaagcaaatgcatagaccatcaacgacatccttgcacgaagaagtttcttcaaagcggtgcccccaaggaggacgcgacgtggatcgccgccaccgctcgttcagaagccgaagcaaggttttcacctggagaatgttaaggaaaggagaggggtacgctaaaacgacgcctccaaggaggggaacgacgccaaaaggcgtcgccgtcgtcagccggccaaacggctcggcgaggctttcgccagcgattccctgtccaaagccccacaaccaatccgcacaagaaggactgtcgtcggtcgacacattgtcccttcagcgatccggcctaggccactgccacatatcttcccgccgtcgacgttgcgcctacacccggtctccttccccacctccacatgttgccgccgccgccgacacaccgtcagccccttcggttgtgatggcctgccaaccatcaccgcaacaggcgccaccgtcgccagccgccaccgccaccgccaccgtcgccatccgccaccgtcagctgccaccatcgccagacgtcgccgccagccggccagatccggcctgggtggcgcggatctggaggtgcagcgcgccgcgcgggtcgtcggcgtcgtggagggagcgtcgacgagggtgtcgcgccagaggtcatgcggcgaggtccttgacgagcccggccggtgtcgcaacacgcgccgcggcccgccgacgtcgtcgccatatccgccaccagtgccgccgccgccacaaccgccaccagcgccgccaccaccaccgtcagcccccgccacccggccacctccctggcagatctagccggacacagcacggatctggccaccaccgcagccgccacggacagctcccccggcctccgagcgcagcgtgggcgagatgaggccctgccgccgccgtccttgcagccgcgcggctttggcggcggtgaggcggaggaggaggcggggagaggaaggcggtggcgggcgcgtcacctcccgagccgcccgggggagggcgatgtgggggtcgtggattatactaggacttaaaggacaaattggttttcttgtgagttctgttctttttacctgacattctagacaacgacacattatatctgatctcaaatgtaggtatttcattattgctattactaaatatatatctacaaaaactattaaaatataattacatgaaggtatttatattaggaaaacgtaacaacctctatgtgcgcgatccggaggcgaccgcagatccagcgttgcctggcctccttcccaccatctatcctgccgccactggaaaaaccgtgcggtgagcaaggagggtggtgacaggaatgaccattggtgcccttaatctcgtacgcgggtgacgtgtggtcgtggatgaagcccgctggctgttgcagcgcggtacgatggcaaggtgggtagccagcgacagctaggataaggtggaggtgacgtgtggtggcggcggtcgcgggggacagctccatggtggcaccgtgttgccaagcggcggcaacccaacacgacgacgagtgcgccgggagacaatagccgcctatcccttcgatggattttggcatatccgagtttggatctggctatggatattgatctataagctggtgccaaattttaaatcttaaaatttgatttttgaagttttttatttttattgaagtttatttttcagcattgattttttaaatcagtaatagcaatacatatataaaagtttgattttattttattgctaataaaccgtgtggcttataatcagcaatagtcctgataactcaaagttacacaaacactctcttgtcccagaatgatgcacactgatttgtcagccagagctgcagatcaaactggggcacgggcgctccccacgcgcgcagaacagagcaccacgaagctccaaacacattcctccatcatctcatcttttgaccggtcaccggccggccggggacctacgcggcggccaccaccaccaccaccggcagcgccatgacagcctgaacttgtgtttaagtaagccccaaagcgtagcaaagtattgcaggaccaacgaaaaggtgaggctgtgctttgatttgatcttcttttttgtgtgcatgaccacctactatacctctctttgattctgcaactctgaatctgaaacgcattgtgttctgacattgcaggtttctttttttttttttctctttggcctctggggctctttcatgattccaaaagtgcaatgttgcatcactggagtgaactgattgtttgctttgctgaattgtattattggaagagttaaaatcttccttagttactaccaacatcccaccaaagaaagagctatctagtctgttctacacgttaagtacccactattacgtcacttcgaaaccacatgggactaaactacactattactgcagtctatataggtttcaaatggagtgcggtgttacacttccaatcctctatggccacgtagccttgcggccagggttaccgatttcgaggtaaaaaccggttcctgttggccgcaaggctacacaaaaccggaccctactggtttcaagaacaaaaaaaggaatggactcccgcactatctctagttctttacacatgtcatggaggaataactcagtgaaacaacgcactgtctggtgctgtttgttaaaaaaaaaaagaaagaaaaaacttagagtgactgaccaagaaatccatgatctggtctacgttcttggttcgtctaccgattcatcaagaagagattccacaccggcctagctacggtgtcccgtgatgtcggctgtcggcaagatcaacatgtatgtttcgttcagctcctccagtgaaatggccccggacagctatatagcctgaatcccaatcagagatgcagtcatggatgataaccatgcgtcgtatgcttcagtaattcagtttagtaggctcatgtgcctctgaatctctgattgggaagttgcagtaggcagacattccagtttggatgccatgatcagttagttatcaatgccgatcctgtgctgatgcagttgttgggttgggtctgattagtgtgacgagcaggaagagacatttgccagtttttctggatctgctacatcattcagaggctttgctaattgatgctgtatttctgtctccaaaaaaaaaaaaaagtaagtgaaatctttgagaaattatgtgattcttggatgcttgccccgttctttttagcatatcgacttatcgagtcatatagattattcatgccatgcttttaaaagttcgatttctgagctactttcctcgtacttaaatatgtgatactaaatttaaaactttgatcatcaataactctaaaaaaatctaaaaaaatttagtttgaaagcataaaagacatatggatagcatactaaaatcttgttatagatgtggagtagaaaaaatagtggtcaacgacgtacatcaaagatcaaaaaatcaatgatatcatatactcctatttaaatacaacgatagtactccctccttaccaaattgatcattatacaagtttatataccaagatcaagaataatttaaatcacatcaatcaatatactatgcacacattctctcacaatgcatgcatcgattaaaacaccatatcaattacaccttagcatgcatacattctcccatactgtattaattatattctgataaaatccgtgtccatgcggttatatgatgattaatttgagaaattttaaatactctgcaactcttgtcccagcccatatacacgtcattacgtaacccaaaaatgttatagtgggcttggactagcctaggttatgggccagcccagcccaaaatgcatataggtttgatcaatatgggccagtgttgttttgtgccagattcaggcctgcatttttctgccgaaagaggcctcgctgatttgagtgaaacgttaagaacacattgaagagatgatgaactgcacaaacagatgcaaaagaagaaaataaaaaaaattgttgatctcttggcttgatttacacacatcagtttcctgaaaattctcactctgtttggctaggatattatcgttatcgattatggtgatataattactcccatcaaactatcgtcaggctcaaggatggtacgtaattgagtaaggatgcttattccttgtacataacaagagctttcatgacaacagaaaaaatacctgccctaaccacaagtcaaccacacaatcttgcaaattgtcacgttattaaatctctctgtctctggtcttcttgaagcaccaagtgagcaactttttttagtgacacgaactatcactgctttatcattattttttgtttactttgtggtttgtgcaccaccaacaggcagcagttcagggtttactttttgcatgtcgacatccctaactacaaccctgacagtgatcagcaaactttcagaaacagatgtgtcaatccatctcaacctttctcaggtgcatacatgttataatagttattgtttttgtaagtgtaattttatctgaacaatgtgtagaaaaatgactagaaaacctccactttggtgcttagaggttcctttggaattgagaaatttgctgcattcttgcagaaaattggaatagttgtatgaaattttcgtagaatcattgtgttccaaaggatccctgagtttgttcttcttttctctgcctctcaagggaacaagtgcaatacataaaaagtgaggcaaaatggtatttcgacaattaaatactcaaatttccattaaataataaacaggatatatgcaagtatctactcatcagccgcccaagttaagaattaaatattgcccattttcatcatgatcttgaaacgtgccggccaaatcagttgttgtcttgagctgttgggagcatgtaatgctacatcctacatgcaatgtattatcaatgcaagatgccattttatattgcgctctttttttccacagaacattttatattacaatttttaaaaatgccgtctttgcttgaacatacctgtatgcctagtcaaagcactgttggagttgtacccatcatttgaacattattgatttggtgcttcgctacattaagcatgtgtggcaaccgaccagtcactagtactatgaaccattattctccaaaaagaagaataaaaacaaaattttctggtttaacctccatatcaatgaataggcccttcaaacatctgtttgtcaatagtggaaaaacagaacttttttttaaaaaaaaagaggtgaaaatggaacctacttattctccaaaaagaaaaataaaaggagtgaagatgaactatgttcccttgttcagtcttttcctctttccctaattcctgcattatatagattttgctggtcagaaaagttcagcctttccacaaccatgatgcattgctctaactttactttcatcaaaaacacactagctatgaacactgtcttttcaggcttttagccatcccatgattgcttaacatgcacatataggtgtgtttagtttctaaaaaaaagttgaaggtttgaagaaagttgaaagtttgaagaaaaagttaaaagtttatatgtgtaaaaaagtttttgatgtgatataatatgatggaaagttgggaatagagggaaactaaacaccgccatatatgagcaggtaaaattgaccaaagaaccaaactatcaagacattagacatgcgcatcagcagtaattactagctacagcatgcacatactttactgcatacgtaatctcttgctgaaaagaaagaagagaaaagaaaacgaagtgttcagaaatcagaattgtttactctgcccaatgcagagcagcagttcacagttcacaccacatgacatggccctgtttagatgggactaaaacttttaagtccctatcacatcggatgtttgaaaattaattataaatattaaacgtagactattaataaaacccatccataatcttggactaatttgcgagacaaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccgaaatcgcctgccgctctggcctctctgcagctgccacagcctctggatccggatctctctcccgtttcttttgccgtctctatcctgtgcagttacttcatcgcgtcaggatatgcagtgaaaaatccgctggggtgtttagacctgtttagacgggacgatgttttggactgtaattataaatattaaatgtagactattaataaaacccatatataatcttagagagataaatctattgagtctaattaatccatgattagtctatgtgatgttacagtaaacattctctaattatggattaattaggcttaaaaaatttgtctcgcaaattagctttcatttatataattaattttgtaagtagtctatatttagtactctaaattagtgtctaaatataaggactaaagttaaagttcctaaattcaaacaccaccttactgtggtggatgcatcaccaatctaatctccgacgagctcatctcattgagcatgcaggagttgatctaggggtgtgtttagttcgcgccaaaattgaaaatttgattgaaattgaaacgatatgatgtaaaagttgaaagtttgtgtatgtagcaaagttttgatgtgaaagaaaaattgaaagtttgaaaaaaaatttggaactaaactcggcctaggatggcactggaaatgttcaccaattggtttgcaaattgcaatgtacatgtgcctgcgaccttatggatatcgttggggtaaccattggttcgaaacgatccatgaaaccagcagcaaaatcgtaagaactctacataaagtgttgttttttggtgaaaatttacggaaggcattctgattcatgtgttctgaagaagactggtgcgcaatctcggagagggatctcgcatggttacatgccactgtgggctcaactgatgcatggccctgtagcatcttgaaattccattttcattctgagtagataatagattgaccatttttcctttttttttccccaagaccacatggatccaaacaacaaagaagatcacaccatgaacagtcccccccccctgttttttatactcatgtttgaatcagcagctagctgatgaactgatgatcctaccatcctagcagtagcaagcagtaaactacagcagtaattattaattaacaaccctgtgctgttcgttgcaaaactactctgaaaattctgaagctgcgagttcttcactgtgcaagccagcagctacgcttgacctaaccgagaactcttcacctaatttacatttctgatttctaccttcccaatttccaaaccaaaccctcctgtactaatcgtagtttaatcctggccgtacgatgtcagctcgccgactccgagatgctctgcagcgacggccgccaattccgccctctgccgccgccgccgccgccgctgctccggtgccggtctttctccgccggcttccgctcctgagtcaccaagaagaggggaattcagaacacaaattcagctggtcggagaagaagagagagagggagagagcaagaattgggcggagcgagtaatcacctggtgatcggagggtcgcctctgttcttctccggcggcggcggagtcgccggtctgcggttgccggtggtggtggtcggtgacctccttgcaccgccgcatcttctcctgccgcctcgcctgcagcgccttggtcacctctgcgcggacaaggagcagacacggattagattttagcctaagcctccatggatggaaatcgagcaagaagcagagcaatccaagaaagaacataatctctgattgatttgataccttgggaggtgacgaggcggtagaccttgccgaggagcagcgtctccttgggcttgagcagcttgatcttggtgatcttcgccgccgcccctccggactcgtcgccgacggccgctccgacggcggagtgttcggccttgccgccaccgccaccaccggacgaggaggcggagacacggagcaacacgagggcgacgtagtggcctgggttgctgcgcatgacgtccgccgcggtggccggccagtaaagccgctccaccttgccgcccgggtgctggatcaccaccgccgccacctccgccgcctggcaattccccatcgccgccgccgccgcccgtacccacagcccaccacctcgccggcgtcaccaatggctcccttcgacgaagaggaggaggaggaggaggtcgtcgtcgccggcggcgtgggagctgcagctgagcttgtggttgcggcggtcggggaagacggggggtgggtggtttatatcggggcgggaggtaggggagcagagcaagcgagcgagagtgattagggaggtaattaaattaaattagcctttgtttaatcataatggttggctgttagcgacgtgattaacgaaggggtcaacgtgttaattagggtaatacttctccatccacaagtagtagtccccgtcattaaataggtaagtgaatgttctaaatagattggataaatagtggaggtaggtgggaaagtgaatggtggatggttatgattggttcggaagagaatgttgatagaaaagttgttatattttaggacaaattctaagggctaaaagttattatattttgggacggatagagtaattttttttctccttccatgtgtattctataataagtttatttttaaataatcattacgttgaagtttgtagaaatagaaaataattgtattattttggtagataaagtaaagaataattgtatttagatttgatagagcagatgtattttaactattttgattttatgtttatatgtgtgaaatggatgaaaaacgaatttattttgggaaggacaaaggaggagtactccctccgtcccataagagcaagtttgatagtatagccatctactaactacaaatcatctatagccaatttaatagctcattcatataatagttatctataaaccattaatatatggtcccacatctcgcacacacacaacgtattgtagttcgtgctgcagctggctacaaatctgtagcccgcttttcttctctcttctcttctctcctctacatgtgtttgcagctgacttgtagcctactattgtactcattctaaaaaatgaatttaggatcggatgtgacacattctagtacaagataaaatgtatgtctaaattcgtagtactatgatgtgttatatctggtactctctccttcccaaattaatcatcatataatagaatccaaaatttctcaaattgatcatcatataaccgcatggacacggattaatgcagcataggagtatatgtgcatgctagagtataattgacatagtgttttaatcgatgcatgcattgtgataatatgtgcatggtgtcttgattgatgcgatttaaattatccttgatctttgtgcataaatatatatgatgatcaattcaggatggagggaatactaggttagtttttttataggacggagggagcacatgtttaggcatgtgaatgaacaggaaaaaggaattatttctttctgcccggccggattaattgatgtttaacagtgggctgcccagtggatagacttgttcttttgtttctacgtcagggcatgttttgagcatgccatatgtgtgtctcctagatagggttgaaaaatccacatggctgtatacggtgtaaaactctagttattagaagggaaaaaaaggaatgttaacatccacaatatttgtctaaggccctaagagatgtatatctagtttgcaatcgacgacgatatcgatggtggtcatggtcacatagatatcgatgttggtcttgatcatacacgcataatgtataccctacgttcttttagaaaaataatttctagttattaatatttacatgggtcccatcatcaggtttataatttagaagttgatttttttttagaatggagagagagagagagagaccaagtatagtagttaagaacagcatagccatttcatctcaattgactttctatattcttttcccccacttgttttctactaatatcaatatgattaggaatctacctgacatcaatttctaccattacattcttgaatgaaaagagagagaaaaaaatgcaattccacattttacacattgggtttttggatcttggatcacacttccatagttccatgtaccttcctcattggattcccacccttatttttctcccaaacttccaatctcagtgaaacatccacaacaccatattattctctccccacattttcacccttttgctgcctttccagtgcacaaaaaaggcagatcttaagctctccaaatggcatcgcccatcctcgacacgtgtcacgaccccactggtagaaactttaacttgccaacacccaatcaatgcaacgtgggccacgtggcaccagcgaacataccggtgggccccacaggtaagggctcccagctgcttacgtaccctagcctgggaacatacgtgtcgacgtctacgagatggccgtacagcttccatatgctcctaccgtagagagacgctattgttcactgtacaagtgacagaacgctgcacagatcagcgtgtcagtgatgttacctcggagacgtggtacttgtagtataatatacgtatatagatcctgtacactgtataaaatttctttagttaggttgtgtttaattcacaccaaaattaaaagtttggttgaaattagaacgatgtgatgaaaaagttggaaatttgtgtgtagaaaagttttgatgtgatgaaaaagtcggaagtttaaagaaaaactttggaagtaaacacggccttagtacttcctcagtgttttaatacataatgccatttacttttacatacacgtttgcttgatgagtcgtcctataaagcttacttatcatttattttattgtgagttatcttatcattaaaaatgatttaaaatgatttttatcttatatattcatataaaatttttagtaggtcaaataaaagttaacagtatcatttattaaaaagaatggacggttatattttattggaagcttctaaatgggcggtgatcatcccagccgtcggattaagatcggacggtcgtgccatgctttggaaaaatcacctcgtgaatggaatggatgtgactagagattaatctgagccgtcaaatccatcaagggcgcccatgatgtccatgatgtcactcgcagcatggtggcatcagtgatgatgataaaaaggggccaaaatagtggatgggccaaaagagaactcgtgttcatcatctcagggcttttttttttctttattgtgtttgacaatatgtagatgctaatatgcaaataatgaaccatgtagtttctacagaaacaaatgatgcactaataccacttctagtgctcatcttgcttgattcatattataagctagcactatagcatatcatgcctttggtctagaggcatgcagctatgcaaggtttttttagcattccaagtttgggatggtcaacaaaatgtagtttatgtcgtccatatgcagcattttcaatgcatagccatgaaaagagtttatcaatcaccatgtacttagtctaggaaatcattaatttatgttagtgatattactgtatataattgatttagtgggggatccagtaattttcagagctgggtcgaaacctaccatatataatactccatttgtaaataaaaaagaagagattttgggtggatgtaatacatcctgttcaaatttatggatgtcatatctattcaaaatttcttatattttaaaacgaagggagtaggctgctagcattgtctgattcgatattggctaacaatgcgaaacttccacctcttgcaatgcaccaatgagctcgaggacgaacatcctaggttagatctagctacctgtgtgcttcgcaagaatatcatatatgcttaaaatataaatggtttgctcaaaatggagatatgccacacgatattatgcaattattgtacatctatctacatgtgtggatgatgtagctcgccgcttttgcaagatgcggtttcaatttttggaagaaagatcgatagcttaagatcgatctttgtcgtatgatactattttcaaagttcaattgcagattatactaccgtttaaaatgaacctccgaggcaacatcctcattatgtgaagcatgcgggacaatgacaatttagataacaacgcatactttttgaagtgcatatggaacatagttcgattccatccatcaccgaattcaaattccgagagaacaaaatcagcgatgataaccaataaatatatatatactaccaaagaggattgctgatcttaactaattacgctatatatactaaagcaagatctttgtgaataaaaaaatgtaaaatacaacataagtgtgatagaggaagcacctttggtgtgtgcgagagctttcacaagcttcactccatataccagtgttcagagactatatttttttaatgtattaatcacaaatgtgtgtacagtaggggactagggatgtatgtgggtcagccacgaacccacttatagatcaaaataaacgggtttgcggcttatcttagcctataagtgggtttcgcaggttagccacttacacccctagcgtacagtatatatgtacatgtatgatgatatgtgcatcttttgtgttaatagatacctgtatattactattaccgcgggattaattttattgagaaacattaattgacctaattgttgatatttcatcgacactttgatcgaatatggatactccctccggttccattttaattgacgttttggataatgacacggtctacaaaatatatctttaaccttacttttctattgtaatatatacaataaataaatgcatgcttacttttattatagtactttaaaagacaaatctatatatgttgttttagtttctttaaactaaatatttttaaagttattgatgatcaaagttataaaaatttgatctcaactttatccaaaacgtcaattaatataaaactggagggagtagttgttaaacatgaaagctcctttataacaaataatcatattaactttttctctagtcaaattttttcaagtttaacctaatttataaaaaaatagcaaatatttttaacacaaaacaaatataatatcaaaatatattaaatgttggttctaatggaactaatttaacactatagatattgctaaaaaaatatttaaatttaatcaaacttaaagaaattttattagaaaaaagttaaaatgatttataatataaaatgaagtagaatataacatggaaatagataaggaacggggtaagaagagagatatattataggcatgtatgtatctttgttaattctgtcctgatctcttgctttcatccgatcgaggaagctaatctcgtgagaacttaagagtcaaaattagtctgctcgagcatgcagggttacgttttccacgcaccgaatcaaatcaagaaagagatcaagagccgtctccacgaggccatgtgccctgactgctgctgatcttgccttagttaaccgagaagatcctaccactcgtaataattaatcactgccgaggcttaattaacttacagcactgtgtgacagtgacgacatgcccaacttctgcacatcactgtttgatttgatcaattacttgtagaaaagtgagtttatactgacatgggaattgggactttggctgtgtgcattctgaatttaaaagattttcctttatcaccttctctgttttcttggattgcaggctaatgcatgcagttaaggtcaggagtgttcttagtaaaattttatctccttcatggaattggatgagttcaacaaaactttcagatgatttcaataaaactttcattatcttaaagatatacttgtagttatatatggtatcaaaattaaccttttgagttcaggcatgatggaaccactactcccaaactaatcatggccattctagagtgcccaagaggctccaatccacatgctcaaaagggccattagcaatgcgcacacctaattcatttttaataatgacctaattaatcctaccatttgcctaattgccttttgcatcgcacaactttactatgatcattggtctacctagattgtatttaaatcactaggcaccatgtagttagtgtggtgccggatcatcttagcaaaagtgcagctaaccacaagtttgttgctgctgccatcacattcagagacatttaatttcttgccttaacctttctcatttactaattctcttctcttccaattctcttcctcttgcgtgtgccaatcctcttgcttgaaagggatttatactgaacggaataagggattttgcgtcttggccataaatcctttgaggcctatcaatgtcgtctcctcgtgactatgtactagatacaaatctccggagaaatactttgttgtagttgatgggtccaattgcaagagattcttcagctaattattgggtagatagacatggcaatttttgggggtcaggactcaggacaacaatgactcgtaagagtgacattgccactgaacaaccagacctagctaaacatggtaggagaagccaaacaattaatcacaatttagtgaaagtgaccggacccaaatcatagtacaaagacacaatcattgaaacccttgctaactgaactctagagaacaaaggtttttttttttctgaaatcatttggagcttgcaaaaatgaaagaactgagattgaattaagatgttcacgaagctgaaaaaaaaaagggcaaaatatggctccattctaacgcaggaatctataaaggtgtagcttatttctcaaatttaagttctttttgtagttgatttttaaaatcagtcttaaagttcttgattgattaaaactcaattttctagtgacacaatttttcagaattagcttttaaacgctaataacacacatataaatgtgcattaattcgcgaaaaacacacttataaaagtgattgcttcttaatttctttttcgtggcttatcagcatatatagttatcagagccgcacaagaattgcaggccaagcagggttcacattgactcccaaatccatgcctaaccagtaaactaatccccaagtgttagccggttatggcacagccagccgccatgcacagaataccctaggcaaaccaatacaacaacacatactctttctctattaattaacacaccctaacacaattaataaagatttttttcctttaataccatttcttctggttgggtatgtttcctagcttggtgataacactagatggcagtgtaaagggagctggcggcggtaggtcgtcttcctcgttgccggtcggcaccctcgcccttcctggagctcctccccttctttgtggggagtttctaggttggattgaggcggcagctcgtcagcgggggaagctcaggatgccgaagcaatgccatctagtcccaggttctccttcggccaaaaatggcgaggtggccggctggtggtggaacggaggagtcctggaccagctctcaggggtggtggttcgatgaagtcggccaacgaaggggcgtcggtgcggtgtggtgggtgctgcgtgctgccttttgtctgtgtgggggttctgagttggtggacggcgatctgcagtcaagggtgtagggtcccaggtaaaagcctagtccggtggttcaccgggccggcagtggctacgtcttcgggcgtcgtaatctccttggggcgttgtcgagggtttccctctccctttctcgatgagtttctctgggtgaaaaccacatcttttttagatgggtgatggcggcatccttggatgtcgtgaccaccgtggtggcatcgttttcggagtctcttctctgtggtgttgccgtaggcctagcggcgttcggccacgcttagcgggggtcgtctggtgctaggcttcaccctcagcgttttgtgcttgggtggtagtgcgtggtgtgtggcaatgcacctcggtgcattttgttgttttttcttgtaacttttactctttaatatactcggctggcctccttcggccgtcccggagaaaaaaaaaagataatactaggcctgcagccctgcatggctgcaacccaacaagcagaaatggacactggaatcttcttgtgttcctgctgtcctaatttgtctccattagaggacatggatccttcccaagtgcaaatctcctcatggactgccctccccatgggggaaattgcagggggcaggcttgggacacagcatgacactgggttttctttgagcctcaagaaaaggttttttgggtctatggtctagtggtgttatgggctaagcaaaggaaaggatttgactggtgtgttgattaatcaacatgctaattattggggactgactggaagttggtgtacccctgcaaattgcaatctctgcactttttatctgtaacatagatgtgcatattttctttctctgtcaaaagtttttggctgaagtgtcaatgtgtcaaggtggtgttacagcctttcttctgaatttcttttctttatcttcacactgagtcctgactagataaaacactactggcccaagccaatccaatctaacctaccaacctgctgctcctaccattttattccatttttgcaagagtgagtcattgctcttgtctactactgctactaattattcactcatgtagtgttggaatgatggttcaaaggaatcaatcgatcactagcttgcaatacaaaattggggaggactcctgtcatgaaatggattattagtattaacaaatctgcactttcacctgctgtctgggctgtctaggtgtctccacgtgtttcagagttgccgggaaggtcctaatggggattagatttattgggagtatgaaccaaatctgttgttttgttaatttgtgcaagatttgattatgcagccggtcagtgtgagaggtttattccatggaccacaaagaattgtgccctaactactaaacaaatgtgtaaagtccgtgtgtaatggcgttagggagggtgaagaaactcggtgaaaaacacgtgtaaaaggtactgatgcttctcctagctgccactaatggttatggacagctgcaaatgatgctcaaacatggtgaggacagattattttgttcaaatttttatggctatggactcgtaactagtcgatcacaccacacttacaccaacacactcaaatatataagcatattacttagtcgtagaagaacgaacaaaacaaccagaagatgaaaagaaaagaacactaaaattaattgtggaaaaaactccaaaatcaactttaaaattaaattctaaaatttaaatgagccatggcggtaaaccaaccagtaaacaaatattttgtttggggagcttaaaaatctaaaaacagctggtttgtatctagcttccgagaatttaaaaaagttgattttcccaacttctgatttctaatttactgtatgggttctataactacgtattttaaaaatcctagccaaaaatctagatttttaaaaagaactagatattctaaaagaagctatagcctccaggttgttgcgggtcgccgccgtcagagctatgtccgcccccaattggatcgttgctgggggactgaacttactcttgctggcccatgtggccatgtatatgggccggcccaaatccatggcccatgtgacccatgtatatgggccggcccactccgtacgcgcggcgggccgcaacgcaaccccacctggccgggcccgtgaaatgcgtaaagcgccgtccccgaactgcgccgcatttgaccgattccggcggcggcggcggcggcggcggtttccgggacgaagaggcggatcggcgccggagatccgacgaatccacggcggcaccggcggcggaggtgctaggatggaatcggggccagcatttcttcaccccgcacattttgaatttttgatccgacggtttctgtgactcgaggccggagaaattggaaagccggcgcgtcgtcgtcgtcgagatcggcgccgtcgtgtgcatcgatgattcaacgtggtcgaggagaggatcgctcgcgctcgcggcggatcagattcagagaccgtccccaaacctcatgtaagttgttttagacgcaccaaataattttgttactgcttcttgtaatttgtaatatggttttgttgctgctggtgtttgtgtttctacggatttagattttagaatgggctgaacagactgaactcactcttgctgattttagtgttgattttttttatattttcttttgctgatttttattttgttattgctgctgctgttctctaacgctggtgattcttggaaggcataccgcataaattttgatgtgaattgaaagggtttgtactccctcgttctctaaatgtttgacgccgttgacttttttaaatatgtttgaccgttcatcttgttcaaaaacttttgtgaaatatgtaaaactatatgtatacataaaagtatatttaataataaatcaaatgataggaaaataattaataattacttaaatttttgaataagacgaatggtcaaatatttttaaaaaaatcaacggcgtcaaacattttgagatggagggagtatttaggaacaatggtaatgcagtgatcactatgagatgcagtaatcaccatgagaagatgcacaaaaagtttttttaaaaaaaatggcgtgctgacgaatgaggaatgatgctactaagcactgtgattctccttgggcaaaacagaagtacagaatcctgaatctaccttaccacaaggggaactcctagcagaaagctctcaagattcaagaacaacagatcaaccagaagcagcagcccctccctgacctctgtactgaaccaaaatgcaataatatgtggcatgacagattagtcccccaaccagccaaaattcacccatcctaagatttacaaaaccatcgaaccaacatcgaaaaaacatgcccccatacaagtagaagctgaagctcccccccaattctgctgcggtccgaacccgagctaaggcggatcacacggaagggaagaacttgttcaagttgaacggcagagagtagaactcctcgctccgggtgtccgtcttgaagctcctgaacttgtcccaccagtggtatcccctgtctctcctcaccccattgtcgcgcctctggatagtgttgtctaggaagtacgcaatgagccctgcgacgaacggctttgacgcgaagggtacatttatcatgtcattgaactgccatgccaaaatgatgaacatcagtaacctgtaaaggatttagctggaaaaaaaaagatatatagaagtacaagaaggttggaggttttctttacatacccatcgagcgccggtgtgcactggaccataaccggcaaccgatgtatactcgttgaagtactgaggaaccgataagcccatgaagaacgagaaccccacaatgaacttggtcctgaagctgttgagattgcagaactgaaggaagctcagaccacaggcacctgcaaatagaggcattgacaatttggaaactgcaatgtgcaaataaaagcacagaaataatcaaaagcctggtaaagggtgctgaatatctggaccacttaccaatatatgcaaagaagatgcaatacagtgcagcgaatattggtaagggaattgacgcaaagattgctccgaatttccctggtttagcataacaaacattattagcctaggaaatcatatggtactctgattctgtctatccttattaaaacttatatgtactctgattctctctatccctgcacacgacaactacgagcctactagatttttcttctgaaagctgatatggagtactaaagttagaaaaagcactgcacattaccaaggatagaaaagaagatcatgaagccagcagatatttgcactactctccggctgccaacatgtgtcaaagctagcaaaccggcattttccctgcaaagatcaatatggattatgacctacttaagagacaaatgggaagaaaaccagttcccaagtaatccaggccactaatttaattagatggtaacattacacttacactgatacagcagttccattggctgtcccgaaaaatgcacctattaaagtaccaataccctgcaaatgatactcagcagtgatcagtaaaacctagcgattgactaagatgatgcttctgggggaaaataatcaacatgtttacctgccaaccaattccacgaccaagcactgatggaggtatcatagtcgcacttgcatatcttgacacagcaatgaaggtcccagttgactgaaagatagtagtagcagcgggttaaaacttataaccagcaatctatgtttcactttcaggtaaagctgtgcagacaaacctctacaagagcaacaaatgaggccatcatcatggcaaaagattcaccagcatcaaatgttggagccccccattgaaaagggaaaggaactcttatcctacaagatttttttttcagtgcttctatgatgagtactatcaataaagggcccaggaagagaaatgatgaaacactcatgaattgcttaccatggagctccactgataattccagagcgatcaacacgacagtgcacttgtgtcttcggccgggcattcttgtatgcgccactagcagttagaatgtatgcatacagccacacaatagcaatggtgaaaatcacagcaaaccggtcgaacacgggctttgccacatgtatgacatggggtaaatactgcacaagggggcaaatgcagttagctcatgactttcagcaaccacagctatacttgtgtgaatatgcattatgactgctgcaatcacctgagaaaatacaagcagtagaatgatttctgggagcccaatttccacgcactttgcaacctgcacatacagttgtggcactaaaatcagtcttatgaggtagggaacagccaaagaaaaaaaaaagaatctccaagctaactcttacccctggaaaaccaagctcatagaggccaaatccagcaagtgagatcaaaggaacagcagacaatggactaagaagtctgtgaaagagtgggcaatggtcaagccacaaactaaaacaatacattgtgcaacgagtcgccaaacctgataactgaaacactgcagttggcaagcctgcaaactgaaatgatgcaattgcacaatgtacattcagaagttcaacaatgatacctacctaactacattgcgccagagaccactgaaaccaagtatgatctggattgtcgatgcaatgatgagagcaccttgtgttcctcgcattgtccgcaagaatttcttcacagcagtagcaaaatcttaccaactttacaagatcacacagaggatgtgacaatcttaatgcttagatacagctagtgcggatactacctcatgaggatctgcttcattgctatagcggccagccaatatgatggaaattgtcggcgcaacaatggtgtacgatcctcccatcacagctggaagacgagtcccgaagaacgattggcagagggtgtttatcccggcaacgaacagcagcgtctgaatcacccgagccttctcctcctgagtggcaatgcaacgaaatgcaggtacagttcatcagttttgacatgcaagctcatcacaaaattacagtagtaacagtttagatcttctgtgacattcttcaaatgcacatgtcaacaagtgaaatcaaccaagattcagatattggaatacttttcaggtgattcttggggagactcacatttccacctcccatctggggaacaagagcactgggaataatcactgatgtgcccagcatcacaatgtagtgctggaatccaagtatgacggcctcagctgcaggaaaagagagattcaaagtttcaaacccatcaacatcgtcaggaccaggtgtgagaaccaccagagtgaagtgaccacaaactacaaccaaccaacacaagcaaacctaggaggccgacatcgacatcgacatcatcaatgctgcaaatctatacggctaagagaacataaatgccacaaagtacagtggatgattagcagctccgccatcaaaatcaaaaggcaaagatggccttggtgatatagagagagaatcagagaagaagaaattaagagacgtacgccatggcggtgggctggtgatgcagtaggacacgctgggcagctggtccttcacctggtgaggctgcaactcctcctgcttcggcggcggcgccgcccctcctccggccatcctccaccacctccaagaacccaacaaaaatgggacaaacaaaggcaaaaaagaaaagaaatgcaggaaccaagaacagggagtccaagaaccagaacagtgcagtgaaagcacaaaactcagagagatttcagagagcagcaaacaaaggcggctaccgattctttgcgtgcaaagaggagcaagaacaaaggaggatgaaaagaaagggagacagctacagctgctgcttcttgctttctactactactcctcccagtgcgcagtggagtgaagcagcagcagtgcaatgcaatgcaacacactcgcagctagcagctactacctgggtcgaaggaatctacaatgctttgagcttttcctccctcttttatgtttcccttcttttctctcgctaccagcaatgctttttttctctggccatgggatcggagtttcgcctttgcgccaccgcctccgcgaaaaacgcgccctccgctcctcttcccaagttgttatctttttcccaccaccgtaaaggagatggcagagagaggaaaaaagattgcaaattccacaatgggaagaagttcgggtctgtttggttgatatcttcgggtctgtttggttgatatcttcggtatactccctccgtcccaaaatataaacatttttagctatgaatatgtctagattcataactaaatattgtaacattttgggacggaggtacttcctccgtttcacaatgtaagactttctatcattggtcatattcatatatatatatatgtatttagattcattaactatctatatgtatatagattcattaacatctatatgtatataagcaatgctagaaaatcttatattgtgaaatggagggagtagtattatatttaaggttagctaggagtatgtcacaactttttaaataactatttggttcattgtcacaatagtctcttgtcaaactttttagacacatggacttccttgtcattgattcaagtttttaaccaaggttgtgtttagatctagtggttgaagtttcgtcgtgtcacattggatatacgtgcacatatttaaagtattaaacgtagtttaataacaagacaaattacagaatccacctgtaaaccgcgagacgactttattaagcctaatcaatccgtcattagcaaatatttattgtaacaccacattgtcaaatcatggcgcaattaagcttaaaagattcatctcacaatttacacacaatctgtgtaattagttatttttttcatctatatttaatattacatgcatgtgttcaaacatttgatgtgacagggtgtaaaattttgctagggatctaaacaaggcctaagcttgtaatgtggataaggatctataaacataattctgtgataagccacaacttatcacaattgtgatttgataaagttagccactaaggccatcaacaatgcgtgcccctggagagtagcctcgcaaatggcatccaacttccgtcgtcgggtcgtcccctgggagggaggtgcgacccccacgcgggggacgagtggctccgggctcctcagctcacttttcctgagctactccatcggggctacgcattggggtgacccgatgccccgtccccacctcctcccccattgcttccccatgttgcccctcaccggcagcgtgacaacgagagcgagagagagagagagagaagagagaggcgacggcgacgggcggagacggcttgaggcgcccgtgctcgccgccgaggagcacaaggacgacgtcgtggtggtggtcatcgcgctcggggacgacggcgacgacggccaccgtgcgccttgcccggccttcttcgctgacaccttgctcgccaccgctggcgccgtgcccgctaccgccggcgctgccactgtatcctccccgatctggccgcgtggagctcagatccgcccactacggtgccggatctggcgcccctgaccggcgacggcacgaggtggaggatgccggagaggacagcgataggcggcaatgggagagagggagagagaggggcggcggtggacgccggcgacgggagaggcggccctcctcgtcgtcctcgcagccgtgtgcggcgagagggagaggcgagtgcggcagcgaaaaaaagagaatagggggcaggagagagagatcagggatagggtagtaaaaataaatatgtggttttgtaggctggaatattcattatgggttggagtgtctctattaagttgtttcagattttgaggagcccatccagagatatcctttattgtgagctgagtttctcctacgagtgttctcagttagtgagtacactctaggagtgactcacattgtagaatgccctaacggaaacaaccccaaatcttcaaagtttttcctctctagagagtcttttatctctctctagtgtaggtagagaggagcagggaactttttgccactgcggtgcaaagctttttctgctttggctgctgctgctctgcttttgctgcggctaaaatggaagaaggggaggggaggtgcgtggagttgaatgctgctgggagcgcatgtgagcctgtgtgagcagagcagccatgggcaaaaatggacggcctctcctctcctcgcagtcgaaacgcaccgttgcgtgtagccatgtggtacgcgttggcgtttgccgttgccaactcctcatttgcctttaccgttgccgttgccatctcctcatggctagctgttcacgcttaggcgcgagaaattgaacggatcgagaagctcaatttccttaaaaaaaatacatgaaatatgcataatcttacacatttgcgattacacactctaacacactaggtgagttatctagagctttttaattttagccactaacacttctcaaactgctaaacattgtttcatgaaataaaatcattataaatgtttttttaaagaaacttgattctcatttttaattttatagtagttaatatttaattaaacatgcactaattaattattatctcatttcacgtatggctgattagccaagctaaaaaactgaaacgaactaatcctaaggctgggcttagctagttcatggcatgaggcagatgatcagcgtgtgattaattaactttaaatactacaaacttaaaaaaataatttatttgatttttagtaaatttatatttttcacaaaacacgttgtttgtaattcgggaagagtgttagctaatctcaaccatagtatacacttaaaaaggtcgatgtcaacacggtagcacttgattttactaaagtcctgggtaagttggattctatatgaagaaa

SEQ ID NO: 47079 - DNA, 10132 bp, Oryza sativa
accccctcgacccaatccggcgcggttttgtcctacgtggcgtacgcgtggcaatccagtcagtaccttatttattaaaaaatggggtccccctgctcagctcgcgggatgaaggatcggcgcagcctgctcagcccgccgtcagcctcagctcctcgcccgctgcccgtagccgcctccggcctcggctcctatcccgccgtccacagccatccccgccgccggccgcccgtcggcgtcggctcctcgcccgcccgccgtctgcagccatccccgccgccggccgcacgtcggcgtccgctcctcacccgcagccaccttcacgacagcccgccgccgcctccgtgcccgctcacctccagcctcagctcctcacccgccgccggccgcccgtcagcgtcggctcctcgcccgcccgccacccgcagtgttcagttgttcaccgagagagaggggggagagaaggagaggaaaaaaggtgttgatagctaggccccacccgtttatatttgtttttgctgactgtatcgccacgtgtgtgccacgtaagctgaaaaccgcttcgaatcgagttagggtggaaatttagccggttttaagtgtttggggtgtcaaatgtctggtattatagtttagggggggtaaatcgtattaccgtaatagttgggggagggtaattcgtactttttttctttataaaaaggaggttattatttttatggaaggagtacttattagtgtcgattactgttgttccgaatttgaccatcagtaagttttactcctaatcatcaatgtatattggacatttacataaaaaaattgtatattggacatatatgaaaaatattcttaaactttagaaactgttaatcacgattaatttctaagaggatttgggtgtgtttgtttgtgctgttagaggagctactccctcctttattgtggacacacttatcaaaatactaaatggtacgttttttaaaaaaaaatcctatataaaagtcttttagaaaataaaataaatcatttaaagtttataattattaatacttaattaattacattttaatggtatgcctcaattcatatgccactaagtaagctgagccaaactgcacatttgaacgaagccttagtgtaaaaacaaaataatggttagtgtgacccccttttatttaggattttgtggaagaattttgtaggatttaaatcgttatccttttgaaacaaaaaattagagctttccaagtcctatagaaaaattcctatggaatatctcgatgtaaattttggaataaaattagtaagagctttaaccttttgggaaaaaaagagtccaaactacatataatttgactaaattatcataaaactatatatttaaggtgatatccctcacaaaactacagatttaacaataaaattatcacaaaactacaggtttaaggctaaatatcacaaaactacagattttggggtttaaattcttagcactaatgctatatttgagtgatgtatgtccaagttttctgattgatattaaacatatagttttaggataatttcattagtaaatatatagttttgtaatacttagccttaaacctatagttctatgataaatttagtaataaatatgtattcttgtattatatcatgttaaatctatacttttatgataatttgattaaaatacctatagttttgtgtttactaaaaaaaatccttctgaggatatatctctcttatttatttgattcctgcattttttcttcacggtcattcaagtgattgtccttgtattttatttcccatgcatttttataattctctattttatatatacattcctagcaaatatgttttttattcccatatctaccattcttgcatggctataaatttgtcttggaagtaaacttattatattttatagacttattctgacacaaaagagatggcaaacgttttaaatagtttggcataatattattcttagcatctgatatttatgacaagagagtgtatactattagattatgatgaacaaaagttgcatgattctattcatgatgcaaattagtttgataacatgtcaaaattaaattcaatattgtaaagagggtaaatcaaaatttgaagatgaacgctactcgtattatttgaaaatagagataacagcataatatatgtatagggtggtggggaacatggaatttattctctcgagacaggatagagtgccccactgatgagtataccctacacacactgtaaaggaaaacatgcagaatcttgctggattaatataccagtcgaagtacatccactcagagggagtatattacaaccatgaccacgaggaggactgaaccagttgaaaacatgccgaatcttagttagcataagcagcacatcactagtagccaagtaatcctgcctcaaatcttggctttagcatgcaatcctactataataatgtctatttgaattttatcacttcgttttcttatcatatatttgtacaaattattgaaagtataacaaacaaagaagtatttgttaatgctatatcaaatcttagtatctttatatatatatatatatatatacatatatatattagtgatttaagattgtaaaaacttgactcagcaacaatactacttatggagtaagcattagtattaccttgaccactaattattgttaaatggtcagactgtgtttaccatctttaagtttttttgtaattttctatagaaaaactagaggtcaaagtttgatgaatagtttccctatgaattattatctccatttaatattatagaacttcaaacttcttttagatctgaataagcttatagaaaaagatattaacattttgaagacaaaatgaacatactatcgtatcaaatatattcgatattgtatttaatatactaattcggtattataaatgttttttattataaactttgtcaaacttttaattttgaaaaagtcaaaacaccttacaatataaaaaataatggagtagtatttttttaaaaaagtgtgctatcttgtttggatgatacccacactattcatagaaaaatatgtagtgtaaacatgtaaactaccgttagataaacaaaataagcgtcttatatatgtccacgtcactatgagtgaaacttttaatgatggttaaatttaggagtaaaagttttacataggacaacatagataattctcagtcatctaatttttatccaacggtagtttttaggttcgcactacctatttttcccatttttccctactttttttctaaccatacttagggtgtgtttagtttacgccaaaattggaagtttgattgaaattggaacgatgtgatggaaaagttagaagtttgtgtgtaggaaagttttgatgtgataaaaaagttggaagtttagggcctgttcactttgatgccattttcaaccttaccaaattttagtaaagttgtaaaaaaatagctacatttagtttgctgccaaattttgataactatataagaaatcctgccaaaattttggcatagttatcaaaatttcggcaatgccaaaatttagtaagttttttttggcattaaagtgaacatgcccttaaagaaaagtttgggaactaaaccaggccttgggacaaggttttgcaaaagaatgaggttatggactttatgatatggccaagagtttagcatgacaaaacatgacatgcaactaaacagtgtcgtgtctataaggacaattttgccagtggatttggtgaaagcatcttggctttaacacagaccaagaccaaggaataaaactgaagtgtacgggcggtcaacatgaggattgatagtactactcctacaccatgaacatgaatgcagccgttctactactactccgagtatctctcctcgtgcctctgccgcctgcttgtgtcatcgtgtgcaagcacagtagcacgcctacacaccatcaatggaatcagagcacagtggaggagacaggacgagtgtttttgccgtcagctgcatccgttgcctatcatttattattatattttgtaacctagaaaaaaaaacttttatgtaatgttggtatgtacttcctctgagaaaactttattaaggaaaaaaactaaaaatatcccttgttaatgctccctccgtccaaaaatataaacatttctagttgcttatccagatttataactaaaatttattatattttggacataaagatagtaagtactactggtaccatttacacgtgaatattaaaggattaaacttcttgaattgtgaatgcggacatcaatgtccgaattcatatgtttcggatgattttaagccccttaataaattggatttttatggattaattttaaatgtgttatagcgtgtttctacgagcataactattatcaatagtctaaaagttaatataaaaaatagactacatttccttaaaagaattaataaaagacaacgatgacaaacactaaagggtgtgctcgaaactgctctttcaccacaaattttagctgcatgcaaaacgagatgaattattagtttatattaattaattgagtattaaatataaaatgcatttgtaaaaacacatcgtttagtagtttaaaaagcgtcctcacgataaatgagggagaaatagattcacactcatgtctgaactcagtctaacttttaaaatttaaattttggccgtggccaataaactaacaaatagattaggaaaagtacgaattacccccaccccgaactatcgcggtcgtccgaattaccccctgaaccacagaaccaaacattctttacctccaactatgcaaaccggacgaattaccccccctcaaaccaattcagagcggttttgtccaacgtggtgcacatgtggcaatccagtcagtgtttttttaataaaaattgtgggacccgcttgccatactcttctcttcttccctccctctctctcttctctctctatctctcgcatggcatcggccgccttcccctcttccctctcttcactctctctctctcacagagtcactgggtggcgcagggcagtcgaaggatggtgcggccgacgacggcagcttctggggcggcgcgtgggctcagggcagcgcgagctcgccggcctccctgcccccctcatgcaggtcggcggggggtggcgacgcagcagcggcaggcgcggaggtggaagcatatggatgcggcgccggcgagcttagggcagagggagagagtgtaggatcaagatgtcgactagaggagggtgaataggcgatttaaaactaaatgacacctaatcaaaactaacctaagttgctaggcttggtgagggtcaactctaactaagcaactaagttatgttttgcaaacctagggtgatagtagctcaattatatctctaggaaagtaaatcacactcctatgtcaatgtttagcactcctagggtgatatgatctcaagtatgtctctagaaatgtaaattgcacaaatgtaaatgcgacaatcaaatgagacaaggagacaagagatttttcactgaggttcggaaactcgccagtttcctactccccattgaggcgagcccaactccaccgctcaaccacgaagccaccgcacgcccccttcgtcaaggggtgggcaaggcaggagccggcccacagagaggactacccaagcctcgatcactcggggtagttcttccttcactccgaatgtggtgaactccaaaccactcacaaaccggcgccgggcctcctccacaatcttctcggagagatcaccgggcaactcctccacaagccatctaggaggcggcaacctccaagagtaacaagcaatgacctggcatggagatgatcaatcaagtgccacactagctctacaaatggaagcaatgcacttgactcttggctaatcaaccctctaacacactagatggatgaacacaaagctaaagtgggtgtgagagaggtgcaaggggtgtatgcaattgaaatgggtgccaagagagtccccttgctgctggagggggagtatttatactcccaccaaccaaaactaaccgttaggggcgaaatcccccaactctgtgctttgccggtctgaccggaggtatgtggccggtcagaccgtcctactctacaacggctagttttgtagccgttgtagggctgtcattgggccccactgcctaagtcggtcagaccgacatggggtggccggtcagaccggcctcggctcggtcagaccgccatcagctcggtctgaccgaatacggctccggcggctcgggatcgacacaccaagacgacaccatcccggccatatggccggccggtcagaccggcccgcacccgccggtcagaccggccttgaggctgcggtcaggccggctatgaccctgcggtcagactggttgccctggccggtcagaccggctctaaggccgcggtcagaccggttcggtcaggccacacagtgaaaacataaattgaaatatggggagtctaaatgcgagcacaagtctaaatgcataatgacctaatgtggcaattaaaatcatctctttgctaggtcattacccctcttaatagtacggcaaagatataaataaactagcacaattttgattgcctaacgcctcaatcaatttaaaatgtaaacactagtttaccgtcttctcttccttttgctttgcgccgtcaattttaatccatcaatgatcatccatgtgcacacaaataagtgaacctaactcaaacaaatagctcaaacacaatggtagtccacaattagtgcttgccattaattaccaaaattaacactgggggcctagatgcttcagagagaggatggagtggaggggaacagcgtcatcggcacggccaccggtgagctcagggcagagagagagggcagagtggaggggaacaacgtcgtcgctacggccaccgatgaactcgaacgcgtcgtcggcctcctcgtctcgcaaagccgcccaccgaccgcccccgcgtgccgtcgtcccccgcccgcgctgcgaggcagcgctcgcctccttcgccaccgcactcatctcctcgccgccgcctcctccgcttgcatcctcctcgccgccgtgctcgcactccgactcctatgctggcgtcgtccccaatcgagaacgagccgccgtctccagcgccttcttcgaggagatctcgagctcctcccccttgtccccgccatcgccatcctcgtccgcgccaccctcatcccccccgccgccgccgcgcgatgctctttccctcgcctgcggcctgccgcctgtgagagagagaagagagagaagaagagtgagtgagggagaggaagagtggatgagagtatgacaagtgagtcccacaaattttttataaatagaatgctgactggactgccacgcgtacgccacgtagactaaaaccaccgcggattgggtcgagggggataattgtccggtttgtatagttggggatgaagaatgtccgattttcaggttcatgggggtaattcggacgaccgcgatagttcggggggtcatactttttccaatagattatgagagatatgttttttttttcacatgtgggataatgtggttgaaaagtgtggaaagttaattgtggcatcaatgagacaaaaatctaaggagctctatagggttgagtgtgatggtttgtttattgaactaaacattccataggtagtcagatatctagacattacattttacagcggcggagccagctcccacgcagagtaggcggccgctcaggctctctcgctggtgtttccactatggacacctcagaatactattagtcgccaggcttaaaggcttcactaattcgagagtattttagaacataatcccttatgtagttggatccattggtggtttgtgttgccctctcgccacctcacgttgtctgtctgttttgtctatttctcatgcatactcccttcgtaaaaaaacttctgattataaggataaatttagacacagtgtatctacagattcatatttaagattattttttttgacagagaggtaaatgcataacctaaggcctctcttaaattgaagaatttttttttgcacaaaatataaaatcatggagtatattattttagtataatttttaatgagatttttatatttataagtttattatgcgagatatatttacggcaaaatttagttttggatataaattaaaatactaatatttatttattaattattaaaaatgggataggtagcatatttttgttgattgtagtacaacatatttgatgtataagataaatctatttatatgctacctaaacagtttttaataccaataaataaataatatttgtaataaataaatattatgttttatatcatattacaaataaattttattataaataatatctaactataacaaactcataataattataatagtcttaaacaacggatttctgccctccaataatctataaacatatatgtttcttcaattctcatgataaaatggttttttctataggaatttaacagtcaacctgcgattaactaacgaaaaagatatgaaagtgatctaaatttaagtttgacatacgtagaagaataactaaaactcaaacgcatagatgagattaaataaaatttcagaaatacatatgagattttctcaaactaagagcaagcacaatagcaagctataaaccaactataaatatattttaaaaagataaaggaagtgagagaagagcagcgggctacagatctgtagccagctgcagcacggactttaagacgtaatgtttatatgacaggtgagactagatattaatagtatagtaagcaactattatataaattagctattacattagctatagatgatttggagatagtaattggctatacgattaaacttgctctaaagtgacataggcataacctaggacatgactagtacacgatcacactgtcaacacaaacatttctttacaatgccagagtaacatttctttactatttcgacaccaatgtaatcattcattcggaatatattagcacgtgtggcggtgtacgtccacggaggagcagtgcagagctctgcctgcgctgggaaagatgccgacgttaaaaactttacgatgcgggcacggcttttgaggtagagagattgggaggagagaaaaaaaattaaggggttgggaaattgggatggcgttcccttccctctcggccggcgttccagttgggccagggtctcatcaagtctcgctgcgcccggctcaggaatccaacggcctaccgagggtttacctgtttcaggcacgtactgtaggagcagtactcatccacatttaaaagagcaggtaaaataatcagctataaaaaaggagagagaaatacagtgggctgcagcacagactacaaaatgcatatgtgttgacaggtgggaccaaaaaaataggcaactactgtatgaattaactattaaattaactataaatgacttggagccaatagttagctatactactccctccgaccttaaataattatagctttatacggctcatctccaacatttaatcgtttatattatttgaaaaaaaaattatgattagtattttgttgtcattagatgataaaatatgaataatactttatgtgttactttttttttgtttttttcataattttttcaaataagacggacggtcaaacgttggacacggatttccacggctgttcttatttttggatagacgtagtaaatagtgactacaagtcaactataaacacatgtggatgagataagagcaaatacaatagtagaccaaatccagctataaacacatatcaagaagataaaagaggagagaaaagagcagcggactacagatttatagccaactatagaacggactctaagacatagtgtatatatgacaagtatgactatctattaatagtgtagtatatgtttatagatactccctgtatctacttttgatagtcatatttcatcttagta

SEQ ID NO: 47080 - DNA, 1423 bp, Oryza sativa
tcatgcataaggaggttcaggcgttggcaaatattgcaaaaattcagccacaccacatgagttttctgttgatgatcttgggaaaaattgatgcaaatgcagctcttaaaaagatagcggctagatctacaccaccagtaaaaagagtaataaaagcacggactgcacggtgagctgcaaaagaaaccaatcggacatacctaatcagggcctccacggatgggcggttgagaccacattggcaaggcttgaatatttcagtcgccatgtgaagaactgttgatggagatcaagaagaaagaagcctaccttggaaagttgtcatgacctgaggccatgacgggataaacaccgccaagaaaatagctgggcggcgtcggctccggggggaagggatgtagatttaggctagggagaagaacattgttggaagggagagattagactaattgatattcattccttaattcataataaacacaatcccatccttatatagatggtaccaacttgacccctaagtaaagacttaatcttatcttatctctaactaactaataatcttatctttaacttaattgatctggattgcttatgggcctctgccttccggcccaatgcccatgacattatatcctccttttgagcagctcgtccttgagctgcaacacgatctttgctggctgagacaactccctaaacaaagcctaacatgactcaagccttttacatctcggcttgctaaattattgcaaactaataaatctaagataattgtagatcgccatgctaacttgatgtcaacaactgctgatggaccccatccggaagcactacgagagaggattagtctcatcacaatgcaaagccgaaaagccaatctggcctgctgatccatgtagagccacgttgtgcagcaacaagaaaaagattgttgggctagcacgtgagacccatccagccagctatgcgaaaaaagtggagcctctgaattcctttctcgcacacgccgtgaatgcggtgccgccgaattgcccattcactgcaccaactgtcgtctccaaaactagcggcgctgcctctgacatcagcatcgtcgccgcaacaagatgtagcccagttcgtcagcatcgctccccttcgttgacaatggcgccgttgccagggccagcggcaaggatcccctggaagcgtccgctgtctgatgctcccttgttgctgctgcaatctgatagccaaggactgtgccggcttgaacgatgccggggagcgaatcgccacccacggtcggttgggaagcaacccatccttaggtggtggtctcccatgggttgacctgcccctcgaggcgctgatatgcgtgcaccacttcaagacctgtggatgttgttgtagtgtatagaacagacaaggggtgcaggaa
